United States Patent 6,812,339 (POLYMORPHISMS IN KNOWN GENES ASSOCIATED WITH HUMAN DISEASE, METHODS OF DETECTION AND USES THEREOF) - sequence listing, part 52

SEQ ID NO: 15174 - DNA, 56241 bp, Human
  misc_feature (1)...(56241): n = A,T,C or G
gagggccgtgtcccaggagtcagcagagcagaaagggaggctgagggcgatttgggcaccgctgctgcagcccctggtactgatggagaaaggatctggaaagtggggcagtgcggggggctcctcttaccgggtttcccactgcagactgagcccaggagacctcaatcccaggggaaaaggaccagaattctcttctgagggaacagaacacacagattcagcagcagcaggagtgacagggccctgccgggagtgagaggcccagctcctcctgcctgcgctgccccggctgatggcgctggattcctcgagccacacctgtcaaagcagggctgaacctaacggttgcccaggtctagtcccttctcaaacatgccacttccgtgtcctgaagcacaggtctgcggcggacctccccaggcccaggatgccccgttgttggagtcactgagttctactgatgtggctctcctgctgccgtggctgcagacggagggatgccacagccccccctgcagtgaccaggcacaggagaacatggccccagagccaccacgggagtgtgtcttgtctaaactgactcagaaactctgctccctgagcggctcagtgacacaaacaccctcctctccctgcatttcacaggcagtgaggcacgcggcctctatctactacatctgcctgctggatgtctcttgtgttccgtggtccgtgccacccccaggctgcacctgcctagtgcagttccgaagctcctcctgggtctgcttctggccatcctctgacaagcacagacaggtttcaacggaacgcaaacacccacctgcccccgacatctgcagaggtgcgcctgtgccatggtgacgtccgaggtatcagaacgagaccccataaaaataaatatgttacccagagacagcaacacttacaaaaaagggtcagtgtgcatcactgatgaccatttaacccgaagcagatccaggtggaataggcccccatgcccagctgtcagggccgctgccagaccaggcaagtacccaagaaagaagggaggggctcaagaaaggtgcaatgcgtgggattctgctgcaaagaggcgccgggaggagctgcagggaggcccccacaggaagggagagcacgggaggtgggtctcggcacccgtcggggcatggccccttcttcccctcgctggggtgccacatgcccgcccggggtctgcaggaagcgaggggtactgtcctctgattagatggtcagcctgggccttgccgtgtggctttcctatgatgcccatgaaggcagtcccaggaccacactgcggaccctgaggaggtaccaaaaagggagggaaatgccccccatgcccacacatcggggccactgccctacacgggttccacaattctcagtacctttctccaccacaggcctttgctggccaagccttgatggagaggggctccacgtcagtgtggaacctgacgatgcccagcctcgctgtctgaaaggaggggacactctctctgtacctttgtcttgctgggtcagtgaggcagggaagatggcaggcggccaagagccagcaccaccctggcaggggggacaggccctgtcctaggacccagagacagccacatcgacgcttgcgccgtttccttactggatgatctccaagcctctgacacccttgggattctctcaacgagatatctcttccctcccagagctcacacactttgtacgccttcttcctcccagggtcccattctggtagtgaacaagcatcgtttgcggtatccctggactcacacctcctgaggacacctggatttttttaaaggctacaacataggtggaccttaaaaacattatgctaaatgtcaatgcatttgaggacacggccacgcataggagtgtcatctttgcacaaaagcccaaggtcatgatccacccttcataggcctaactcaagtgctgtcttcctagtgtcaaccatggatgtcacatacttccatgctgtgcccgatgggctcagtgacataaacatcctcctctccctgcatttcacaggcggtgaggcacgcggcctctatctgctgcatctgactcctggatgcctcttgtgttctgtggtccgtgccacccccaggctgcacctgccccgtgcagttccgaagctcctcctgggtctgcttctggccatcctctgacaagcacagacaggtttcaatggaatgcaaatacccacctgcccccaacatctgcagaggcgcatctaggcctgagaggctgggccaggctgcttcaggctccacgcgttatcctgggggcttccaaatgtttccactgtgcctcgccttttggtatgagatttacatggctgataagcccagggattacccagcggcattaggggctggggacttgaggagacaggttgcaggtggttccagctgaagccaccccagcctggcccaaattttgatccaggacacaccagaatggcacatctcagacgagttctgccacccaacaaccaaactcccaggctcaggctgggcactgtcctctcttggtaaatccccatccctgtcacatacagggatgagtctccatctctgaactccactccgtatccaacacttacctccgtctttgtccaggaaatgctgggaaattcctgctccttcaaaaggtacagaaaaaacctgatttccaagtaggtgtttgtctcatggaagtcaatagcatgtcctgcactggggatggctctgaaaaaaaaaaaaaaaaaaaaaaaaaaaagcaagtttccatgtgcctgtaacccaaggcatgggcatcctggaatctctcatggtgtcataaacacaatatccaagtatgcacccaagagaaatgaaaacatatgtccacgcagagttctacactgcaacgttcagcgttattcacagtagccaaaaggtgggaaccacccaaatgcccatcaacagatgcacagataaacaaaatgtggccattactcagcctttaaacgagtgaagttcttatacatgttacaatttgcataaacctgaaaaacattatttgcataagccttgaaaacattatgtaagtgaaagaagtcagacacaaaaagccacatagtacgtgattccttttagaggctgtacccagaataggcaaatctgtagagccggaaagcggattagccgttagcaggggataggagaggggaggaagcgggagtggttacagtcatcccttgctgtccctgagggatgggttccaagtcccctaaggatgccaaaggccacagttgctcaagtccctgatgtatgcatagtattttcttataacctatgcacatcctcccacacactttaaatcacgtcgaggttacttaccatgcctaatacagtgtaagtgctatgtaaatagttgttacacagtatttttttaactttttcatcacctcataaaaacaccctgttccagctgggcgtggtggctcatgcctgtaatacccggcacttgggaggctgaggtgggcggatcacttgagatcaggagttcaagaccagcctggccaacatggccaggtacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggagttcgagtaccagcctggctaacatggagaaaccccctaaaaatgcaaaattatctgggtgtggtggcacgtgcctgtaaccccagctattcaggaggccgaggcaggagattcactcgaacccgggaggtggaggttgtggtgagcggagatcatgccattacactccagcctgggcgacaagagcgaaactctgtctcaaaaaaaaaaaaaaaaaaaaaaaagacgacacaaggcagttccaggggcagagatttggaatattttgaataaagggggaaaaggtaagaagatactacacaatgagggctttagaagaatagtaagaatttttgaggctgcgtgcaatggctcacacctgtaatcccagcactttgggaggtcgaggtggtggattattcgagcttgggcaacatagcaagacctcatctctactaaaggttttttaaaaaattagccgggtatggtagcacatacctgtagtcccagctactgaggaggctgaggtgggaggatcacctaagcctgtgagttcgaggctgcagtgagccaagatcatgccactgaactccagcctgggcaacagaacgagagcctgtctcaaaaaaaaaaaaaaaaaaaaaaaaaaaaagtaagaatttttggaattcaaatgtgaatttttaatctttttaattttacgaatcatagagaaaagaatctgaatgaagatctggaaatacaatttccagtctctggctttgcttggcctgatcatttccaaacaaaccttaagacttgctgttttgcccaaattcttccctagtctaatcgtcaggcagatgtgaccgtggggaactggctgtccccgcatcagcagcaggcagcggcattacctgaggtatttccttcctggcagttgatcatagaagttcatggttccatctgtgcaaagaattcatccccagatccgaaaaccaagagctctggtttggtctgataatgtgtcatatggtcttcagaagaaagcagaacaatcggtcattccaaaggtcatttggaagaaccaaggtcattcagcttctagttgtgagtggaggctgcagagggaccctaggaggcgtgggaccctagaggaaccccagggatgagtgggtgtggaaggggcgccctggtcagtcaatagtcaacacaagagcactattctagtcacaagtgggcccaggaaggcgttgagactggtggccgggggcgcctgctctcctgcccaccaaccaggtgacctgttcaagccactgaacctgcctgggccttagtcccacagcgctggggtggaggcaacaggcgtcgctgactctgggttattggggtggcggggttagatcaactgccaacctggcgaacgccctgggaccacgcatggctggtaaggaactctagaggggatttttcatccttattattatgaccggcgcccctccatgctgagtgatgtgctgagactgtgcacgccaccctctgcccccttcatttcaaaaatgcggaacggaggctgcagggggccacctgcccagtgtgcacagctcatgaatgaccggatgaggtgacaccaccatctgtcaccccagggccaggcctctgtcctccccagaaacttgtcctcgcccactccacctgcaagtcctctaggggctgagcactacacaggaacacgtgcagattccagcacccagaggtccttcacacctagccacagggcctctggcagcctcggccatcctctctgcgtgcctgcctgaggcggctgcgctgagcagtgggggacccaggaaaggtcacggctcccccagcacatctgacacacctcccgccgggccagctgctggcttcagcaagcagacgtccccttcctatggaaaagcccatgaaagctgatttgaaatatccgagcagctgtttgaaggacgtggatcagccctgttcagcggcctgagcggagagcggggccagaggtacaagcctgggacggcccgcaggctctgggagacacaagtcttctcagacttaggcctcatgggaccccaggggcctggtcagctgggttccccaagggctcacccacagagagcctccgttctcagtgtcgctgtggatgaccaacactaaaacccccaagcccagaccgcacctcgttcccgctcacctcggaatccctggagaaatcagacatcagccctttaaaagttccccagtgactttaacgtgcaacccaggtggggcgtcactaggccaggtgtcacccatgtgtgcccccaactggaggccctcagtgggcttgttcgagggcctccaggctggatgttcgccccagatggcccagatggcctattttgtgcattgtctggctgtgtggaaacagaacagcaccatagtgacatctagcccggatgtgggcatggcccaccgaccactgaccgcctacgtcgttacttccaccccgagcgcccgcatatcccgttccgttcacctcccactggggtcaacactcccttcacagcctccatcttccccggggcagtcccattgctttggagacttcaaaaaattgtactcacaaaaggggtcgacatgttctatcttctcctggaagcggggtgtgtccttgttcccagtgacattcagcgtgtgcagggcccgtacgcatgcactctggcctccaaagcacctgtcgttgtggagattccacagcaggcagggtggagatggtgagccgcagacatcacacctgccccaggtcaggctgaggctgctcatcaggagccccgagacctcgaatgcaacgtcttcagatcccaattccctccctgcatggagcagaacagtgtctctcaaaaactcacgcccacgagaagtctcagaatgtggcttttagtagaaatagggtctctgcagatgtctttcattaagctgaggccatattgagtgagggtggatcccaatccagtaactggggtctgtataaggagagagaacagaggcacatgaacggaaggtcaagcgacaacgggtgcagggatggcagccaggcagccacaagccaaaggacgcccaggatggtcagcagccctggaagccgggaaagacaagggaggctcttcccctacagcctgcagagggagcaggtcattatctgttaatatcttgatgttgcagtttggcctccagaactgtgagaaatgtgatgttgtttgatgccacccagtttgtgttcctctattacagcagccccggagactagtaagtgggtccctggcagaggaaggggacggagcgtcgaattctcctccccgcagggagccacctgggctccgagaaacccttgcaccggccagaggccatgacactaatgctggaatgttctctgtgagcgatgaagctttcaaccagactccgctagagaaaaatacccgacagaactgtttacccgattaaatgaaattaaattcagttttcttgttgccaagcagaaatgaggccctgtcataggaatgtctgagcagttataaaaataggagttcatgtttgcacatagctggttgaaaacagaaaattcacacctgctctaagagataaacaatgcacagctgagcgttgaactcacacaaacgagccaccatgcactgcagaacagaaacagaagaagacttaagaaaaaagccaagataaatgatcacagccaggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcaccagacactcaacctgctggcgcctggatcttggacttcccagactccagaacggtgagaaatccatttctgtttaaatgacccggtgtcagatatttttgttacagcagcaggggtgaactaagacacacacattttagacaactgcctacataactaataagaatgggccagggggtggggggttaggggagggatagcgttaggagaaacacctaatgttgatggccggttgatgggggcagcaaaccaccatggcacgtgtataactatgtaacaaacctgcatgttctgcacatgtatcccagaacttaaagtacaaaaataaaataaaataaaataatgggccacgcaggagcccccatcctctggactccccggggctccctatttggacagagtaaaggaaagtccctttctcagttgtggactctgaatagggaagtctgtcaccctcatggtgtgatgggtgaggacttaggaacgtgaatcccagccccagatttgctgctaacttgtgggcaagaccgtgagcaaatcacttacctgtgagatgtcccacctccctatattgagggactatggaggacacttaagccccttcaaccccctacgttttataggaggctcatcatatatacgaaatgctttatgtctgtcttacactgtggatttttcactccgatcatctgtaagcagttggtaactatcccaaggctaccaggatgtagggaggggagagagctcggagctggggagcctcggtgatgctctgaggtgactcccacccaacagagtcctttgcctgtttcccaaagtgcagttaacgagagggcagcaaggaaagcaagtcagagtccacgttggtctgaatatcgctgatgcaggtagagacaaaccccagggaaaaaagacttaaaagtgaaaaatggagctggacaccgtggctcctacccgcagtctcagcactttgggaggctgaggtgggaggatcgtttgagcccaggagtttgagaccagcgtgagcaacatagtgagaattcatctctactaaaaaacaaaacaaaacagccagacatgggggtgtctgcttgtagtcccagctacttgggagacggaagtggcaggatggcttgatcctgggaggttgagtctacagtgagatgagattggtccattgcactccagcctgggtgacagcaagaccctgtctggaaaaaaaaaaaagtgaaaaaaaagtcccagaccctttaaaagcttgaaggatccttctgtgtgtgggactaactgagatgcaataagagaaatggaaaaccacccgagtcactgtcgcaagataattttgtattgaagtaagacacctgaccacagactgacttcacttatatctgcacaactgaaccgagcaaaaggaagttctcaaatcaccattcagtgctcaactcagcctgggaagccaacagcaagctttcaaggcgggcccttgctttctcgtttgtgtgtgtgtgtgtatgtgtgtgtgtgtatgtgtgtgtatgtgtgtgtgtgtatgtgtgtgtatgtgtgtctatgtgtgtgtatgtgtgtgtctacgtgtgtgtgtatgtgtatgtgtgtctgtgtgtgtgtgtgtgtgtgtgtgtgtgtgtgtgaatcttttctaacagtgacggctgtgagagcgggctctccaactcctgccggtgaccttggacgtgaccttcaccacacggggctcaggctcctcaaccaccaaatgaggaaggagaactaagctgtcccaaaaccattcttttttccatttctaaatcctttgggtgttctaaatagacactaggatctctcaagtgattctgtaacacaggaaacattacctcagcaggcctggtttaaaacccaaccctcccctctctctcattcaccagctgtgaaagtgtaagtaatgcattattcttctttgtcctcggcctccccttctgtaaaatgggtataaaagaacccggctgggcgcggtgactcacacctgtaatcccaacactttgagaggctgaggcaggtggatcacctgaggtcaggagttcgagaccagtctggccaacatggtgaaaccctgtctctactaaaaatacaaaaattagccaggcatgttggtgggcacctgtaatcccagctacttaggaggctgaggcaggagaatcgcttaaacctaggaggcagaggctgcagcgagccgagatcatgccattgcaaaatgccaggctgatgatttccatgtacctttgatagtccagaaaccaggaattttgtgatgttctgtgttcaattggagagtttcagcataaaatctgtaacagtgtcgagacttctcactgtggcctaagaataaaagtaactttcattctctcccagtgtttgggggctggggctgagctacacattgaattttactacaagtttactggaagccaacacaaacagaaacgcagaagggtggtactggctctctgaaaaaaggaaagtgtgtctgttctgcaagaaggaaaaaatagcatctttccttggtactaaatttaaaacaaaatgtattatatgagagatgttaataatattattacaatcttaggaataatatctatagtctgaggaatgttgaattattattcattatcccttatattatttaattttgataatcatcatattatattattaaataacaacagattttaaagtggttggagtccaaagagtatgggttctcctttaatcagcaacacagaatgctgacatacctgaattttgccaaaaattagaatatcaagttgcctaattttcaacttccctcaaaagtttaggctgggcgcagtggctcacatctgtaatcccaacactttgggaggccaaggtgagagaatcattgagtccaggaatttaagaccagcctgggcaacacagatctcatctctacaaaaagtaaaccaaaaaaaattagcttggcatggtggcatgcgcctgtggtcccagctatctgggaggctgagacaggaggatcacctgagccagggaggtcgaggctgcagtgagccgtgatcataccactgcactccagcctgggcaacagagcaagaccctgtttcaaaaaaaaaagagagagagagaaaagcttagataagaaaggtcatacaggccaggcatggtggctcatggctataatcccagcaatttggaaggctaaggtgggccaatcacctgaggtcagaagttcaaagccagcctggccaacatggtgaaaccaggtctctactaaaaatataaaaattagctgggcgtggtggtgttcacctgtagtcccagctactcaggaggctgaggcaggagaatcactgaactcaggaggtggaggttgcagtgagccgagatcacaccactgcactccagcctaggcgacaaagtgagactccgtctcaaaaaaaaaaaaaaaagaaaggtcatacaatcttgacatccatttctccagatgtgccaagctccctctggtcaaccagccagaggatgatcctggacccctcctgcctctgactgccaatggctggagtctcttggggccgcccgggtctggcctgaggcctaaagcctggacctttgcactcagctctgctccagcagtgactcacctgcagagaagcctatggaattctgggaacgatgcgggtggttgtttcaggatggcccacctgagccacaaagtcacctcccaacacacacacacacatacacacacacacgcacacacatcctgtgttaccttgatcatcaggaacaaggccaaccaatctggctgggacatttggtccttgaggaactgccaccactgcctgaacacgatgtcatctgtggtcagtggacgattcttccagggacaaggaaagacgaggaaaatcagaactcaccgcttgggtccctctgcctcaactgcagccttgtttgaaactgggctcttctgcaaacatgctatgcttgcctgagcgtaatgcccaccggagtggcgggatcaggtatgttcatctcccgggcaggctgcgggggtcattccgctcagagcaagtgcccggtctccatcagaacccttggagagcctctgcagccatgaacaaaaaggtaccgagacctgccgtgaccatcctatgatgatagactatgaattcttataaaccgaagaattaccagtgctggagagcccgcgagcagcccggcattgcgtaaagggtctgcaatggctcttcctagcccccactttacacttggcagggtggggcttgtgagagtcacagaggagaggggctgagcgggactggctctcagagccacctccactaatggggcttttccagttcacctctggagcccagtggaccctcactgctcccactgaggcctcctctccagccagccacacaagctcagattcaccaaagataaaactcagggaaactcagctgtccccctggctgagacagcgggtcccccagtaaccattgtcctccttcccaaatgctagcagggcacacactgcctgacttgtccccactcccttgcagcgaggtgtggctgccacgagactgtgtcctggccagtgcaccagtgcaggtgagcacagggggtgtgaatgaagtgtcttttgggaggaggcacatgcttctccaacctattccctttctttgggatgcagatgtgatggttagagccagagcagttaaagatggtggagccaggccaggcacggtggctcacacctgtaatctcagcactttaagaggctgaagcagggggatcacttgaggccaggagttcaagaccagccggggcgacatagtgagactccatctcttctaaaatcatatatatgttatatattatatgtaatatgtgttatatgtatgttatatatgcaatatatgttgtatattgtatgtgatatgcattatatattatatgtaatatatgtaatatatgtgtgatatgttatatattatgtgtaatatatgctatgttatatgtaatatgtgcattatgtataatatatgtaatatatgtatgttttatatataatatatatgtaatatgttatatacgtaatatattacatataatatataacatatatatgattttagaagagatggagtcttgctatgttgcccaggctggtcttgaatatgttatatattatatatgatatatatgttacatattatatatgatatatatgttatatattatatatattatgtgatatgtgttatatatgtgatatgtgttacatatgttatatacgtgatatatatgttatatattatatatgatatatatgttatatatatccagacatggtggctggcacatgtctgtggtcccggctacttgggaggctgaaacaggaggatcgctttagccaagaggttgaggctgcaggagccgtgatcatgcaccactacacttcagcctgggtgacagagaaagaccctgtctcaaaaaagaaaaaagaaaaacctaaaagcaacaaagtaaaaataaaacaaaaacgaaaaaaaactttacaaaatacagaagtgattttttttttttccgaggctgctggaggacaaaggacaaggtcaaggagcagaagaagattcctgtcacacacagaccagcgagaggcacccagcccctagctccccgcagcacgcccgagggcgcctgcggggctcgatcccgtctttccttcctccctcttccgcaagcttttctgtcccggcttcttgccagtctgctggggtctcaccctcacctttcctttctcccatctttagctctcatttcctttccttttccttctgccctcatttcccttgccctgtccaccatttttccttcatttctctccatccatctctgtgagagtcaaggatccagacattcagactgggtatcctggcgagtttaacaaaggggtggtttatagcagtgaggccagggtcgaaagagaccatggaggtcggtcatggtggctcacgcttgtaatcccagcactttgggaggctgaggcgggaggatcacttgagcccaggagtttgacaccagcctgggcaacatagcaaaaacccatctctgttttttttttttaattaaaaaaaaaaaaacaaacaggccgggtgtggtggctcatgcctgtaatcccagcactttgggaggctgaggcgggtggatcacttgaagtcaggagttcgagaccagcctggccaacatggtgaaaccctgtctctactaaaaatacaaaaattagctgggcatggtggagtgcacctgtggtcccaactagtcgggaggctgaggcaggagaatcgcctaaaccaggaggcggaggttgcagtaagccaagatcatcccactgcactccagcctgggtgatagagcaagactgtgtctcaaaagaaaaaaaaaaaaaagaaagagaccacagagggagagtgcaggacagggccagaagagcaggaaaccactagcacggctgggcctgcagggcaagggagggagcatctaccaggaccaagctgtgtggagagtgctgcatggagcccaggcctctggtcaggggtgcaggagaccacctcgagccaacagggaggggctgaggaataagtagccagcccctctctcctcctttccttccccatctccggctgggagaccccatgagacacgcacagagcaggggagaagctagagagaggagctagccgcagggcagatgggggatatgtggggctgtcccccgcgtgtgttttcccgctgtgccttaccttgtaaaccctatttcttctcctgccgcgtgcatgaaactgttttgtgacagctgctcctaacttctaaataagggcaacttggctttcttcttttccaaaacatcaaaattgggtcgttgctttttaaagtgcggtgccttgggttgttctactgggattagcaggcctctttttatgggatgagacaccatcacccgtcttctccccaagccgcagatggaacgtcaggagtgcagactagtgaaggggaagaaaggatgccagccatctatgagtctgcctgtgtcttattctctaatatcagaccatagctatttatggatccaccaggagccattaacttctgcgtctacctagcggttggaaagtggccagcgtagctgaacagtaaatgaagctgacgggtcagcaggtgttacagatcaggagactcgacgccgtgcccaagcccttccccgctgcatccttcactcatgattctaggaaggccaagtccaggggaggccctgagatgagcctgtgggaaagcacacacttccttactaaaagggacagatgcagatggcacggtctccatcacatcccttctcctgccctgaatgcagacccactcctgggccgcccaggtcatcgcaccgccatggtgggccttcaggaggatgacagcctctgtggcaacggtaggggcagctgaaacacgtgcctctttgtcatagagaaaaacacatctctatctgcccaaaccaccactggtggccattcagttatgggcagccctacgcgttcccgagtgaatcatcatggtgggtaatactcgtatctctgatgcatttagtgaaaacaccattaacaagccattcaacgacgttatcgttgcctcgccacagaagaggcaaggcaggggatatgaaagtgtgcagcttgcggagaaggtgagtggctggtagggaatgctctttaataggcagcgcccctgcagggaggggactcagagtaacgattccatccgcacctgcagaactgagagcaccagaaactcctcacctgcgcgcatcatccaggcaggttaacagcggggaccaaggaccagctttaagggagtgatatcactgagcttgtccccaaagtttagtaaatacacaatgcatgcaaagtctgaaaaactgccgatagcgtttaacgaatgcacagagccccactccgtgaaccactgtcatattttagacaatccaggcgagtcagccctggccagccctgctcttctctgcagtgtttatcagggagtgtatcaatgtcgggaaaacttcctaaggaagttcacccccagaagaacagcttaggtcatgattatcctgctgaggtcagcagcacatggttgtccgactcctgggagaaaagaggatgtgaaaccctcggaagggtgaagggtgcggcaggcgggactcatccggggaggtgtggccaggaggatgttctgacgggaaacggcgtcatcggaaagcccctccccagctgctcctcagttgcagggaggaaaaagaaacagcgattctgcagtggagaagttgggcacaccttcatcggtggtggacagtgatgtccctagcgaagggtggtgggacctggagggccctagaggggacgctcagagttgggccagcacccccagcatggggtcccggccaaagagtcaaaacctctgtctactcgtggggaaacacaggacaaaccccaaatgaagggccatccattatcaaaggaggggagtattctttaaaaagaaaggctgtcggggccgggcacggtggctcacgcctgtaatcccagcactttgggaggctgaggtgggcggatcacctgatgtcaggagttcgagaccaacctgaccaacatggtgaaaccctgtctctactaaaaatacaaaaattagctgggcatggtggcacacgactgaatcccagctacttgggaggctgagacaggagaatcgcttgaaccctggaggtggaggttgcagtgagccaagatcacaccactacactccagcctgggcaacagagtgagactctgtctccaaaaaaaaaaaaagaaaagaaaagaaaagaaaggctgtgggatgttgggatgttcccgactgaagaaggctaaagagagagaacagggtcctgcccaaccctgggctggaccccaggctcggaggaaggctatgaatgacttcattgtgtcaacccacaagatttgaattcaaacagcagatctggccaggcacggtggctcaagcctataattccagcactttgggaggccaaggtaggtggatcgacctgaggtcaggagttagagaccagcctggccgacatgacgaaaccccatctctactaaaaatacaaaaaaaattagccaggcctggtggctggtgcccataatcccagacactcaggaggctgaggcaggagaactgctggaacccaggaggcggaggttgcagtgagctgaaactgtaccacttcactccagcctaggcgacagagtgggactctgtctaaaaaaaaaacaaaaaccgatcagacggaagtattgtgtccatgttcaatctgctgacattgatgactgtacagtggttacataagggaatatcccttttcttaggaaatatgcccaaaactgttagggccaaaggtctgaggtacgtaagcaacttttcaaatgcttcagagcaagagaggacgcacacacaaacgataaagcgaatggggcaaaatgttaacaagcaaatccagacatagaagtgttctttacactatacatatatttcttccaactttattttaaatgccttgaaaggcaagacctttatctatgtgtgtgaacatgcatggatgtgtgttggggaaggggagggaggaaaacaaagaccatagagaggagagagaggcagggtgggtgcagaggtgggaggaggagagggctgagaagcagtgatcaaacgggaagaacaaggccccgagagctgactttgccagcacctgctgggggcagtttcatccttattaccgcagtgctttcccccttctgccttaaagcttttacgtctgggttttccaagccacctcgatggtgaaggaggctccggagggcagggagggggtcattgcagtttctctttctgatgtagaacaagccgtgggcagagagcctgggagctacatggtgggcacacagataatcaggtaatgccaccaaatgggagagtccaccagggattctgaaaagtacaaagaaagggtaaattgctgctttttcagaaatacgccctacccgctcactctgcccagggaaatgtaacatcaagatgcagagggatgggccagaggagggacaattccagggagagcccctgtccctattcccagtgcctgtcaactgcccacactttgttcccaactggcccttgctgctgtcaccgtggagctgtggagtcggaaggaagccgggcaaggatgcagactgacattaagttttttgtgactgagctctgaagagcatcttagcatctgaccattccagtgtggagcagggttgacatgataaggagtaagagaaagatggcccggactgcagcaaggccgaggctgaacacagaatcacagaggctccaaggctgaggtcagttcagttggaaggcagatgcccaggggcagccccagaagatgcaagaacacaggcctgccagggccactgagagaaaggtttctggcccaaagacctgcttcctgcccacaccagctgtggcagctgctcttccaagcgctctttctgcacaagcccctcgaacagcaaacagcatcactcggaaccctgtccaagaaatgcggattcatcataattggtcaaccacagccacactctggcaaggggctccaaccgattttcaaagtgtttttccctaaatggttacttggatcagataacagctagctgggaagaaaacccccagtccccatatatgctcccagacatagcttagaaatgtgacctccatctcttatttttattttcttatttgtgtattcgtctgttctcacactgcatgaagaaatatccaagactggacaatttataaataaaagaggtttaattgactcacagttccgcagggctgtggaggcctcaggaagcttgcaatcctggctgaagggaagcaaacatgtccttcttcacatggtggcaggaaggagaagtgctgagcaaaaggggaaaaacaccttataaaaccatcagatcggcagggtgcagtggcttacacccgtaatcccagaactttaggaggccgaggcaggcggatcacgaggtcaggaggtcgagaccatcctggctaacatggtgaaatcccatctctactaaaaatacaaaaaaattagccgggcatggtggcacgtgcctgtaatcccagctactcgggaggctggggcaggagaatcgcttgaacccgggaggtggaggttgcagtgagctgagattgcaccattgcactccagcctgggtaacagaacgagactctgtctcaaaaaaaaagaacaaaaacaaacaaacaaaaaacccatcagatctcatgaaaactcactatcacgagaacagcatgggtgtaacggcccccatggttcaattacctcccactgggtccctcccaggacacgtggggattatgggaactgtaatacaagatgagatttgggtggggacacagccaaaccatatcaatttgtacattgtccttctctcccgttctagtctatacgctccacgaggggagggattttattttattcacggctttgctgccattcttagaacaatgcctgatacctagaaggcacttaataaatatttgtggaagaaaggaagaaatgacttaacttgggaaattaggttaatcatgatgtcattgacagacgaggagaaattattttcagggagatagtggaattccttctggtcgtcaagtcttaaatgacagaagaatttcttaaattctctttacacacagtgtgaaaaaacaactattggttgacggagaagaaagagagctctgggagggacccaacatcagcaggactcttttttttttttttccttctcagatctggctttgcaaaaagtcaccaaagttaaaatgcactagttcttcaatcaagtttccctatattttactacatgtttatcttcttttcttgttccagacaggcaagaacaccttcacagactgcaaagacataagatttctttcaagagacatttatgcaggtgataaacataattaagctggtcatatatttagtttgagattttacttctcagtttgaggtagcaaggggcccccctggactcacacgccttagaccccgtcttcattctcaaggtttctcctggaggaaatgggttccaggaggggagctccagtgagggcgccccagagtccaaggcagttcagatgcgcaggccccgccttggggtcctcctcaatgcattgcagccaatgacgggaaaaaggactctgccctgagcccttctgtgcagggaggaggctctctgggctgctggtcagctggaaacgggaggtcttgcagtagagttttccccctgagcatggggaggagtcctggtatttggggggaaaacaggacttccaaattagagctccctaaatatttccccacaaatgatcctttgggaaatcacctgacacttcagaggagcttgtccctctgatgccacttctctatttaccagagacaaacattcctgctttcaaggctattgacagtggccacgtcggatctgtcccggagttctgcttccaaggctgatggtgtgtgttaaggtcgtggggtggatgcagcagtcaactgtgcattcattcaacaaacacccagcctgatgcgtgccaggcactgggagtgccctggaggtaagaagcacctctcattaatttattcttgttcttccaaggaagcactggaagcacagggggctcgagcccatgctccctgactatgctttttaaacaggacaaaatatgtttaatgcttatcagaaagaataaatgtcttagaatagctaagaacatttagaaattgaggaatagcaagggaggtttcattcaccagctattaatagctcctttagaagctactgaaatgaaaagagtattcttggcacaagaaaagaagtaatttcaaaaatgtatgggaatttaatacatgataaaagtggtatctcaactgaatgaaaaaaggaagatttagttaatgaattgtgttggcattatcaattaccttcctggagcaaaataaacttaaatcccttccatctaaaaataaactttagataaattagaaatctaaaggttaaaaaaattaaaaattagaggaaaattcagggaattattaatattggaataaagacaatctccttaaataagacacaaaactaggccaggcatggtggctcatgtctgtaatccaagcactttgggaggctgaggcagacagatcacctgaggtcaggagttcaacaccagcctggccaacatggcaaaactccatctctactaaaaatacaaaaattaactggacttggtggcaggcgcctgtaatcccagctacttgggaggctgaggcaggagaatctcttaaactcgggaggtggaggttgcagggggccgagatcacaccattgtactccagcctgggtgacagagggagacttcatctcaaaatcaaacaacaaagaacacacaaaaactacacaggaaaaatgaacatatttgatcctatgaaattaaaactttggaagacataacaaatgtaatcaaaagacaaatattatacttagaaaaatatctgtagtacacatgtaagcataggtttcatattacttaacataagtacctaaacatcgatttttaaaaaaggacaaaccaatagaaaaatagtcaaagggcatgaattggcaattcacagaaaaaaaaatttaagtcaacataaaagaatatgcaccatctccaggagtcagggagatacacatccaaactgcatgagatatcattttcactttgtggacagaaaatattttacaaatattttcccccacactgtggtttatgtctgagtcattaatttttttcttttatgaaatttttgtctgttctctaagaaatatttgcttactccaaaggttataaagatattcttctatgttttctcttagaagtttcatagtttaaggtttggagctaggtctataatccatctcaaaataatttttctgcacataatgtagtagtagttgaggttcaattattttcatttgttggccgggtgcggtggctcacacctggaatcctaacactgtaggaggctgaggcaggcagatgacttgagcccaggagttcaagaccatcctgggcaacatggtgaaactctgtttctacaaaacataagaaaattagctgggtgtgatgatgtgtgcctgtggtcccagctactcaggaagctgaggtgggaagattgatcacctgaactcatggaggtcaaggctgcagtgagccatgattgcgccactatactccagcctgggtgacagagtgagaccctgtctcaaaataaataaataaacaaacaaattaaatattcccatgtgtttattccatttttccagtactagttgttgaaaagtctttcctttccccattgtattgccttggtgactttgttaaacaactggtcatatattcatataatctgcatgaaagttcttgtctgccagtctttacattgggtcatcttgggctctgtttttacttgctattttttcttgattatgagttgcatttttgtgtttctgcacatctagttattttgtattatatattggaaagtatggataatatagtgtagccaatctgaattagattgtcctcctttacagagttgtgagatttgtctggcaggtagtttgatgactggaaggctctttggtcccatctggtttgctttattcttggctagggcagggctattttggtcttgaacatagtcctaggaaatagttcctctaagactggacctttctggggtcacacctgaatgcgaggtctcttcatcctggctgggctgaagcacctcttcttccccagtacatcaagacctccagtatcacgtttggccctcagccctggaacaggcaatctctgctgggcctcatggagttttgccctaccccatacagctcagctcttgaacaaagacctgtgatgagtgttgctgtggacttctagagctacccgtttttctctgggattctcatttgtaaacttcagccactttgacagcccagcactctggcctcttccatcttagctcagcgatcgcaccactctgctcggtctcttcctcctcaactgtgacacaaaagtggctgcaagtcagaggcagtcacgggagcttcagctcatgtgattctctgctctcaaaaatcacagtcccgtgctgtctgttgtccaatacctgaaaacatttacctcttatatttgtccagtttatttgtctgtttgagacagtctcgctctgtcacccaggctggagtacagtggcgcgatctcaatcactgcaacctccgcctcccagattcaagcgattctcatgcctcagcctcccgagtagctgggattacaggcatgcaccaccatgtccagctaatttttgtattttttagtagagacagggtttcaccatggtgaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttgcaggtgaattagactgttgtattcatacagatttcaggataattaaccttaaggataattttatttgtgcagtgaatgatcatgtgaaggggaccataaacacttgatttaaaaaacacacatataccggcaaccgaaatagactaaaacatctaggctgatttgaaattggccctgaagacactgcttttataagtcttgtttcctctagctccacgtgtgtgccctgaggctgggggcacatgccgtccctccctgtatacccagcatcccgcacactaccctgaaacctcatgggtgcatgagtatttgttgaattggaccaaatggattcacttgtctcttctgttatatttgagtcctcttcaaggctagctataaatttacgtgaactttactgcgtttcattctctagtaaaggcacaagtcttgggaagacacacacacatacacacacacatactacacacacaaacccacatacatacacatacacacacagatacacacctacacacgtacacacagatacacatacacacacatacacacacacggttgttcttcaccccattctgagagcacttcctcactcaatcttggagtcatgtgttcattggcaaagttgacagagataacttcttagacatttgcaatattttgacaggacaattatgcaatgtcctcatcttcatgaacctgaaccaactttcaagcatccaagacttacttagtcagcattcccaccaaagtagccaatagcaggagcctaaaacaatgaactctttatgaccaaaatgctgtgtcagatgcaacttcagtaactaaattaactaatgagggtctcctggggggaaatgggataaccctgcattcttgttttacccctccctgtctttcaacagctctttagaggtttatctgtgtttaagactctttatcagattgtcatttgaaccgcagggaaagtgacttctttctgcatttccacaatcaatccatttattcagagaaagttcttcaccagcagatatgattgtatcaatggggtttcccctaaactcccacttaaattagattttttttttttttaagatggagtctcactctgtcacccaggctggagtgcagtggcccgatctcagctcactccaacctccgcctcccaggttcaagcaattctcctgcctcagcctcccaagtagctgggattacaggcgcatgccagcacacccagctaatttttgtatttttagtagagacagggtttcaccatgttggccaggctcgtctcaaactcctgacctcaggtgatccacctgcctcagcctcccaaagtgctgggattacaggcgtgagccaccacgcccaggaaatccgtgtaggaagagataagatcaatttcatattgccatgttggatgctgttccaaaacccccccctttccaaatacatgtgaagagtgtgactttgtcacacaacctgcagtccgtagactggcgtgaggggcctgttgatcactaaccttgtgggcaaaatgttgtgtgcacgtgcatccgcgtgatctgatgaaatccacacagcatgggatgctccagccacaccagcctctgccaggtgaatgttcctgtaaatttacatcaggggcctgatgtgtcaatatcaaccccatggaagtctctgtgttgtgaaccgttcaagggtctcagaaggtagtgtcgcctctaagctgcatcctctgggcaggcttgaccttggcagaaatctcaaccacctcagaaaagcctgccttctccttggctaagtaccttccatgcaggagaggcaaatggtgggcggggttgaggggtggtcagcaacagcccttgaacactcatgtcatcggtgctggagctcccccatcatgagccacctctaagggtcatgtgctgtatttccctggaagtttccaacccagcccttcccggcccttccctaccactccccactctgccatccactcatggccccatgttattcccccactccccatgcatcccttttaggtgcacctgctctccttaaacacctaacaccaggagggctctaaaagcaggcaggctggctgggtgcagtggctcacacctgtaatcgtagcactttgggagggtgaggtgggaggatcacttgaggccaggagttcgagaccagcctggccaacaataagtgaaatgccgtctttattaaaaatacaaaaacattagccaggcgtggtggcagacacctgtagacccagctactcaggaggttgaggcatgagaatcgcttgagcctggaaggcagaggttacagtgagccaagatcatgccaattgactccagcctgggcagcagagtgagattctgtctcagaaaaaaataaaataataaaattaaaaaataggctgggcgcagtggctcatgcctgtaatctcagcactttgggaggctgagacgggcggatcacgaggtcaggagatcgagaccatcctggctaacacagtgaaaccccgtctctactaaaaatacaaatacaaatacgaattacaaaaaaattagccgggcgtggtggcaggcacctgttgtcccagctacttgggaggctgaggcaggagaatggcgtgaacccaggaggtggagcttgcagtgagccgagattgcgccactgcactccagcctgggtgacagagtgagactccatctcaaaaaaaaaaaaaaaaaaaaatagaagcaggagggctgactgcgcagcctgacctggtttcggcctgaccctcgtgtccccctgtccccatcatctgtcccgtgttccattctcccaaatgtgaaaaactgcagccaccaagtccctatgtcctccaagtgtgacgtcttgtggactgagacgttgcccccagactcctagcccagcataccctgttccagcgagtgccacgcacaggccattccccagcacctggtgctattgccacttcctgtcaccactaaccagacagattttacacacatatttgagcctcttgcattctggtgcagattttccttctgactggcatttgccaataggatgattattttaatattttaaaattagagatggcggggggggggtctcactatgttgcccaggctggtcttgaattcctggcctgaagcaatcctcctgcctctgcctcctaaagtgctgggaataacaggcattagccaccgtgcctggccaagatgattttatagtccgtaattcagaaaagactattctgtcctagattattattattttttgagacggagtttcactcttgttgcccaggatggagtgcaatggtgtgatctcggctcactgcaacctctgcctccggggttcaagcgattctccttgcctcggcctcccgagtagctgggattacaggtgcctgccaccatgcccagctaattttttgtatttttagtagagaaggggtttcaccatgttggccaggctggtctcgaactcctaatttcaggtgatccacccccctcggcctcccaaagtgctgggattacaagcgtgagtcaccatgctcagccgattcttaaatttagattattagttagaaaaaagtgcgctgaaaacaggagtcaagtcttggggggatgggggagtttgtgagtgggtgtgtgtgcatgtaccggggcagaggggagcttgtagaagaagaaggagagagaccacgttctccataatgggcctgactctgacgcatgttagctggagtccttgctttctaaatgtatctggatctcccccttcctggtccgaatgttttctgtgttgcattttttgagccctcactgtgataacacgaatgctgtgatctgatctcaagtggagaaaaggggtcctcctttccatcaccaacgtgtgagctcaggtaggggaagccaaagctctgccccaggcaccctgagaatcaggaaggcaccaggtggatgtgtgcaggagggactcggaaggccacaaggggagacagacttgaagtttcctaacttgagggccaacactcaccagttccttcaccaaggacgtctccaaccagaaggaccaaaaccatggaggtgacagacaggtgaatatcaaaatttaaaattgagcccagggtcagtcctggccctggcatccggtatcttcccacattggccacttttctccagctcccagggggctgctttcacaggaagcagagttccagtgaggacacctttgcacaggtctgaccctgagagcctcttactgtccagccacttgagtgaggccttattcaaacggtaaagggtgaagctgctgccctccagggtgtgatgggcaaggtctgtgtagagatagtgagggccaaagccggcaacatagtcacccaggggtgagggccgaggctagccctgcccaaaggctggagcccaggagaccagccagggagagaacatggtcctgcaggagggtgggaggtcaccccacttgttcagcacagctcatggagggcaggcgaggaggctcggcccccgccacactgcccctccggagcactttacttctccgtattcaagactctgcgtcatgccattggaataacacaaaaaacatgcttttgtatttgctcaccaacagtagtctgttcattcgagtaacgtccttctggcaggcacctgttgttgattttggaaagtttaggaaaacatgagattcaggagcctcatatgcagtcaccggatccgggtgccctggaatggccccagcccccaagtgcagctgctcacgggccacaggctgccacgttcctcctgacggggatcgtggagatggcgcagcaggagaggaagactaacaggctgccacgttcctcctgacggggatcatggagacggcgcagcaggagaggaagactcaagaggattcaagcctgacagtgcttttggcttctgggtctaggagactcaacattcttcccagtcaacattagatgaatgaatgagtgatgaagggggtggccaggagtggtcaggagcaactctacacaaaatagaaggccaggcgcagtggctcacgcctctaatcctagcactttgggaagctgaggcgggtggatcacctgaggtcgggagttcaagaccagcctggccaacatggagaaaccccgtctctactaaaaatacaaaattagccaggcatggtggcgcatgcctgtaatcccagctactcgggaggctgaggcaggagaatcgcttgaacctgagaggcggaggttgcagtgagccaagttcacaccactgcactccagcctgggcaacaaaagtgaaactctgtctgggaaaaaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgatttcttatatgaaataccagagaaatgaggggtgccaagcacagagtggtggccacatggccattcgcccgatggatacttaaggatcacagtggtgatgaaaatgagagcgtgaagggtgagttcaggatctgtgtgtaacagaagaaacaccacactgccttcagtgtggtgagattgtgaacaaaggtggtgcagggatgccaggacccgccagccgtgtaaggagaggtgctgcagctgcctaaaccccagtcgggaggggagtttagtgagccgtctggtggagagaagtgggtccagagttagaagacagcagtgacgctgcccaaagcaggctccttctttctctctttcctcttccagcttcagatcacctccaccctttaagagttagaaccgctttaagagttagaacaaccatcctgacagcctgtgaacacacctgaaccacattctcttcggtgcaggaaacaggttctgataaatgattcacatgattctgcctggcatgaagcagcctgtggtttattcccatgcatcgtttattcagcagacacaccccgagggcccacaacatgccgagcattgtttaggagctgggaacacagagacgaactgaagagacaaaatcccgtttcccacagagctgaccatctagttagtgtcacggttgaagggaccatatcaccctgtccttcatgaatgcagatgcaaaatatccttaacaaaatattaacaaatcgaatccaaaaatacacttaaaaaatcatgaccaagtggactctatctcaggaatgcaaagttgatttaccacgaaaaaaaaaagccacttgattcgccatgctaacgcactaaacagaaaaatcatgaatatttgcatctgtgcagaaaagccatgtgacaacactcagtcctgattaaaactctcagaaaactaggacaatagcaggtggagcatctccaacctgataaagtacatccctgaaaaacctacagctggggccgggcgcggtggctcacgcctgtaatcccagcactttgggaggccaaggtgggcagatcacgaggtcaggagattgagaccatcccgactaacatggtgaaaccctgtctgtactaaaaatacaaaaattagcctggcgtggtggctggcacctgtagtaccagctacgcgggaggctgaggcaggggaatggcatgaaccctggaggcggagtttgcagtgacccgagatcacgccactgcactccagcctgggcgacagagcgagactctgtctctaaaaaaacaaaaaaacctacaggtggcatcaaacttaaagatgaagaactgaatgctttcccctaagatcaagagcaagacaaagaactcatcctcaccatctctattcagtattgcactagaagtcctagtcagtagaataaggaaagaaaaataaataaaggcatacataagaaagtaaaaggaaaggaagaaataaaactggctttacttgcagacaatatgatcgtctatgtagaaaatcgcaagaaatatgcaaaaaagcgattagaactaataaatgaatttaacaaggttgcaagatataaaatcaattaaaaatcaatcaaaaaatcaatcatatatgtatatactagtaacaaacaaatagctattaaacttttaaagtaatggtatttataggctgggcgcagtggcttatgcctgtaatcccagcactttgggaggccgaggcaggcggatcacttgaggtcaggagtttgagacaagcctggccaacatggtgaaaccccgtctctactaaaaatacaaaaattagccaggcatggtggcaggtatctgtaatcccatctgaggcaggagaatcgcttgaacccgggaggtggaggttgcaatgagccgagattgcaccactgcactctagcctgggtggcagagcaagattctgtctcgaaaaaaaaaaaaaaaaaaaaaaaagtaaaagtatttataatttataatagcatcgaaatggatgagaaacttagggacaaatttaacaaaatatgtgcaagacctataaggtaaaaactgtaaaacattactgagggaaattaaagaagacctaaataaacgaagaaataagccctgtttatgtatgcatcagaagctgcaatattgttagatgtcagttctcccatgattgatctagagatttaatgtattcccaatcaaaattccatcaagcattttatggaaattgataagttgactttaaatttatatgaaaatgaaaaagacttaaaatgggcaaaatgattttgaaaaattggaggactttttactatctctgactgccaaacttgctataaagctacaacaatcaaggcaatatggtattggcataagtatagacagagatggatgaaacagagcagagggtccatacagccagtatggagaaaggcatggaggttcctcaaaaaactaaaaatacagctaccatatgatccagcaatcccactgctgagtctgtaccccaaagaaaggaaatcagtagatcaaagagatacctgcccttacatgttggttgcagctctgtccacaatagccaaaatttggaagcaatctaagtgtccatcaacagatgaatggataaagaaaatttgcagattttctgggtctttcttctagatatggtgagaactttgctccttctagctttctgtatcctaagtggaagccagaacacatattctatttattttttaaaattagaaggaggctgggtgcggtggcccacgcctgtaatcccagcactttgggaggccaaggcaggcggatcacctgaagtcaggagttcgagaccagcctggtcaacatggcgaaaccccgtctctactaaaaatacaaaaattagccaggcgtggtggcagatgcctgtaatcccagctactcgggaggctgaggcaggagaatcgcttgaacccgggaggcagaggttgcagtgcactggtatttcaggaaggtgccccctcaagtctccatggtatcccttgggccctgaacagggggctaatttgtctgcaccttgagtgaggccaatgggctcgggctgtgatgtgtgatgtctgctgtcaccgacggtgcccagcacaatgtgagaacttagtggtctccaccccttttcctgtgaccgaaagggtgcaccagatgctatggagcagacacacacaagttacccttgaacaaggcagcgtgcagagttcagaaaccagtagcacaagcatggggcgggggcgctgctctaagacatcatcagcatgaatgggcgaatacctgacaggtgtgagtggattcggttcggtgtgagttaatagcattgcgtcacacaagcacctgaacaaagctgatgacatcggggggctctcgggtgaaggaagctggggtcccggttttaggggaattcctcctccaggagccctcctggcatctctctttgccacccagccccagcttaggatggagggccctaggctgggttcctaaggccccgggtgattccctgaggcggccatcatccacatacatgcacgcttgtctgcctgtggacggtgtaaagcccctcgaaccctcccacgggccgtccttatctctgtacccacggggctggtgtgcactagagcagtgttccaccaataaatgagaaggcgctttgaagaatgagcaggcgctcacctggctgggagaggggtgggcgagacccatggctgggaatgagcagggctaaggcagcagcattccaggtcccctcagtcccatggctggagcagggctgtcgggggaggctgcaggagatggaatggggaggccaaaagggactccagcctgggaggtgcagtctccccctctaaggagtttggggctaccccattgtcaggaaggtgttttgaggggtttccaggaggtggctggtgggacacaatcacattatctgagccctgaaaagaccaggcaacaccatgggaaactggctggagggaaaccagtgtggagcctactgtggtcccggggcgggagaccagatcctctctgggtgttcgtggctgtccgtggtgtccaaggcaccagggacaaggctacgcaaggggcacctctagctcatggcggctagttccgacgctgcagccgtcagacgtgttaaatcacacagggcatgaaccgggaaacatgaaatccaccctcagcttcaattgctccaataattatttgttagctcagaagttcaagacatttggaacaggtccaacaatgatgtcaacttagttcccatctctgaatctgtggtggagaaacctggacactggaaacagggtgggtttggggatccggctgacctggggcccaattctgacttccctgtttctgcgagcccctggatacgtacgtttctaaatgtctctgaacctcggttttcctgtctttatcattcgtgcattcattcatgacattgtcatttattcaacaaatacgtactgagcacctactatctatcaggcaccgttccaagtacagggaatataggtgtgaaaaaaagctcctgccctcactgattttacatcctgggacagggagacagaggaataagtcatgaggtgccactgggcagggaaggggctggggagagctgcgggcggctgtgatcgtggtagcaatgagccctagcagcactgctttcatctcggggctgctatgaggactgagttagagaatgggtgttagaagagggctggcacctgccggggcccagcatctcatcctgcaccagcctggtgggaaggcttgattcccttcaagtatcaacagccatggaagctaaatctcgaccagacctcgcaaggagatttaaaaggagaaaagaaaaaaggcatcattctgaataattattcctcaaagccgtccctgtggcgtgctgataacctatcgggtcacatgtggcagtttactttaaaggcaaaggggtttccaaatgaacctgcccgggcggggaagctcttgtggttcctggcggcatcctgtccctcagtagagaatcttatcacgacttcctcaggctgttgacattctgattagtgtgcagtccacagacatcaaaaaggacaaggatggattctgaaaccaggaagttttactgactgtcttgctcacagacattttagcctgtatgttgtcatctgcagtcagtgactgtaacctctgtattgtaccgtccagtgaaaaggacagctccaatgtgaggagtccccctctacactctcctctaaaaggcttccagcttggagcaggccccaggacacgcccacctttgttggcatgtctgccggggttcatcctcacttccggtttccagtaaaccagatcacagtatttctgcctcagctactctctgcctatggggtaaccctgctctgccagagcagtcaaaaaagaaaaaacattgggaaaaaaaaaaggaagaatattatttctgcctcaacagtcttgatttcggtcagcaggaggctgcggtgggatagctgggagcacatttggggtggtgtcaagtgtcaccatggaggggaggttgagcttgatcctctagatgtgacactggccgctggtctgggagtgagggtggagagacaggctggtgccttgattagcgccagcagctcgctgctgcactcaggccggagctgccagagacagccctcaaggactcattgttggttgagcaacgcagagagtatgtgtggccccagggcagccgggccccagggccaggttacttaggggtgtatgtctgctgcctgaaccctgaaggccaggtggttagcccaggccatgttgcccagctgtattcattccttttcactctgctggtaaaaacatacctgaggctgggcatttacaaaagaaagaggtttaattggactcacagttccacgtggctggagaggcctcaccttcatggcagaaggcaaggaggagcaagtcacaccttacgtggatggcggcaggcaaagagagagcttgcgcagggaaactcccattttttaaaaccatcagatctggtgagacccattcattatcatgagaatagcacggggaagacccgtccccacacttcagtcatttcccaccgggtcccttccacaacacgtgggaattatgggagctacaagatgcgtttgggtgtggacacagagcacagccaagagcaggtgtccctgagaacccaaacatcctggggaggccccgagcactggggctccctgccccacccagggcaggacgtgagcaggaccttttgacatggaggcagagaaacacttcccaagaacctcagagggtgggcttgggaggggtggccaaagctcctccccccaggccaccgcttcatgcgtggagtttgtatcctgcagctttgccaaatccacttattacctccccgtttttttgtgtgtgtgtagaatctttagggttttacatatatatatgtgtgtgtggggggtgtgtgtgtgggggtgtgtgtgtgtatatatgtgtgtgtgtgtgtgtgtgtgtgtgtgtgtgtgtatatgtaaaatcatggcatggcaaacagagatcattttactttttcctttccaacttggagaccttctttttcttgcctaattgccctggctagaacatccaggaccatgttgaggagaagtggcaaaagcaggcatccttgtcttgatcctgatcttagaggaaaagcttccaatctctctccgttgagtatgaggttggctgtggtgttttcatagatggccttgtactgtgacaggtcctccaccaggttacttaagggcatatgtctgctgcctgaaccctgaaggccacatggtgagtccacgccacggtgcccagccaaggagtaggtgtccctgagaacccacacagcccagagaggatctgagaacccgccaaggaaaagtcccatggcacacacacacagtaggcaaagagccagaaaatcagcgtaaaagcagcctagagatgggggcggcgtggatctctcgagctgtcctgctgctgtccggcagtgccctgtgtgcgggtccccatcaactctgctactcaccaggctggacttgccccagtccttctttggggcctgggaaggaggggacgatactgtctcaagtgtgtcccgcagtaggccttgcttgtgttgaaagggttccttctgcgcctgccccgttgggtgtatttcctggtggagtttcatttcgtccaatgcttttcctgcatcgatggagatgatcaccccgttttctccttcattctgttaacggtgtagatcacactggtagatgtttgtgggtttgtggcaggccaggctcactaacgcaggcctccataacaactgtttcagcactgaccacgtggtgaagttaaatattaaaagccggccgggcacggtggctcacgcctgtaatcctagcacttagaaggccgaggcgggcggttcacgaggtcaagagatcgagaccaccctggccaacatgctgaaaccccgtctgtactaaaaatacaaaaattagctgggcatggtgccacgtacctgtattcccagctacttgggaggctgaggcaggagaatcacttgaacccgggaggtggaggttgcagtgagccaagatcatgccactgcgctccagcctggcgacagagtgagactccatctcaaaaaaaattaaaacaaaaataaaagctgagagagctggcccccttatacaaaggctgggatgtaacaaaagcctgccaagagttttgcccaggcctttcctgggccttaaagcatgaaaaataacaaaggaattcttaacatgacccgtttaggactaaacaagttttactgaggccatgaaccacaagcccttccccaggtggaccattgggaagccacatgtgaccagtaggtggtcactcatctttctgcagagctcccaatgtgaccagccagctccccacctgccggccattataagagtcatcctcttcttgacacctccagaagagaacctggatttccagcccaagtctgtccttgtcggctgcccaggcccaacacttaggactcatcctgatttctccttctccctccatttctacctccaagttctgctgcccctccctcgaaggcacatcatgaatttttaattgtcccctacacctctctcacggttgtcccagtacaatccccatcacccccaactgagtcatgtcacagcctcgtgctggcactgtcctcccccaacaattctccctccagcagccagagtccctctccagcccccaagctccacgccacctcagacgtcccctaccatggccctggtcccgctccatctggcccctgctgacctctcctctgcatcccctgccaccccaggccttagccagcccatcccagcaattccttcaggatccctccaccccaccactagctaccctactctaagcggcgccccgggcccttgcctggtggcctcctcttcagctcagcaacctcttctcagtggggccttccctcatcagcccgttcaagttacctcctccgcttgctctttccaatagccgcccacctgtttgctcctggggttagccccccacaccccgggatcacttcactcaattttctcatgtctgctctacccagactctgagcgccagacacgggttctcactgctcccagtctccacctttggcggccacagcctttctgccgacctagcatccattctccaccctctgcttgccggcgtccggcccacggtaccccaactgtgtctgcaggatgtgtgcccagccccagtgaggcatcaaatgggcctaagcggaggattggctgagaggtggagacgagacccagggtgatgctgaaacgtaaggacacgtctgcagggaatccggggaaagacacttcctccttgatgaagggaggcaagcatggggggccctggctgcccctcgctccctgctcctccttctgagtgccactgtgtgaggatgtggtatcccctccttctaactgtgccacgaccgggtcaatatgagtgttccaggagagcggaggaggaggaaagctccgggttacatcccagggcagccgaacaacctggagcgcacatttgggacttcctgttcttatttgtgtcctcatgagtcatgtccccactaggtgagctctctgtgacgtgcagcctcacgcgcactgacaggcatgaagcccagcgctgggcgcatgggacctgctccatcaggttagaagcagggaacaaacgcctcacggctcctgctcccaacacaaccatggagacaggcacgtccgcataagccatcccagaaccgagtggactcactgctcaggagcacgaggaggcccttcagcctggggaaaaagctgggccaatctggacggcgcaaggcttcgaagaatgagaaggttttgcacaaacaggctggcagaggagatggcaaaaggaagtctcatgagcaaagctattagctattaaacggtggctgtggagcaagagcttgggacacagggcagggagggcgcagttaaggatagaaacagctagagataaggcgaacagagcctggtggagaaggccttgagcatcatgcagattcacgttctcttctgcaagcaaagggacaggttctgtttgcttgttttactaaatggaggaatgacatgatcagtagatgaaaattccacagccgcatcaatcacggagtagaagatggcaaagcctagaggtccgcagaccagtggggaagccacccccgcgggccaggcctgtgatgaaggtcttggggcggcgacagtggctggaggagccactccagaggtccacagggagggcttgggaatgcctgggtgtagggagagagggggagacacatgagaaagggctccaagcctacacaggctctctgagggtggcagcagagtccccaggacaaggggcagtcttggggctatcagctgtggacaggctgagctggggaggcccggcagccactctggtggagacgtcccacaagcagtcagaggtggaaaggggagcctggaacgggccggaattgcacaggcacacataggggcccacagcgggtagcagcagggtcagtcgcgggactgattatctgtcaaggaagagggcttaggaacactgggggctagaatcctgggggatgtccagcagctggcgggtgggcagagaggagaggccagggaaagaacgcacagggagctgtcagagaggtaggagagcccaggtagactaatccaccagagccaagaggagagaggagggggacccctggctgaggagtgaacgaaagtgaggacatagatgcaacgaggaactgtcggagtccctgttagcaatgcaaaatgtttgttccctggtgtcacaaggaaaaattagcattcagacaaaaagttctctcagcgaggcaatttttactttctgcagaaagggtgtcccttgcagatggaacaatggggagggcacacacagaataaagagacgccagaatatccattctatatgcatgaggcctctattgctgtgtcctgtctccattggctggagccggacctcacaatctaaattaaaacccgattggctaataatttattctcaaataaggaaggagcataggctgtgagctggaacatgcctatgagcatgtgagcacagatatcttggttaaggtacaaggacatggaatgtactacgtgccttgagcatgtctaacagctacctaggatagggcttaacaaagagttattagcacaaagcaaggaggcttgaaggaagttagtctttaaaagaaactattatttctaacacttatgatttattctttaataagaagggaaactttgaagaggaaactttttactttctacagtcctgcaaccacacaaacaactgcagagaaaggcagcagcagcaggcctcctaacagccaagaggcggaagcaacccaaacgcccatagatgaatgaataacaacgtggtctccatacgatgaatgttatctgggcataaaggggaatgaggctctgacacacgctacagggatgagtcgtgtaaacgtaacgctaagtgaaagaagccaaacgcgaaggcccatgtagtgtatgattccatttgtatgaaatgcccagaagaggcaagtgcatagacagaaccattaggactgcccgggaccaggggaagaggaggagaggctgctgatgagtagacagggtgtgctttggggtgatgaactgttctcaaatggattttattggcgttttaataacttcgtggatgtattactattgcaggatttttccttagttcagctaaacacctcttaaaggtcctaccttttcatactgtaacaatggcagttacatttcaacatgagttttggagggaacagatattcacactgtagctttctgccactggttcccccacactcgccagtctcagtacaaaacgcattcattccatcccgactgccccaaaagtcctaacttgctccagcaccaattcaaaagtccaaagtccagagtctcctctagatcagatatgagtgagactcaaggaacaattcatcctgaggcaaatcccctccagctgagagcctcgaaatttaacaagttatgcacttccaaaatacactgggggacaggcatgagatagacattcccattccaaaagggaaaaaagggcaagaaggaaagaataaccaatcccaagtaagtctgaaacccaatagggcagacattaaatcttaagactccagaatgatctctgactcatcttaatgtgatcccccaaggccaggagcagccccaccctgtgctgggttctgcccatgccgcagctgtcacaggatggcatctagtgcctacatacagctctcccggctggggcggcaagctggtggtcccacagttctggagccttgggagtggccccgttcccatggctcagctaggcattatgaagtcatgttaccagccaataaatgtaatctctcttctttcctatctggatgcctttcatttcttgcctaattgccctgactagaacctccagtacaatgctgaatagaagtggtaagagtggacatctctgtcttgttcctgagcttagggagttttcaaatgagatgggcgtttctgtggtttgagggaaagaaattaatggggaaagaaactggggatatgtataagacaaaggataattgacagagatggatccaggggagacaggaaaaaagcaggccacttcttctggcgatgggagggaacaaaaacaactctgactgatgtggaaaggtaggaatgctgcccttcacacctaatggtcgtctcttctcagtaaagtggggcagtcacctggggaatggtcagggtagactgggggcttgaagcaaggaggaaacatcaggcatgactgctgctgtgtggaagaacgcggaccagcccgtggagatggacccacagaaggggccagcctggtgctttgctgtctctctgttcggtgccggttcaccaagcgccttcccctgcttctgggttctagcccacctgagacttttccctgtttattccctggcattatgaagtcatctctggaaactgaaatcatactaaaaatgtattatattgactgaaggcatatttcttgatcttaatttaaaactgatgtttcacgtttcttctaaaaaagtgggggcggtgcaaagactaagttacttatcttttctgactctgctcttcttaacagaagacagaaccctcctcccactttcaaggtgttacaactgaactcaaggtgcagctggagtaacaccctcctgcacaagtgtccggtcagcacccctttcccacctcgagggccccgcctgagcccagagacaccgcgaacaacaaagatggcttgggcagagttggagtttatttgctgcagttccttggcgctagtttacaaggcaaaaacaaacaaacaaaaacaattagaataattatttcttaaaaaccctgtcaacaactttcagtcatttctttatatttttgtattttgacaaaacttcttttaaacaaatacaaaataatctaaaaggagaaaaactatacatagattatttacacctctgataaatagactaatactgacccaggtgcctctctgtctaggaaacacttgagaaccaggccagggcccgggccagctggacaggctccagcaccggcccaaacacgcccagacctcggcaggcaccacctggttctcccacccagaaagttcaggtttccagcctggaccctcttctgtcaccctcacaagctctggcacaaaagtgcctaaagccattccctccaggtaggatctacacaaagtggcggggagggaggtgacagactgtccccctctattcctcccaccactcctctgcaaaagctatttccagagatgctcgccaaccctaaaggatcagaggagccgtggcgacgcggccctgtgaaaacccgcagctcctccacctgcctcctcggggctgcgccctgcaccgccctggtccagggtcctgtggaggggcggggcgagacggccagccagccagccacctgctctgcctggactggcatgctggccctggcggagtggcaggagctgccctgagagtccctgagagaacggcaggaaaatgctgcgtgtcacggctcccttcatactgtaatgaggaggggcagggccagctcacacagcgcctgcaggggaagacagagatgcgagaggcagcccggccacccccctcactccagtgcaccccacggagcagataaaggcccatcttcccctctagggggcccaccacaaaatgcatccagagtagtccagttagggctggttttgaggcagaaaaagctgaagccctacggggatcggggaagtcctactccttcctctagaacgaggactggagtctggggaagaggaagaaaacccaaaatgaaacaggttatccggaacctctgtcccgataaccttcctcacagttttggttattaggtatttagctcaaggaaaatgctgactttctactttaaagcccaacaagaacttggattctgaaggaggaaaataacgtaagcgtccagtcagctctctcctctcctcggcgctccgcaggcacttgggatggaaaagcatccgcgggagatgccggactgcacgctgctgccgactgcgaccccggccagggcaggcccccgactctgactgtgccgtctgaggctccactgggcctctgccctctgcgtcctcgacctcacctgtccatctcgcccagacaagcaccaggcagcgagctcccacagcacaggagaggcaggccaggccctgccgcgggcccaggctgatgccccttggccgcagccccaggtgctcttctccagggagaagctccccagcgcagccagggcagaatgcacctgaacagccctacgttctctcttaaaaaaaaaaaaatagatctttatagtatgtggcttctcttcctttccacctttttctcttaacatataataatatatggacacatgtatttatggtgcagggtttgaaggcttcttcacggggacaaccaagaggtaaacagttggctctgagctctgctaccagaacactgagcagagaaactggccaggaggctgccctgccgacaagagctctgccctgtgagagaggaaggctctggagcccatgctggacaggtggccggtcctctcttccccagtgataactgcccacccttctcccacttaaaaaaaatagcaaaagctgaagctagtctctaggaatccagggcggggcctggcagaggacgctctgctcggcagcagtgcatccatggaggtgcgggagaagagcaggagctccaaggcccccgcagaccaacgcccttggctgcacgctcagtgtcgcttcgtggaggagaccttctttttccgtgctgcgagcatttcgtagaaagggtccctgctgatggctgctctggagcacagaaaagggagaaaacagagacgtgagggacagaatcagaagaaacacacccaggcaggggtttctcaggggcccctcgtgccccagaacacctgtcccaccccaccatcactgcaaaggccaagttagcgtcctccacccttgctgtgtccacacagtgacctaaggtgacacacttcgaaagagacacaggaacacgtgacaagaaaattttggggtttttacctgtttcaacataataatcaattcacatttaggaacagaatcataccacattcttacagctatattccaattcagagaaaaagactggtgcttgagtttccatgatgacatctgactttgctttgcagcagcgagtgccacgtaatcaagccgtgtcacatgcagtcctctggcacggggtgtgtgatagctggcatggtaatgcagtggggccttccaagccccccacgtgcacctgctcagtaactaaggctccatgactctgcaggcggcactgcccagcacgatgctgctggtggggcaccatggacagaccggctggacctggctgggtctccggtgcacagggagggggcccgagctcatgcttgtgctacagcctcaaagacagc

SEQ ID NO: 15175 - DNA, 56241 bp, Human; identical to SEQ ID NO: 15174
  misc_feature (1)...(56241): n = A,T,C or G

SEQ ID NO: 15176 - DNA, 16874 bp, Human
agccaagcactgagcaaaaatgtcccccaaaggggtgtcagcattcaacagtctcacatctcctagggaatcagtcattcaggagggtcttactgaaagctctcatgtttccccaaaagtagtgaaggatcccaaggtcaccctctcttccaagcaatgctgccccactttgaacatcaggcagaaacttccctgttccttaaggtacggagaaatggtgggtaaggtgttggggaggaggccagtcctgtgtttctggtactgtcatgtatccggtctccaacctcaaaagatgtgctgattctctctcccccaagcctccctgggtcatgcccacctcctggagtccccagctttgcctttgcctgccaacttgcctcttggttcagctctatttgggagcagagagtccccataggcccctaagggtgaagccctgtcaggctgggacagaaatgtagagctggggccagttcccaggggagaactggggaggactggggtgaaggtagagagaggagaagttaaactttaacatgacaaaaatattaaagtatttttcaaagtactcttaaaaatgtaaatctttatctatatactgatatgcaaaatattccatgacaccttgtggagtgaaaaaaaagtacacattataaagcagcatgtgtagtgtttatataaattatatatttgtgcatgtgtgcaaaagacagagacagagagtatataaggagtgaggtctcagagggtgttcactgaaatgttaatcctgtttggctttagggggtggaatttggggtgatttatacagtctcgtttttacttttctgtgctgcttaaatttcctatataagtatgtttcatctttatacacaggaaaactcccaatgatgctattttcaattggggggggggaaacggatagttttcatcataaaaggagtctaatacattagttaacataaaaggaaaatggagaaagaaaagcctccatcgtcctatctccgaggcagcccttcagagcatgtggtgggtttccttcctgtcagccggctctgaatctgttcaaagcagcttttccatccaggtataataatagattggaaagtgctgcacacgtacaccctctcatgtaaggcttgcagcccccctgaaaagtagatctgtttatttcccccagtctatggatgaggcacgtgaggttgactttcaggcaaggaaaatgacttgcctgggtcacatatacctggcaggcagagccagacctgggactctcagcactggcagcccaatgctacttccagtgcccatgactgccatgcagggtaggggagcttttgtgggccctgccaggcccagctcagggccctgcaaacccctggctgctgctgatgcagtgcgctttaaggaacatttcctgttgtccatcaggttccaggtctgcccccagggctagagctacaagatgcagccaactcagcacatgtggacctctggtggggagaaagagggcaacccgaaaggtcacttagcacagagtctgggcacacagtaggtatcaataaagatcgattgaatgttcatggtcaaagttgcttctagtgtgcccgtgctccgagcctctgagtgccaggagaatgcccagcgagtcccacttgggccatctcggaaggcttcctgtaggagagggcctttgagctgagacttcaaagctgggctgaatttccccgagggtccagaagagagccacgggctggtgtgtcaggcagcggagctgacactcccagaaagcaagatcttcgaactacagggtgcgcgcaggctctcgcttctctccaccatggggggccctgcagtactcgccaagagcgtagaatttgcctagtattagccacgagagggcggggtggggcgaggcggagcagggccgaggtggcggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcctctgtgcccgcgccggaacaagaacgtctcgtctgtttttctggctcgacaatgcttctgactccgtgtccctcactgctttggcttcagcgtagggagacaggggaatggggttgttaggaggacagggaaagctccggaggggcgtctgtgcccaggctgttgcaccaacagccagaggactcacaagggagacgggtgagtgcgggacagtgagaagtcaccttgatttaggggaagggtgactgtggcttcacctagaattggtgtgcgcccctgccccactctctactgtagaggagtcgcagcgggcagtgaaagcctgtgctctgggcggacaggacgcctgggcctcctgtgtgggaaactggaggggaagggagccccttatctccgggccccctgcgcccacctcccccggctcctttgctgctggtgtgctcaggtcagctttagtggtggtagtggtggtggtagcggtggtggtggtgtgtgtgtacggggggagattgggatttggtgacatggagaagcagtcgccaagtttcctttccggtcttactttgagatcatatgtctggtgtgtgtgtgtgtgtgtgtgtgtgtgtgtgtgtgtgtgtgtgtgtgtgtatgtgtgtgtgggtgtgtgtgtatgggggctagtgcagtaaagcttgtagggggcacagatcccttccaggcacaaatgcccacgggctgggcagatgaagctcacccaggggtccagcctggtagccagccccacactgcaccctttgaggctggtccagtgaaaaccttccccacactcctgtccagaaattcaccggttcagcctggagaagtggggaaggggtgtcccatggcttcatggctcagggttcctgagccccgtgcgtgatggggagagtttggggctgagggtgctgcttccggatagagcctcctgcgcaaggaaagaaacagaaacctgtgacttgtgtggtatttgtttagtaagcaacccccggagtggactgtgtctgatgtgggctgtgcgcacccacccttcccagtgcggcccatgtgagcaggggaccagcgaggaccagtgtggaagggctgttgtcattggtggacctgggatgctgggtcccaggtccgagaggtgtggataccaaacgtggggcttggggtggaggggagagggagaaggccatgttggaccccagaggttggtattcgatctgggcattgctggaacattcttccctccagatgatttttgtggggtagcctgggactggggaacctgttgccagccacaactggcttcaagttactgagctgttccactttccctgggatgaacccaggaaagttggcgtgttctttgatggctcagccttcatctcttaagccttctgataatttctctctgctccccccaaccctagtcaccctttgggtgtacccagacacagcccaagcttctggtcccaatgtgtctgaattggaagggacccagaagatcctgtccctctcactgcacagacagggaaacaggcccagagatagcaagagactcttccaaggtcacacaacacactcattgcaggcagagctggcactacagcccagatagtatttgcttgggtttctttctctggccccctacggccaccagtaaaaacagccacccacgctctctgaaggccctgatgcattcagagtgctttcacttccattatttcactgtgcgttaggtaggccaagcagtctccccattttacagttgaggtcactgagttgcagggtcagctaggggcttgcactccatcacacagcagaccagaagtggggcctcttaaccttccactctgttgtgtggtcaggaggacttcccaccctgggcccttgctggggtctccccacagcctctgccaggcctctgcctcctcctgccagtcttgagggatggggtggatggagcatcagccagcactctagggagttggccagtgctagggggctgcctctctgcctgtagagccagcttcagggaggctgtagagcacttcagggaggcacttgaggggatgattctcgaagtgtgtatcaccatctctactcccatggcctcctttccttggtgttcctgctgagtaattctcacttgacaagtttttttgtcccccttttagatacatacacttacatttttttattatgaaaaattccactacatacaaacatggacagaagaatgtaacagacttccatccccagcttccacagttgtcaatatgggtccaatcttgtttctgcatcctcacttcgcttcttctgtctgcaactatattagtaatatagtaattactaagtacattctagatattattttatctctgcacctctaaaaatgactttttaaaatgaatgcattaccattagcaaacctgaaaagaatttcctaaatatcaccaagcttctctgattgcttcataaatgtgtgtgtgtgtgtgttttccaatcctcacactttttgctccattctgaggggctccatacgcggggtccctgttgaaggaggcagtggctcttcactgtttcttttggtgctttttcttggatcaggcttcatagaccccacgctgccatggaggggacagaggacacacaaccccaattcagtcccactagccccaggttacctccataccttctcagcttgggctcctgagatctgggaaatcagtggccatttcctctcaaaacaggcttttgggcttatagcacagcttcctttccgtcttcctgcttttgtgggctggcctatccctccgtgggttccagtgacccaccagtcacaccacatcacccatgaccttcttcctttttgaaaggttctcccacctcaggcccacctacagcctacagccccacggctttttgccttgagctgactcacgccgtcccggattcttcctctcccacccaccctggatctatccctcggtattgaccagcgccagtggcatgctcttcccaacgggcagaaatggggcagggcacagggggtgattcctgggtctggagattgatcaaggcagctcagatggggctgagagaggggaactgagaacaaaacggtggattatcccagtaggagactttggtgtctacgtttgtgtctggagatttggggcagcctgataatgccccacacaggcttgtgcgagggtttctgtgtggcagtgtgtgtgtgttgcgaatgtgttggcgagtatataatagttgatggtagacattctcagtagaggaagagagaggcctgtgtctctgtgggtgtgtgggtgtgtattaattgctggcaatccccactttctgggtgtgattggttgattattataattaagataactttgggtagctgtgttgtgttaagctcaatctgcatttggatttgtgcatgtgaagacagaggttggtaaaacaacaatttcagtcccacactatccttgctatcctcacagtcattacaatttttttttgtctccactttcccaactccaagaactttaatttttttatttgtaatatttttcatgggccaggaagtggacttgaacctcccacatagataactttagtcgataactttctacatctttttttttttttgagatggagtctcactctgtcccccaggctggagtgcagtggctcaatcttggctcactgcaacctgcacctcccaggttcaagtgattctcctgcctcagcctcccaagtagctgggattacaggcagaagccaccaagcccagctaatttatgtatttttagtagagacggggtttcgccatgttggccaggctggtcccaaacacctgacttcaagtgatcccccgcctcggcctctcaaagtgctgggattacaggtgtgagccaccgcacctggcccaacttttcagatcttaaaaaattttttttaatttattttttatggagacagaatattactgtgttgcccaggcggtctcaaatccctgatctcaagcaatctcccgcctcagcctcccaaagtgctgggattacaggcatgagccattgtgcccagctaaaaacattttttttaggcttaagcatgcttaactggtttcatttgtcttggggcaagtgaaaacaactttaattaaaaattttttttaaatgagacatggtcttgctctgtcacccacgctggagtgcagtggtgcgattatggctcactgcagcctcaacctgctgggctcaagcaatcctcccatcccagcctcctgagaaactgggactataggcgcacatcaccatgtccggctaattgtttctattttttgtagagatggggtctcactatgttgcccaggctgcagctttgctttttgtctggctgtttgccagtggctgtctgagtctattaagtggatctgaggttggtaagacgaggagttcccttgatgcccaagcacattttgtactttggtaggtacgacacattgccagaataccctcccaaaaggtgctaccaatttacgcccacaccaatagtctatgagaggacccattttctcacagcctcatcagcagtagatattatcacattttttttttttttgagacaaagtctcgttctgttgcccaggctgaagtgcagtggcatgatctctgctcaccgcaacctccgcctcccaggttcaagcgattctcccacctcagcctcccaagtagctgggattaccggcatgcaccaccacgcctggctaatttttgtatttttaatagagatggggtttcaccatgttacccaggctggtctcaaactcctgacctcaggtgatccacctgcctcggcctcccaaagtgctgggattacaggcgtgagccaccacgccgggccaatattatcaatttttaaacattgaccaatatgactgagaagaactatctatctccttgctattttaatttgcacttaattacagtgaagcagagcctgtgccaggagctccgaatctgggagaggtatgacgaccctgtgaaccatcccaaggctacttagttcttagggccagcagaggaatttggggtcttggaccctgtcttatgagggtgggatggtaagtggcctttagggacgctcaatttgacaccagacccatcaccactctcggttccttcccagcaaagtgtcatgtaaatcaggggctattttgggattccagctggtggtgattctagacttttagggagaaaccgagatctcctttctcttctcccttttccccagcctcttcctgtgtctccatttccctctactagtgataaaaacaggatgagctgggcatggtggtgagcacctataaccccgctcgggtgactcgggaggccaaggcaggaggattgcctgtgcccaggcatttgagcagagcctgtgcagcatagcagactccatctcttaaaaaaaaatcagtatggcctgggcgcggtggctcacccctgtaatcccagcactttgggaggtcgaggccagtggatcacctgaggtcaggagttcgagaccagcttgattaacatggtgaaaccccgtctctactaaaagtacaaaaattagccaggtgtggtggcgggcgcctgtagtcccagctactcgggaggctgaggcaggagaataatggcgtgaaccttggaggcggagcttgcagtgagccaagatcacaccactgcactacagcctgggcaacagagcgagactccgtctcaaaaaaaaaaaaaaaattagccaggcgcagtgttgggtgcctgtagtcaaggagaatctcttgaacctgggaggcagaggttgcagtgagccgagatcacaccactgcactccagcctgggggacagagcgagactctgtctaaaaaaaaagaaagaaaaaaatgaatatgaagaaatggggaccacagagcacagcatgcactctgcagtcagaagacctcacctctgctctcccaccgaggaccgtcaccaaacctctcggagcgtcagtttcttcaaatataaaattggaaataacattttattttttattttttctttgagatggagtctcacactgttgcccaggctggagtgcagtggcgccatctcgggtcaccgcaaccttcgcctcccaggttcaagcgattctccttgcctcagcctccaaagtagctgggactacaggtgcatgccaccacaccaggctaattttctgtatttttagtagatatggggtttcactatgttggccaggctggtctcgaactcctgagctcaggaaatccaccctcctcggcctcacaaagtgctgggattacgagtgtgagccactgtgctgggccatctttcgaactttttaacagctttcagaggaaagatggacaggagttagactctccatttacatgtgaagaaactgagatttgggctgggtgcagtggcccatgtctataatcccagcactttggaaacctgaggcgggtagaccacttgaggtcaggagttcgagaccagcttggccaacgtgaaactccatctctactaaaaatacaaaaattagccgggtatggtggcacatgcctgtagtcccagctcttgggaggctgaggcaggagaatcacttgaacctggaaggtggaggttagagtgagctgagatcacgccactgcactccagcctgcatgacagagcgaaactccatttcaaaaagaaactgagatttggcttgagaattaacttatccagggtcatagggtagtaatctatttttctcaactcaggaaagtcaggggaagacaggcgtgtgacagcacccttctaggacaccttcccaaggttgttaggtaagttgtcctggggacctctggggattagaagtccctcaaaaacagttcctaggcccctggaaccctccctcctccaggtttcctgactcagataggtccctttttcctcatccttcagggcttctcatgagaggagggggaagtgtgtggaaatgaaaaataattctgatgaggattagcttctgccattctgaaaactctgctcttcctgcttgtgttagaagagaaaggctaagccattggagctggtgatggaattggtgctggtggaggtggtggttgtagtgacggtactactggtggtggttgtgacggtgaaggtggtggctgtagatggtggtgcccgtgctggtgctggtggagatcgtggttatcgtgatggtggagggggcagttgtagtgacggtggttgtgatggtggtgatgggtggttacagtgctactggtggtgatggtgctggttgtagtggtggtggtgacggggctagtgaaggtgttagtggtggagatggtgatggtagaagagtgcttcttttctgaatctgttactctggcacaacagcggaatcatacagcatcccaccccctaacttcctctacttttcctggaaacaaggactttgaacatgagccccgtgttcaatagagccttctttcaggtggatgggaagctccctgttcaactaggatgtgtgcaacttctctaaaggctgagggcagactataccgcaggtggcagacccaggagcatgggagagggagggcctgtgagtgggtgtcatgggtctgggagtgtgttagcactgtgagagccacggcagagagggtggctgaggaactgaggcgtgaggaccttccaggaactgcctgtggagagctggtggtgccccctcctaggaagcagctaaggttagagacaggggtgtgcaggtagatgtcgagcaactgaccctctgaaagaacattttaaaaaactctgatttgtagtgtttgctgatccctgtggtgtaaatactcctgctatggatgatttcaagcgactcatgtgagtcattgaacacagagccgggaagagactcacagtgcactgtgatttagtacctcctccatgcagctgcgatagacggaagtaacctcgacagtgcagacaatagtaaaacgtaaaataactgggcagtgatgattttttagtttttactccttttttttttttttgagatggagacttgctcttgtcatccaggctggagggcagtggcgcgatctcagctcactgtaacctctgcctcctgggttcaagccattctcctgcctcagcctcctgagtagctaggattacaggcgcccacgaccacacccagctatttttgttgttgttgttgtactttttagtagagacggggtttcgccatgttggccaggctggtctcgaactcctgacctcaggtgatccgcccgccttggcctctcaaagtgctgggattacaggcatgagccactgtgccgggcctactttgactgttaatatgtcttgaattgcaagtttatataatttaatttttaattatggctgtgtttaaccactggctggcaaactccctaaacaccttccagctggttcttgtgagtgggaggaagccggctacagcacaccactgatgcctgggcactgttgcaggggggactggctgtcaagctggagctgatgggtgctgggggctttctctcttctctccaggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggtgcgcgcgcccctgggagcggtgggctctgtttcgctgggactgggcgccccctggtgggcccaccaagcccctacccctaattcctagacctttaaccccctcccactccatcccacgccattgcatccctcctgtttctggcttcctgctttgctctagcctgtcctctgctgagtcctctgcccttccctgcctggtcctccccctgtgtccttccttacgtccctctcgggacaggcaaagccctacatcaccagggttctgtcccgggggctgcatgtcaaagaggtgaactgtccacaggaaaccgcctgtacgtccacccggactcccccaacacaggagcgcactggatgcgccaggaagtttcatttgggaaactaaagctcacaaacaacaagggggcgtccaacaatgtgacccaggtaggacctgctcttcaaaaggtagcctcgccctgctccccaccctgggtctgagacctccaaggccacaagggtcctgcggggccagtttggttcattttttcttccttcctacaggaaggaaggttcgtttttcttctgtcctaaacgaagggtcatttttcctccttcctaaactctggctgtttctcacccaccttgggaggaagatgagatgggatgaagctgaatcttggacgggggtcatattcaggccacacaggccaacccagcctcagggtttcttcaccaaatcatgggttgccattgctccggcaccatgaaaggcacagagttggccctgtggtcccagggaatagatgccgagtttctctaggttgaacaatcctgttaaaagtgcccttgctggctgggtgtggtggctcacacccataatcccagcactttgggaggccaaggcgggtggatcacaaggtcaggagttcaagaccagcctggccaagatgatgaaaccccgtctctactaaaaatacaaaaattagccaagcatggtggcgggtgcctgtaatcccagctactcaagaggcggaggcaggagaatcgcttgaacccgggaggcagaggttacagtgagctgagatcatgccattgcactccagcctgggtgacagagtgagactccgtctcaaaaaaaaaaaaaaaagaaaaaagaaaaaagaaaaaaaagtgcccttgccctaaagccctgtttgtgctgataccttggtctcaattgacatctggaggtagaagagggggcaagaggctagaattggtgccccaaagagtccggacactggagttggaaagcttgggggaagttacatggtggcagagcaggggaatggacaggatgacctcaaggtgcttgctagcctcacgtggggccagctgttggtgggggtgatgggatcctcgaaatccttcctccccacccctacaaccgtcttgctctgtctacagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgaggtgagggctgcctgagccccggtggggaggagggcagagtggggcccactgtcttccttgggagggatttggaaagttcccgagccccagactcaggactcaggtgactctatttcccttctctctagattactcagctgaaaattgataataacccctttgccaaaggattccgggagaactttgagtcgtaagtgccactgggttcaactcagctttggtccctcctgagacacatcctctccctgcccctgaaaacaggagggtgggggacagatgctacaggtgggcaggccagggaaggagggtcggagaaggaatgtgtgaaacaggtaggctcacaggtgactggttctgcttgtgacccgttttcttgccttctatttttttctagcatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttgaatgtgcctgcctcagtgccagcatggggggacatggatggggactcagttggggttgtacccaagctggtgtacccaaggtgttctgtcagctttcatttatggggaacctgctaagaccctgaaatgactccagctgagttacagcaaggccacatgtcctaccttcagcactcagggggttggttgatgctacctcttaaggcatcttgggacggacagagaagaatcccttgccctgtgtgcaccctgacattgaaaggaggggtgtgagggcaaggccaagggctggactgggagcgggggtgcagggcgctgtgaggcggtggcacttgatttttctttgcatttctagcagccctccacctttatctctagggttattcaaggattaaagaaataaatataaaatgagccatgtgaaattaccatttttgtaggtcgaaaagccaaatattagcaattttatgtgactcaagctaatacatgtaaagggtttaagaacattgcctgacaaacagtaagcactcactgtgtaagctactgttaccaacagtttctagctgtttctgtctgtctttttatacacactgaattgtgtttgtaaaataatacatacttttttttttttttttgagacagagttttgctcttgttgcccaggctggaatgcaatggtgcgatctcagctcactgaaaccttcgcctcccaggttcaagtgattctcctgcctcaccctcctgagtagctgggattacagatgtgcaccaccatgcctggctaatttttgtatttttagtagagacggtgtttcgccatattggccaggctggtctcgaactcctgacgtcaggtgatctacccaccttggcttcccaaagtgctgggattacaggcgtgcgtcaccacactcagcctatacatgcttcttttaaataattcaagcaaggaagaaaagtataaagacaacaataaattatctcaaatcttacccatcaagaattatcattaacattaggtgggttagacagaaatagttttataaattggaaccatactgaaaaggctttttcttaatgaaaatggttaaattttagcttatagaatttagtcacacacacacacacacacacacacacacacatcaagacaagcaaaacctctcaaactctcaagtgaaatgaagggagttgctaaacttaagataaatttttcttcactacaagaaatattttcttggttttttttttttttgagacagagtctcgctctgttgcccaggctggagtgcagtggcacgatctcagctcactgcaacctccacctcctgggttcaagcagttctcctgcctcagcctcccgagtagctgagactacaggcgtgtgccaccacgcccggctttttttgtgtttttggtagagacggggttttcaccatattagccaggatggtctcgatctcttgacctcgtgatctgtctgcctcggcctcccaaagtgctaggattataggcgtgagccaccgtgcccaggcaagaaatagtttctaaaagaacactctcaggctaagacaggtgcttataggaaacattaagaagttagagttactatgttgccccaccacagtccagggtgcaccccattctaatggggaaacatcatcatgggctttgggtagttctcccagttctgtttaaggtctggaaaacctgttttttttttttttttttttttggtcacagttcacatcccatccttttttgctctctactcagaggcaccttctagttagaaggaaaaaatacggtggcatacttggctccctttcctttgaatttggaatctcataattttgtaaatgacaggagatctgccacattgtgctctgtgagttcagattatttgtccccctactcctaccccgtggctgtcactttctaaagttaatgggttgggtctatttcctttcttggaggaactgtggttgataattataatact

SEQ ID NO: 15177 - DNA, 18556 bp, Human
ccataacaatccgcggaggtctatactattactagtcatatcttaccgatgctagtggaggattttctattactatctccacttataaatgaagaaatgagataaaagaattcatgtggtagctatgagaaaggaataaaatgggtgctgattctagacaaaaaaaaaaaatcctaaagattaagaaatagcaggaattgggacatatcagaaacactaacccaatgagataaaaagctcaagataaggtctatgcaaataaaataatttaatagaatatttgttggtagcttgactcttcagaggttggaaggcagagaaatgttagttgcaattagcagtcatagaaagatagaaatgggaggtgattttagaggggggaaaatgccatgtaccgtagtatatgtatgactggtgctttaatcctttcttcaaaaaataaaataaaatcaaacaatgtatttaatgttattacttagcaactctacagctttaacaagcacagtaaaacatattagctatttgaccacaggcaagttacttaacctggtaacaattttctcatctgtaaaatgggtataataatacatatcttacaaactagttgagtaaagggaaattatatatataaagcaaaaagtaggtgctcagtgagtgctaataaagatgataatgttcttgcagagagtagacatgcaaaacttgaaattctgtctgctcttagccatggcaagcaatcagagtaatatgcagagaaacatattctgcacaatcatatatggtttttagatagtaacatgaagtattaaacttagccctgaaagacaggaaagaacactctctttctacagaggaaatctttacaagatttagactcttactagatattagatatacatgaaatgccttctttacaggatctgagtttaaattaaaacatgctttttttccccttttcctcctgtcctctcagatgcctttctcacctgtcacttctttctttgtaaataaataattttgtttatagccacaaaactctcagaatcaaaagggaaattatttccaggcacgttatctttgatctgctaggagagtgtgggagagggatcctccggcagaaagcaaactacttgaacccaactgtgtgcctgctccccaagtcacacaggtatactggagccagcattcatactttgttcttagtgaacaggcactctggacatacttgttagtgacacttggttagaggtgctaattatccagaatcagctgcagttgctaccatggaggtaaccagctctgcccagtgggttctcctgtgccctacaggcccattaggggaatcagctgttggtgacctcgagtagtcaggtagtttatgggcaataatttacctagaacctgctttgtcctcagaactacctttaaggccaaaaatagttctcagtgcaaagcagcaaataatgcagtcaaaaaaaaaaaaaaagagagagaaagattggattggtacttttatacagcactattttgtattttgcccatgtggaaattcagtgattaccataaaaggcctggacacggtaacagcttaagagtatcagttgacaatatggctgtccaaatgggggcagaagatgtgcttggggacatccatcaatcatccatgcctatgtttattcaacaaacatttaataagttcctactttgtgcaagacactgggctggtggctgagcatccaactgcaaataaggcatacctcacagcctggtgggcaagtcaagaaaataaacagataattttaatacaggtcatcatattaagaagggaacaggggataagggaattagagtaggagcttggaattcagggaagtactttaggagcaggcaatacctttggggaatctcaaatgacaggcaaatattagtgaggcaaaaagaaaggggaaggcaaaaggacattccaggcaaaaggaacagcttgagcaatgtgccccagaatgaagggagaggaagaggagaaaagcagcaagatgcttggagatggagaggatttaaagacaggtgagtgctcctgaagcacaaagttcaaggtagggagccatgaagctgcagaggtaggctagaaaataaggtttgccaaggtaagaattaagaacctcatcttacaggacaatgagttatgtcaggcactagctagggaagtgatatgatcagatttgtgtttagagagactgctgctggctggatgagagctgtatgggggaaatataaggggacaattcaagcaagaggtaggaaaaccagttatccaggagagagatggtgagggcctgagtgagggcagcagtgactgaggaggagaagacagctgaaccggagaagacagctgaaccaaagcagtcattgtcaaactgagccctgtatccacacaatggaatactctttagcaacaaaaagaaatggtatacgggtacatagtgcaacacggaaaaacctagaaaacatatgctaagtgaaaaccagacacaaacgaccacctattgtatgattccatttagatgaaatgtccagaaaagacaaatctggagacaaaaagtagatcagtggctgcctggtacttgaggtagggatcttattagggtgatggaaatgttataaaactgcattaaaaatggtgaaggttgcaccttaaaaatgatggttggtaaatttataaaaattatttaatgtacacctaaaatgggtaaaatttttgatgtataaattttacctcaataaagttggttaaaaaaaaaaaaaagagcatggtcccagatagcagcatcagcataagcattacctaggagtgtgttaaaaatgcacagactgcaccccagacctgaatcagaaactcagcgggtgagccataacaatgggtgtttcacaggccctctggatgattctgatgcataccaaagtttgaaaaccacttgattagaggaatatttaggaggaataatcaactggacttagcagttaaaagggaaaagggggtcagaacaggacagttcttaaagagtactcccaggtttccagattggggagccacattgctggtgatgcccccaaatgtgattgggaatgcaagaaggccaggcattatagcaagaagtttgcggtgctggtggggcatctagcaggaaggcccagcagacactgcatctatgagtccagcaacactgagttccaggcagctaaggactcagaagtccactgtaatcaccagcaggctcctggggaccttagcttctggacacagcaagaaggtgactgggatgtgaagaagatcagtaagggaatctggactgaccttttagaagtttaagaggggaagaaggttggggcagtatctaagcaggtaaaaagggtcagaggaagcctattctagaatgggagaaattttagcatgttttgttgacagaaagacacagtaagaaattttgaaatggggtgatgggggcggtgggatcatgtatgaatcaagtccaagaaaaggcaaaaaggagatatctccaaggcagagtttggtcttggacagaaaccgcacacatcctcttctgaaactggaggatatggatgtggatgcttatgcagtaggagagtggggaattaaggaatattccaatggagggacttgattttctatagacattaggacaaggtcatctactaagagtgagggggcaggggttgatgggatggtttaagagtacaggtttaaggtcatttttgggaaaagaaagatgaccaagggcaagagtgaggctggccaggctggctaaagccagctgggagggaagacgtgaacgcataggggcaccagaccatgaactgtgagattctctctagcacgctcagctaccctgaagtagaagccaaaaacgcagatgcagcactgatggggatttgctaaggaagcagaagaagtgaggggtgtgagggttcataagagagtaatttagatcatcaacacaggatgaatcttgggttaggaagaaagggaggtccagagagggctgccaggtaggtgggaaccaaggaaccagaaacctagagtctacaagagttccaagcaacagatgtggaaaatgagaccatgaatacagtggaaagacaggaggttgtgggccaaggtagaaacaggaatccagccatctgctggtgagcagtgttaggtgtttccaggaacaatgtgtttctagggtgggtagcttgaatgccctggttgaggtgacagggccttatgtggaaagcaaaaaggccttaagccccgagccaacccaaatgcattgagtgttaattaagagacatatagtaggctagcaattggaaaaccagcggagaagcaagaaagacagcagtgcatctgtgttttctgcttctacttgagggcagctgagcgtgctggagagaatcttacaatccattgtccagcgcctctatgcatttgcatttcccctcccagctgggctttgacagattctgtcaaatcttctacacaacagggggtgctgctcaggtttttaatcctaggaagcactgtacatcctccacaaaaagaagttaataaattttggctgcaacaaacagctgtagcaggtgtttataagctaatcaacgattggaagtgctttgataaactgacccagtgtcctctcctcccagcgtggtgcctgagaaatgaaggtgtgagttctgtgctcctgggatcatccactcctgaacaactcattgaaaaccttggtgccattcaggcaagtactgcagccccttccaacatcagggaatttaatggtgcctttgaggctatctccaggcagtgtcccatctctccccctctctgtcctgggtggggcaagagtagggggaacaaaggcaacagaacactttcccagtacatggatccagggttgtcctctgcctatgaacaggcagtattcccaaagctcatttcttgggatggtttgtttctgtggaagagtgcattgcagtgttatacgtggcaactgacttcccaggcctcgccataaaagccggcctgataacttgcttggaaatttaagtcataggacaatatacatacatcatttacttgtttgttctttccacaaatattgcccacctgctgtgtgctgagccccttcttgctgttccctgaacatcttgtattccccctcccatgatcttttatgataatgtagtataactgcctgtctctcctgttggactgcaagccctctgaggtcagacctgtgtctttgcttttccactggttttccagttcctagggtacttactacatgtcccttagttaacactcaagatctattgaataaatatttgccatgttttaagagaaatgggctcaaaattctattttggacttccaggatcacatctccctagaagcaaatttaggaggcccatccccattccctatcccatgagatggccactggtccagggcactagatggggcctgcagccatattctggggagcctgtagtggcagtgggtgggttgaaaggatgttcctgggagctctaactagaggggtggagtttagtatctattgtgaccacctcctttccccaaaggccacaactagtcctgagcctatcctactctcaaccctgctaaaagccctaggaacgatcctgcccacaattcctgccatagccactacctggtaaggttatctatttttctcttgctcatggaggaaaagaactgtctcacagcttcttccctatctacctgtccctgcaacaagcacacagccctgttaccattcccaaaaggaaacaggtggaggtagcaacaaacatgatttaaaatcttttttaaaaatagcccagaatacactgtggaataaatggtatagatccctgcccattcccccaacctttcttaggactgtgcagccgtgtaatcacctctgcctctctgcttctaacaactcccatatccagccccataactcctactggattctgtgaggttccctgtagctacgtgaggaattctccctcttatgttcatttatgctctgggaaaagataagggtacacagtgatgaggggacagaacagtttgtacaaaaaagaactgaaattcaatccaatgatttcagtttcactaatatttatggagcacttattctatgcctggcatcatgctaggcagtgggaggactgagatgagtaagaacaggacctggccttcaaagagctcatgtgctggctgagaaacagtgaattaaaaaatctatcccttaattcattcaacagatctttgagagcctattgtataccaggtactggagataacacaggaaagaagaaaaacactgtctaaccttcaagggatgttttacgtgccagtaggagagacagataaatagcaaaatgatttcaggttgtgaaaagggctattaagtaaataaatgtttattttactgagactgagaaatgggtgagcctacattaaatgtttttgcaaaaagcccctctggaatatgtttactccgagggcttcatgtgccttcattttttacattctttgacaaccattcacaagtcttcacacagcatgtgaagagtccaggaaagtgcattccagggacagggaagagcagtggaaaggccctgagatgggaaagaccttgacttttcccaggaactgccagctaaggccaatgtggtcaacacgtagttgagcacagggacagcagatgcactgacgtggagagacaggcagggccaggtctcgcaggacaccatggggttagagttcatgctacatgtaacaagtccttgtggagggttttaagaggagggacatgctcctatttgaatgtctgaaggtcactctggctgccatgcataaagtagaatgaagggcaagggcagtcatccaggcaggaggcgatggtggcttgaatgagggtagtggccatggagggggagagaaatggatggattctgcaggtttgggaaagagagacaccatggcttggcagaagagggaggaattgaggatttttatcatgctaatacagggagatcactgccattcctgggggcagtcatagtgcctagggatggcatatgaggcaagtctagggctgagttttaaaagctgtggaaataggcaaggcagctgacagggaaggggacacatttcagaggaaaactcttgagtaatttttcttcccaaaacatttcctccctagcaaggctttggctggcagcaggatgaggctttgcctatcctaaaggggacattatccatgcagcaagactgctaccattgcgggcttaccaatcctcccctgttctacttcacctcccccatacccagcactaaagtccacccaagacgagttgtgattgggccccacaacatggtgaaaagcagactgggtgactaggggtgcccagcagtggtggcactggctgcaaaaggatggaaaatacggagcaccagcagttgtaagaaaatatttctagtaggctgggaaggcagctgcttcaagggatgccacgtgcctaagatgtgcaggaacgaaggggcgtatataaatcagagcctgacagatgggagagacaggaggagaaaccacagctgcaggcagcccaccttcacctgcacaggttccatcctccccactcccacctaaaaggtgggagaaccgcctctccccctcctccccacatgccttaaaacccttctgaggcttcccatcacccatcagagaaggccaggctccacagcagtcgggcctcatcactccccaccacaccttcctggaatctgaatcttgagccgctctcaaccactcagagcttcggcgataacagtggccctctgcctacaaactgaccactatcccagcctagcaaaatcctactccatccccaagttccagatcaataggaacccaatcctgggaggactttactaatgcccagccagccccagcaacattagccagacctcccccaacccaccacctatcccaggcagtgtaacatcaagtttgcaaaactagtagcctgtggggtgtttgtaaaatctgtagtagtttacaatgtttcaaagtggggcttctcttgaaaattctggtcttgtgatactatgtcttgttttattcgagtacttttatggtttcatttttttaatgtttaaatctctttcctatagagatttgctttggtgtaatgaatgaaggattcttctcctcacgtggctaacccgctgtattttagacaaaaaaaaaaatccaacaaatccagtttctaggtttttggtctcattgttacaatctcattttaaataacacattagctgtttggacactgaaattccagagctagtgggaaaccaaattcttccttcagcttcagacagtaaaacattaaccagaatgaagtttcccaggctggcagctctattttgccaaaccctaaggcttctgaggatagcacttgactggagacaaggtcaccttggccagcaggattgcaacaaaggaagaatgaggttgaaacctcagaattggtcgtcagaattgtatttcaccacagtctccacacagggtcagacttttccagtgagaaagtctgcctttgtcccttgtcttatggtgtaatgtgtacccttggcccacttctcacagtaaatgctagccttggatgagctcatcctttcccggggcttcagtcagcatgtcggtgcaaatgactcacaaaccctcaactccagtcctccggcagctactaagctccacagctgcacttgcagctgctcagtcactcctaggtggatattccacaggcactttacactcaacacatcctattctctcccaacttcttattccccaaactacttctcctttggtttctaatctcaataatcaataccaatatacttctagttactcagtcttgaaaccaccatcttcccccaaaatgtctctcaggtccacttttctgctccactgccctagttaaggccctattgcccggcttggattgtaatacatatctaatatctgtgtcccctttccacctcctccagctcatccttcaaactacctccaggtgtctgatagggttactcctagatcagaagtcctgacaggttccccactgcctaaagtggggactccataaaatggcattcaaggctttccacactcttatcccattcttaccatccgtatcctgttcttagcatccccacacctacaccaatcactgtatactatcactccagttcacttttccatgctattccatctacctgggatgcctgttaaaccccagccatccttcaccagggataagaccaccagtcagaataaatctctccttagtctctagacctgtgctgtgtactactatggttctagccacatgtggctattgtatgcgggaaagatggtgagtccaaacagagatgtgctttaagtgtaacatgttcacaagatgtgacttagtaccaaaaacaactgtcaagtatcttttctatattgattacatgttgaaataatgttttggatataatgaagtaaaaacatgtattaatttcactgttctttttaaggtatctaatagaaaattttaaattacaaatgtggcttgcattatatttctgttggatagagctgctctatatttctatgagccttcacttatgcctttatgccttcatttatgcagtcaatcaacaaggcccctgacctcaaggagcttacaatgtgatggtgttgggggcggggggcttagatttcagctgtggtttatgaagatatatgattctagattactttgctaaatatagagcacaaaaaaccgaatgatcaacactgctaacaatatcctttgtacttctcctcctgctctcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctgttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacatatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaacttaaagtaaaataaaaaataaaacaatttgaaaaaaaagatggttaatgtaaaataatataataaagattacgtacttcatcataggattcttataaagaagtgtagggaaaatacaaattttaagaagcaaagtttaatcatacttattaagcaagacttttcacaagaattgagtataaattcaatctccatatttcagttaacttcaaaccttgtttcaaattatcctttccaagtttcaataatatggcaaataggacaaccagtaaacttttattgcttaagaatatcaatctaggccgggcgcggtggctcacgcctgtaattccagcactttgggaggccgaggcaggtggatcacgaggtcaggagatcgagaccatcctggctaacagggtgaaaccccgtctctactaaaaatacaaaaaaattagccgggtgtggtggcgggcgcctgtagtcccagctacttggcaggctgaggcaggagaatggcgtgaacctgggaggcggagctcgcagtgagccaagatagagccactgtactccagcctgggtgacagagcgagactctgtctcaaaaaaaaaaaaaaaaaaaaaagaatatcaatccaagatttttattaagttaaaatgaaggaactaaaaataggtaaatgaaaatgttataacactttagtgctatttatgagtatgaacaaaggaatttaatcactttgaatcccaattacagatgaatcttttatttcatgggtgctgggtatgtggtctttttaagacaaaaattctacagcatggttttactaagtcagattgagtaggtcgcatctctgtgtgccacacagaacttttagacaagagtagaggggaaaaggttctgcaattcctcacagtaaagtactcacacagtaaatccttaacgaaaactactgaactgtgagtatatgctttataatcttatgcacagaaatgtatctattagtacagaaagttggaaaacatcaagattaaaaacagtgctgtaggaaaaattcacaacagtaaacaaattttgctcactcattttcctacaaatcttcagtttattaattcaagagaaactatattaggaatattcggctgatacccctatttcaccacctcatctaagctacactgtattataccaagaatggtggcaattttttccccatctatacaggcactgccatctagtggcaagttttcaccagcaattttaaaagatagtggcccaactctggtaacaaatagtggacactgatggtttgtcaaataagcaaatgcatttatttgatacacaaattccatgccaccagtcaaactatggtctggcttttttttttaaccaacagtaaagaaaactttttgggtttttttgtttcttttttgagatggagtctcacccttgccacccaggcagtagtagcacgatctcgactcactgcaacctctgcctcctgggttcaggcagttctcctgcttcagcctcccaagtagctgagattacaggcgcccaccatcacgcctggctaattttggtatttttagtagagacggggtttcaccatgttggccaggagttcaagaaaagttttttaaaaataataaacctctaaagtgttaccctaactgtaccttacagtgatatgtgacttctctagtcactccacattatccagtgatggcacctagataataatgcaccaaagaaaagtaaagaattgcagacttctagaagcaatgatgaaatataattctcagttgcagaaaatgatgatctgggtcattatgcaaatgcattcctgcctgtttttcttccaagttcttgcatggagcccaacacatccgatagcatggaagtggaagttaaactcccgatgaataatttttataaaattataaagaaaacaactaataacatgtatgaaattcacattaaatttagaagtggatagtaaagattaggactatatttcctttggggtgctgcttgtaggaaattactgaatgacaactgctatcacctgtgatttcatatccttttagctgatattgctaaagagcttcccaaactttttcaagtcatggcatacacaagaaatgatatctgtacatacacgggtaaaaaaatgcaagagattgctctcagctggatccccaagggctaaagagataaatatcttgctcacaatcaatgggaacctgtgaactaaagagtcaaatgtatgaaagtcctcatggaaaaatgctgacaagcactaaaatcactgtaaattccttggagagttctcagaattgcagaagttcagaaaaattactttggtcttttacatgtcaatattcaggaaagaggttctttctcttacttaacattcctccagggtgtgagaccctggtcaaggaaaacaatgattcctgtgtcttagtaagtcaaaccaacatggcagggtcaagttgacctccctggccactcagggccaaagccatacagtggaacagtgtgttctttaacctcgtaggacaactctcatatgcctgggcactatttttaggttactaccttggctgcccttctttaagaaaaaaaaaagaaaaaaaaagaacttttccacaagtttctcttcctctagttggaaaattagagaaatcatgtttttaattttgtgttatttcagatcacaaattcaaacacttgtaaacattaagcttctgttcaatcccctgggaagaggattcattctgatatttacggttcaaaagaagttgtaatattgtgcttggaacacagagaaccagttattaacttcctactactattatataataaataataacagctcggcccaggttactgtgacctctgacagatcaaggaaacaagttattttctcctcttgtgattacagcacattgcaagacatttttttccttttaataaacgtcctagtactctgagtttccctttcaattcatttaatttcaacaatctgtcaaaaaacagccaataaacaaatactgaattacattctgctgggttttttaaaggctctagactataaaaacatcttgtgtctcccaccctgaccaccctgctacttttccatataccacaggccacccatagacacaaagccagggggtgaagctgacatggtctatttggagccagtagacaggagggcgatgagtcctgatgaagcacttatggacaatatgtagttcctgtaagaaatttaatgttatggaaaaatgagtaactccaaattggtttttcgagaaaataaagagcccatctctttggaatgtactgcttccttcctgacacttggtgtaatcataatgatgtgcagccccattgtctgcaaacacaatttgcaagacagaagaccaaaaaaaaatggaaaacattcacaggaaatgtgttccaatttaaaaaaaacactttagacagaaacctagaacacatgatcacaaagaataatctgaattccatttaaccttcacgaagagctgatcaaagaacatggagagaaaagagatttgttttccttttcttcccctaagagcaatggaaaaataagtcttccctgcaaatcagtgttttgctgcagttggcttgcaacagcaaggaggttctaaaagttcgaagctactcctagcctcagaactctacaattttcagcaaatcactccagcattcccagaaggtacacgttggagggtatctgatattttattacatcataatcaccaattgttaaaatcttggctgcacattcctggataacatctttaataaattaataagagaagactgattcttgcccaaaagctcaacttaacagcagcttgaaacactattaagatacactggaatgaacctatttaactgcattggccatccacccaacccccagagcccaaaaataacaggtacaggggcttattatttcagaagctatcaaaaatgacaggtttgctttggctctttggagcttttttttaaggaggcaaggacacagattcccatagactactttgtaatactttatcatacagtcataattcataaacttaaaagaatcttaaaccaatagctgttattttaaatgtccagaaagttatctaaagtcagcactatttaatggactgactcccagagcagtttttctttccactaaaatatccagacaagtcaaaaccaaaatgaactactgtttcttgacttctaaaaaagataatcaaccttgaaaaggatacactgtggggttgaagttcttcaatatgaagaaggaagcaacaatgaccacgaccaggaacagagtgttgttatagaagatggaaaatgttgtagcttcataatcagcaacttcattcttcttccacaagattctagagacacagaaacaagtcaaacaagcttataaatatgatttaaaaaaacttttaagtaccatatggctctagttcatcataaaacaagtttttccttgagtgttctagggtaagaatgtgtttgtaatattagatttagtcagaattgtcccctttcttccactgaaaaaaaatatgtcactctatgatagtgaagaaaacatcatgctggttatgttaccatttttcccaggcaaccagggttatggaagaaaggactcattaatggcaacccgcacggtttcatcagcagctaagtcaaatatctttctcttggcccttacctaaaactcaaactccatgattagcagcctgtggagtttccttggctataccttgggcttgaggctttctacagcctacggatttcagacttcaatatcacaccttcagaagacaatcccaatgacaaaaattacctgtggtctcacagaagtaggctattgttagccatctttattaattcaaacaaaaaaagagcgcttaatcattaggaggactttttaatgcctgtaaaatccttctactttttattctattttacttgttctgatagtttatcttattaatttactggtatttcatccatcttttcttttaccccttcacacatgcaaaaggaagttataggatgcctgtgaataagggagccttcattcttgttggttaattaactttgtaaagcagtttttaaaagggtaggttgtgacccattagtgggatgtgaactcaatcaagtggatcgaatgcccatagaaattaattgagttgagaccagcattttaa

SEQ ID NO: 15178 - DNA, 5432 bp, Human
tcttcccatatagttatatcttttttgtcggtacaattattgaacacctttttcattttaattaatatgcatgagcttctagtgttgtcctatcaattgtatataaaatatcttgcctcccactttgtaagatgaagatgttagtgccacaattctttcttctacctccttcccatctccaaaattctcctatatttttctttgccagggttgataatatttatttggtaaccaaaataaagacctctgttctttacctataacttgattctataagttgaaaacaaggaaacattttcattatgtgaatattatttatataaagctaaattgtataccgtgataacatctttctttttttttttttttttttgagacggagtctcattgtgtcgcccaggctggagagcagtggtgcaatcttggctcactacaacctccacctcccgggttcaagcgattctcctgcttcagcctcccgaatagctgggattacaggcacccaccaccacggccagataattttttgtatttttagtagagatggggttttgccatgttggctaggctggtcttgatctcctgacctcaggtgatcggcccctcagcccccccaaagtgctgggattacaggtatgagccaccgcacccggccaacatctttctatatagccccaatgtctcccttttgtaccacaaaggaaaattgattttctctccttttttaatacctaattctcaaagtcagggcacattttactttgtttcatttttggattatgccttccttgaacattttttccttagaattcctgattggatttctcttttctttccttgctgtataaagaaacatgtcttcttcaccatactcctatcacttcccagcttcttacacattctgtctattgcttggaatctattccattttttcttcttgaacctactgacttcctaatagggaattcattgcggcatatatgaaccacgactttcccgtgcagtcttcttgttgctgtccttctctgtgtaggagtattcctttgtatactcagacactgcttcagtgcttccttgggttggatccacattttcctggattccacttactcttctgagagtctttccacttactccatctatacaactccacccacccactagtgttctagtaaataaaatcccattcttcattgacttccctcactaacccaggagagcttggaaagaaccagcatgcaacactgtcacttaatattctatactgacttacttttcttccggcatgtgctctgtatttaaaaacaagttgtcttagttgggtatggtggctcatgcctgtaatcccagcactttgggagactgaggcgggcggatcgcttgaggccgggagttcatggccagcaacatggcgaaaccccatttctacaaaaaatacaaaaattatccgggcatggtggcgcacacctgtaatcccagcttctcgggaggctaaagcaggagaatcacttgaaccagggaggcagaggttgcagtgagccaagactgcgccactgcactccagcctggatgacagagtgaaactctgtctcaaaaagaaaaaaaaatacatgtctcatcctctatgaacccttcttaggtatattggtttcaaggacaccaggtagacttctaccaccaacttttttgtacgtgctctaaactattttatgtttgtgtaacatttggtgattcttattagaaagaatagagatgtatatgctgtcagaatagccaaaattaagccactttccctgggtacaatgccagacaaggctgtcagagagtagggacacaggacttatattaccagagagaaattaataaaaaataaatttttttaaagggttctcttttcccttccccaaattacattgtacagctagaatcttggaaatgcttttgctctcttgtctaaggtccttcctaacgcattttccgccacaggccctcagatcctgatgattgcagtcttcaccctcactggagctgtggtgctgctcctgctcgtcgctctcctgatgctcaggtacagccgcctctatcatgcctgtgttcggtatccagagaggcaggaagggaaagtgggagaggtctgttgtctgttgatgatgatgaatattcacaaagaagcctgcagactgacctaagataatgaagacattctgcatcaaagactaactgaagggcagaatattattgagtgaatagattagggctttgaagccaaagatgcctgaactcaaatcccagttctttgagttactagttctgtggtcttaagcgtgttacttagcaacttaaacaggtaacttagcttcagtttcttcatctgagctgttgtaaggattagaaatggaacatgtatacaaactaccatataataagcatatatagataaaatagttatttttattatgctgttatattgtgggagacatcaaactcattaaattacatatttagactgggagaggttttagaaacaatttattccaaatctcctattttagcctgaggaaagagaacccagaaagtcaaatggcttctctagagtcttatcaccaggtagtgggtggggccagaactagaactcaagccttctcaccatcagttccatgatttttctgctcaacttgggtctgccaaatgcctagccagagacattgtgtgtactaagaaatatttattgaatacataaatgagtgagtaaataccacactacatcctaatctgcatatgttaaatgccaaacttataatactgtattatattaccaggttcacttgcacttcctagctaaacaagacaacagttttatctgtgtattacacactttggtctgtgtgtcattatactttctcatgtgaatgtccagcctgccatatactggttgatgttttctccagaaaaggaagtagactattttcttcaatctgacaacaccgcttggctcctgtaactgtgttgctcagaaatacaggtgatggtctacaatgtgtggtgaccatttagtgaagagtgagaagaaaccaaaattttcccccaaaagcaaatctaaatgggaatcactttaagatagggtaaatcacaagatcaaagataataacaggtgtttctcattgtctctaaacatggcaggcagagatggggcttcctaatgaccagtgcaatgctatgcccatgagggggcctggcagacaggtggtacacatgcagtttgccattacaacagcctatgcaagaaaactagcaaaccatttaagaaatcccctaattcagtatgaatgacagttggctctgctgggtcccaagagtctcctggggtacagagctgagaacccaagagcctttaaggtcttgatattcatcctacttgcctccaggtcttagggtcagtaatatgctattttacatgcatttacttgaagaatactcagacttagatggaagcatacaaagagaataatcatttctgcttaggggacattaaggaaggcatggccttgagaaggtgagaatgagtttgtcaaataaccaaaaagcaaaggcaaacagggacaaaacaggtcaatagaaaagaatatcagttccagaatcagatacaagcaagaacttataatatgacaaagatgacagtatgtgacagctaagaaataatgttggtggccgaacacggtggctcacacctgtaatcccagcactttggaaggccgaggtggctgaatcatgaggtcaggagttcaagaccagcctggccaacatggtgaaactccatctctactaaaaatacaaaaaattagctgggcatggtggcaggtgcctgtaatcccagctactcaggaggctgaggcaggaagatcttgaacccgggaggcggaggttgcagtgagcagagatcgcaccactgcactccagcctgggcaacagagcaagactccgtctcaaaaaaaaaaaaagaaagaaatgatgttggtaaggtaggctttccacatgtaaaaaacaaaattaaaacaggtaacttagcttcaatttcttcatctgagctgttgtagggattagaaatggaacatgcacacaaactaccatatactaagcattatataaatgaaaatagttatttttattattatattgtattatgttgtattttattattattatatatctaaaataatacacaaagacatagtttactctgtggagttttaaatgttaatgcatagtttatgtggagttttaaatgttttaaatgtttgattatgtgaaaatcaagcttcaaaacttagaataaattaataaaaatgactttttaaaattatttttatttttttgagaccgagtctcactctgtcactcaggctggagtgcagtggcgccatcttggctcactgcaacctccacctcctgggttcaagcaattctcgtgccttggcctcactagtaggtacaattacaggcgtgtaccaccacacctggctaacttttgtatttttagtagagatagggtttcgccacgttggccagcctggtctcaactcctgacctctagtgatccacccaccttggcctcccaatgtactgggattataggtgtgagccactgtgcctgtccaataaaaatgactttatgatctcagtttaggaaagtagttctcagtcaagataaaaaaggaaaagtcaaagaaaaaatacataaatatgacgataataaaatcaaaactttctgtaaaacaaagttaaaggaagtcataaactaggaaaaggtatttgaaaactaaagggacaaaggatttatttctcaaaatatattaagaacttatgtaagttaacaaggataagaaaaatatacacactaggaaaaaatgagcaaaattataaatacataattctatataattctgagtctatatactctattaaatagctagaaaatatttgaaaggataatatcacttgtaatcaagaaaatgcaaagtaatgcaataatgaaacactgtttcaccttcatcataaaggttaaaaaaaagtttatcaataccaaatgttgacaagaatatagaaaatgggaattctcaagataagaaggtaaattaattgataactactgctttgggaagcaatttggtgatatctgcaaagtcgaaagtgtacatcgtctatagcccaagaattctgcttcatctataccagcagtccccgaccttttgacaccagggactggtttcatggaaaacaatttttgggggtggggagagttttgagatgaaactgttccacctcagatcatcaggcattagttagattctcataaggataaggagtgcacaacctggatccctcacatgtgcagttctcaatagggttcgcggtcctgtgagaatctaacgcca

SEQ ID NO: 15179 - DNA, 7031 bp, Human
ttttttttgagatggagtcttgttctgtcgccaggctggagtgcagtggcgcaatctcagctcgctgcaacctctgcctctcaggttcaagtgattcttctgcctcagcctcccaagtagctggggttacaggtgtgcaccaccacacccagctaatttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtattttcagtagagacggggtttcaccgttttagccgggatggtctcgatctcctgacctcgtgatccacccgcctcggcctcccaaagtgctgggattacaggcatgagccaccgtgcccggactttttttttttttttaaataaagttggccaagataaagcgtatgtatcggtaaaagccttatatccagaatatatgaagaactgtcaacttgataaggaaacaacccaataaaagcatatgaataatgttcaacattagtcattagagaaatgcaaattaaaaccacagtgaaataccactacatatgtattggaatggcagaaattaaagactgatcatgccaagtgtttggcagtgtagaaaaaccaaaccttcatacactgctcttagaatgtaaactggtacagtcactttggaaaacagtttgggatacacctaccacattatccaaccgttccacccctaactagagaaaagaaagcctgtctacatagacttgtacacaaatcttcagaacagcttcacttgtagcagctccaaattggaaacaattcagatgtctatcaacaggcaaatggattaacaatggaatagtattccaggatgaagacagaattattgatacgtacgacacagatgaatctcagaagtccagacctggccggcgtggtggctcatgcctgtaatcccgacactttgggaggccaaggcaggcggatcacgaggtcaggagttcaagaccagtttggccaacatggtgaaaccccatctctactaaaaattcaaaaattagctgggcatcgcagcgcacgcctgtaatcccagctacttgggaggctgaggcagaattgtttgaaccgagacctgggaggcggaggttgcagtgagctgagattgtgtccagcctgggctagagcgagactcctctcaaaaaaacaaaaggccagaccccacctcaatgtccacacacagaaaatcctaaaaaatacaaaccaataaagcaactgaaagatcaccgattgcctggacatgaaaatattttaatgggggcagtgatacttacagggggatgtttggggtctagattgtaatggcttcgctcaaaagtcaccaaatttaagtgtgtatcgtttatgtcagttgtgcctcaaagccattttaaaatgactgtcacatatggggtatgtcgctttaaattagcctagggccttctaaagctccagaattcctgggctttgcttttagacatttctagctcttaatgaggagaggtaagctaacagctaggacatgtttcacaatagcctgaagacttaaaaaaaaaaaaaaaagccttaatttttttttcaggtgccacacctccctggatgatccaagatgaagaatacattgctgggaaccaagaaataggaccatcctatgaagaatttcttaaagaaagtaagtaaactaattcaagagaggatcgtctaaatcttcacactcaaaaatggtttccttgcctgtgtgtggtggctcatggctataatcctagcattttgggaggctgaggtgggagggtcacttgagcccagaagtttgaaaacagcctggacaacatagtgagaccccatctctatattcttcaataaagaaaaataaaagtttccctatcattgtacagaggaaaaacagaagttgaaaaaactccccccagaccgagttggggccaactttgatcacagctccaggaccagtgcaggctggctgccctcttttggccgcgtctggaataatggacgccgctggcagtccaggtatgtgtgttcagtgccgggtctccaacctacccatccaacctcctttttggagatgtcacccttcatcatcgtgttaaccctttatttcctttcagacatcaattcaaaactgaagctgcagcaatgaagaagcagtcacatacagaaaaaagctaatcatgctctctaccaactaccatgaggctaaaagcaaagtcaacaaacccctattataccttccaccaaattctttatcattgtctttcttaggaaacagacatactcattcatttgatttaataaagttttatttttccaaatgtacagctggttggacctgtaaaaaaaaattaaaagaatcagaaccataaagctttgtatctacctcctacaccatgagcccacacattcctactcacctattcatgcatcttcaccagcagctggagcatctccacccttggtatttctggtgtaaattacttgagctctgtgctttgaaaccagtttgataagtcctagggggagagaatagcacgatgagatgcttaacagatgctacaatagaaactagtaaggtttttggctgggcgcggtggctcatgcttataatcccactgctttgggaggtggagacgggcagatagcttgaggtaaggagttgcacaccagcctggccaacaaggtgaaaccccatctctaccaaaaatacaaaaattagctgggcatggtggcacatgcttgtaattccagctacttgggaagctgaggtgaggaccacctgaacccaggaattggtggttgcattgagccaagactgcccctccgcactccaacctgggcaacagaatgagactctagtaaggtttgttttggccgggtgcagaggctcatgcctgtaatcccagcactttggacaggtggatctcttgagcccaggagaccagcctgggcaacatggcaaaaccgcatctctatttaaagaaaaggaaaacaaaaagacagagttctctcagaggtgcccagaatggtcttaaaactccttggctcaaatgatcctcctgctttggcctcccaagtagctagaaatacaagggtaccactgcacctggctccagaattgcttaatctgacgttcggtaaccgagaatcctagtttttaacgatcatctatccttacttttcctttaaattagggctccattatcttccaccccccccccctttctgagacagtcttttgctgtcactaaggctggagtgcagtggtgtcatctcggctcactgccacctccatctcctgggttcaagggatcctcatgcctcagcatcctgagtagctgggattacagacgtgtgcccccacgtccagctaactttcagtagagcaggttttcaccatattggccaggctggtctttaactcctgacctccgttgattcacccgccttggcctcccaaagtgctagaattatagacgttcagtcactatagttagctgagccttattattgtggaattatggtaatcagaccatactactgagtagaccgtactaaatttctggttttaaaatttaatacatcaacaaaatatttaccataaaggttttaaacattttcaaagttgtttcaaaatagtaatctaattatttcaaaaacggttgtccctgtaattctatgcatccatttactcgaaacataaaagatccttgggcttcactaaactgccacagggtccacggcacaaaagtggctaagaaccctgagaattcatctcaggatcaggagtaagacgtcagaattacattactaacagccaatggtcaagccacgctttttttttttaattctgcttttccagcaaaaccactgaagatgcttaacatggtcaagacaatttaacctacaaaaacacacatgtaggatacacccctcacctttactaaggagctcctgaagggctgccctggccagggagcctcgaatcttcagtctctcagagaccacagctggggttataagtttatagttgggaacttccttacagagtttatcataggtagctttgtcaaacaagactaagttattgagcttgtcccgaactttgcctttggaccacttctgctcaccaaaacaaaacagaaacaagttagtatttctggcagaagcaccctttccctctcgagtaatctgcgtcagagaaatctgttccaccgttatcaaggataaattacacattactaaaacaaaaacaaaaaaaaaacaccgacacgtttttggccttcaaacaggggccgagccccactagatcagttaaaaataacacagcaggcacagcggcagacacttcgcacaacagacccattttcatgatcctaatgggaaaaagaacgagtggtgacgggaagataaactctcacattttgactctagaaatctacacctgaaaaaccacttactatacaagttacctattactagaggattacgagagagttacccctagtctctttcagagaggtcttatttctaccttctttttggccttgcccccggatttgttcactgggtctttgtctttcttggccgactttccagcgtccttcttcttcttgtcgtccttaggcggctgtaggagggcagcgggaatgcaaccaggtcctcaaatagcgccaaagtcccctaatactgcgccctcagcccccgcaaactccaccaccagagcacatgggccaagcaataaccgcgcccgccctgcaaccgaggccggcaggccaaggagcgctcccgccgaaggctctccccactgagtcctcaaacccaagaacgccggcgacttcacacccctgaagcttaccattgcgaagctcggagaatagcagcagacaccgcagcctcgtcaagatgtcggacaaaaaggaagcgctgctcagaaacgggcccaaaaaccaccgtccgctgtgagtacttccggggcaagaggcggagccaggcagaagaagtcccacggcgaagcgctcgccctctagcctgaggcggaagacaggaagtggattctagttcccaagccgcaccgcctaaatactgccggagtctgcgctagttgtgacgcagtactatagcgctgttttcctgcactgataaacgaaaagcaatccaccaggtctcggcagctaactttccggcactacttatgcccgagcgtgtcgctcccagtgcgcaagtgcagcaggtggctgcacggggggcgcgggaggaggaggaggaggaggaggaggctggggtggggccggcggcaagtgctgtgatgcggttccggggaggggccgtcgggtagaggctgaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgaggtgggctaggctcgggcccgtggcgggtgcgggggtgggagggccccagtgctgtagaagtgggctggttgtaggtgcggggttgggggaaaaggggttgtgtcgggtcccttgtcccctcggcggaatccccgggctgcaccttcgctgaccgttagcttcacctctgcagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgtaagtcccccgtctcctgaacggcagcgcttgtaatttgtctaccttttcttaaatcgtcgttctggtgttatgaaaaacgcaaccgatccagatctagattttaggtaataacggcagtggtgtcatctttttttgctgggtggggaggggccgcggagttacccaggctggagcgcagtggcgggatctcggctcactgcagcctctgcctcccaggttcaagcgattctcctgcctcagcctcccgagtagctgggattacaggcgcgtgccaccacgaccagctaatttttgtatttttagtagagaggggttttgccatgttggccaggctggtctcaaactcctgacctcaggtgatccacctgcctcggcttcccaaagtgctgggattacaggagtgagccaccgcgcccggccgaggtgtcatcttacttaaagtcaacttctcttctctgagccttagtttcttcatatttaaagaaagccagtttaactaaatgacctttaaactttttctgctctcaattgtgatatcagatgtgccggcctttgcttaaacacaagcttagtaagcgtggcacatattcctagagtattcattttacccaaagttttagatgtaaaatgtcttgtaacaaagtatgaatgtaaaatattcacagaattcaaatgaacttagaaattttgacactactgccagtcagttcacactacttctcctgactgtcccaggctgtaatgtgaactcctcagcaaatagggacacttcagtggaagtttgagaagcactccttccttagagcaactttgcctcctttgcatataggctctttgccatcggctcccagctgtctcctgaacagggaagctcaggcattgagatgctggagacagacacattcaaattgcactgctaccagacactgacaggtatgcatctccacggaggccagaggagtgtgatggagaaggtggggaagagatactgataagtttgcatctccaggtgggcc

SEQ ID NO: 15180 - DNA, 12167 bp, Human
caaaatacagagatcatgaaattcttttttgctatgtccgacaaaatgaacaagaaactgaataccagttttctagatgcactaataaataacttcagttaaaataactagagttacattttttcaaatgctcttattcatctggaaaattcagtgttatatataaatgttacatatacatatgtgtatatatatatactgttttaggagaaaacagcatttcagcttgatattttaaatgccaattatgcacatttataatagtaagatttcccattaagtgaaacgttatagttacctataaacgttcatttttcactatttacaatttgaattatgtaatgcttgcatactgcaactaattgttatagaagagtcacatagacaatataaatctgatgtccaatcctttacaaatacgaaatttgtttcactgggttttcaaactatcaagtataaataggaaaaggtcagcaatacttaggatgaggcactttaacaattactcagaaaggttaagtgtacaaaactgtaaaccaaaaccctgcatattaatcttatccttaatttcagatgtgattaatctgagatggtctatttaaggagtgttaagatcatcacagaccagttaatgtgcccatatacaaatgaactaaactatctaatgacacttgggtttcagaaagggactctttcaacactaaaacttctgtagaattttttcataaacaagtataaacacactgctctcacaaaggcaaatggtatctctaccatattcctagacaagaatgccctcaaatgtttaactgaatcacaattttacagtcttatgtactctttaaaaatagttttcaaaatactcagaaattttaaaattaaaactaccaatactttttagattacaattttaagataaaaaaggtaacgaatagatattttaccagccttttgtgaaagaccttttaaacatttctatttgagcacctcattttcaaccttaaatcatgttctctgtatatttacactgcacgttttggtagttcaggtaataaatacttgattaagggtaataattcccttttttttttggagacggagttttgctcttgtcgctcaggctggggcgcaatggcgcaatctcagctcactgcaacctctgcctcccgggttcagccgattcttctgtctcagcctcccaagtagctgggattacagacacccgccaccatgcctggctaatttttgtatttttagtagagacgaggtttcaccatgttggccaagctggactcgaactcctgacctctggtgattcgcccgccttggcctcccaaagtactgggattacagacattagccaccacacctggccaattcctgttttctgaattcactatgctgtattttttccccaactgtctgatttccacattcttctattagttaaaaaaaaaaaaaaaaaaaaaaggctgactcaaattttaaagtttaccagaagagattaaaatcttgatatataccaagaaagaatctgtggacccattagctaagttttaggtaagagtagctaaatctcattaaacctgtttatttcttctaatttataatttgagtaatttccatagctcagatatacaaatgtcctttaataaaaatgcagtaataatttaacatggttagctgttccaggttcacttatcaaaataacttgccatgaatgtgtacacatgtacttcttaattccctagaacagtttctccttttctaaagaaactggctttcaatcaatatactaccagacacttaagtctctactaaaatcagaagttaaccagttttcaaatacatggaaagagaaaatactgatttagaatgacaaaaattaagcttggcaaaagtggtgacttttatttacaattgcatgtgtcaagattacaatggaaacactagtgataccatctgaacaaaagcaatgatttattggtaatggcaatgaatgaaacattgacagtctctggcgagaatcaagcaattatccaggagctgtagatctgattgcaatatggttgtccagtgtcttttgtaccttagtggctttctccttttttgccaactacctagaaaaacaaaaataagtttatatgtacatcctattgattttaaatatgagttattaaaaatactaataatcagtttaaaaccttggtattaatttttatccttggatcttttctggcatgcaatgtattttcactgttgaagcaaactgtgacctcccctccaatcccagccacaaggaattaaaaataaaacacatgcaggctatttttggtttcacacagttttttttttttttttaaatagcaatttttaaaaacaaggttgaaagtttagagaagttaatttaaaaaatgatgctatatgagtaaaacatatttgacatactatttttagatagttagaaatcaaatgtcgatcacaaaagaatctggaattagaagcgtatgttaaactcatgtccttcatgcccaatatagcaaatttccagactttccccctcaatacactgacatgcaatgaaaacagattaaaagtgactaattttttctggtttaagaaaaagatcctggttactttaagagtactattaaaaatgaaatgaataaaccttgtttctgtcaatgattagaaaaatcctctactggaggattataaaaaacattctggttgctatatatgtggcagcataaaaatgtgaagaataaaaatttgttctctaccaacaaatctagaaaacaaattctctgcaggagagtttgaaaactatgttctaattgagaaatgtactgacaacttacagtttatcattagataatgtattcttagggcaaaaatgccttgaaagaaacctacttgcaaaatactgaatgtatgtttgtgtagaaagatttctgtgtacatttatatatttaattttcgtattttacattgattctattctaaatggcagtatctataccagcaaaactcataaaggtcatcagtacatgtctggtctaaaatataacatagctgggtcaacatcattcatgagagacctgaaagctttccactgaaatcccaatcacacaatcctagaaatgtttttcccaccctaagaaaactcacttctagtaccttaaaagaactcccctttggtccaaagacaccatgttagaaagctcacaaggtagcaagatgataaaaaggcagtttcatataaaagaatgtggataagagtaagaaattcaggttttaagagccactagaaggggaactggcattatctctatcacaagtaaattttgtgctgataaacactgagagcattattgatcattgtattacttgggaaacacaaaacacaaagctattagattaagcaaaagaaaacaaaaacaaatattaaaaattaaacttctagcagatgtgatacagaagacacaaatctgcatactgtttcacaggttgataactctcaacttgccaatgtgtattttctgtaaaaaagaagaaattcaacattccaacatggattgtcatcccaaacgtaaagctcttttattcattcttaagtctttatattacacctcagacaaaccaaaatttaggtacataaaaattaggtgtaaaaaatatttattcagtaaagagtccattgatcttctatattaatatgttaacccaacctaatattcagtccataagtccttcaactggttttgagctcacttgggcaaaagcagaggacatgccccaatcaatcatcaaaaggactttggggctaacattccaacgaggaaaagaaaaccaacacccctcaactgaaatgtaatcaatatattaaactagcacaaacataaaagaacttgatgcaactgctatatttgttttccaaaagaattctatagttcctaggaaataaaatttaaagtttagaatggattaaaactattcaactagttaaatctaaaacattttataacaatttaattttattgtgatgttatgcctcaaaatgtaatacaaaattaaatatgaaacagtagaaagtaaaaaaaaaaaaaggctagtgagcaacacggtatggtaaaaaattaaagcacctagttgcaagcccaaaacaaaagccaaaacaaaataaaaggccaattaagaaacacaactaggatgagatctgaagaaagagatgattgaggaaacctaggtaacaaggctgatccagatgatagaagctgtagaaatcttgcaccaacaatggcgagaacatgggaagggtgagagcagacaggtgctagatgagcagagaagcaaggaggggagtagagtgagacaaggtcaatctttatattacttcattttaaaatatcttctgtttttagttcatttgagttggattaaaaaagctgaaaaataaacagacagaaatgttacaaaaatagctgatacggtgaatggccagtttagaaaagtctatttttattatagtgataaaaatcttttcacatgcacctcatttcctaagaagcagaagcccctataattttctcatttttgtatttttataaaattgtaattaaaaattctgtattaaaataaagcaatccatataaagagcatattttagcaaaaacatctacttccaattaagatggcaatggcaagcttttcatgctgcaacacaaaaaatccattgacaacaacaaacagccaaagtatagattataatctgtgcgtgatgcctataagagccaaaaccagacaagtggaaggggtattctagtctgtcaaaccttaaaagtctaaccttcaaagttgtaatagcatgaaaggttgtctaagatttctgtccacattggagattcaacagcattaccttagcttctgtcagatatcttagtgacataagaagtcagtgacatactaaaaacggaaattatccagaaacagctcacacaagataaaaatataaactgaaaatgctaaacatttgatctactttattattcattaagccattttatatagcgcccttcactacacagaggtcatcaaaattttcctccctgtgcctataaaatatatgccaaatctatttcaaaattttcaattctaggccaggcatggtggctcacgcctgtaatcccagcactttgggaggcccaggcgggctgatcaacgaggtcaggagatcgagaccatcctggctaacacggtgaaaccccgtctctactaaatatacaaaaaaattagccaggcgtagcggcgggcacctgtagtcccagctgctacagaggctgaggcaggagaatgtggtaaactcgggaggcagagcttgcagtgagccgagatcacaccactgcactccagcctggacaacagagcaagactccgtctcaaaaaaaaagaaaaaaatttcaattctaattactatgtatatactaattcagactgagcaaacaagtaaaagaaaagacatgccacatgtgacttgtccttgaacgattgaatcctccaccttcctaagttcatgtccaggtccctacttttccattctatcaagggtgcccatagctgcctgttgaactgtccaaattctactctcaaaacttagttcaaggccctctttcttcacaaagtattctcagactttcccagtcgttgggggaaaaggaaaagtcacctagctggtaacgtctgagaatactctgtggacaaagaaacccttgaactaagctttgattaattttgattaactttccctatgtttgtccctatgttatctacaagaatataaactgctgtagacagagatcatgactgaagagtagtccctccttatccatgctttcactttctgcagtttcaactgcctatggtgcagtacaataagatattttgagacagtgagagaaagagcaagcatgggagagaccatatccatgttaacttttaaccacagtatattgttgtaattgctctattttattattagttggtgttaatcttttttatttttctttctttttgatatggggtcttgctctgtcacccaggctggagtgtagtggcgtgatcctagctcgctgcagccttgaactccagggttcaagcgatcttcccacctcagcctcccaggtagctagaactacaggtgtgcccaccaccttgcctgggtaattttgtgtgtgtgtgtgtgtgtgtgtgtgtgtgtgtgtattcttatagagatggaatcttactatgtttatcaggctggtcttgaactcctgggctcaagtgatcttcccacctcagcctcccaagtagctgggactacaggtgcacccaccgtcttgcatgggtaatttttttttttttttaaatagagatggagtcttactatgtttgccagctggtcctgaactcctgggtttaagtgatcttctagccttggcctccggaagtgatgggattataggcatgagccaccatgctctggctttgttgttaaatctcttactgtgcctaatttatacattaaacattatcagcggtatgtatatatgtacagatgctcctcgacttccgatggggtaatatatcccgattaaacccattgtaaagaccaggcacggtggctcatgcctctaatcccagtactttggaagaccaaggaaggcagtgaggtcaggagtttgagaccagcctggccaacatggtgaaaccccatctctactaaaaatacaaaaattagccgggtatggtggcaggcgcctgtaatcctagctacttggaaggctgaggcaggagaatcacttgaacccgggaggcagaggttgcagtgagctgagatcgcaccattgcactacagcctgggtgacaagagtgaaactccatctcaaaaaaataaaaataagtaaacccattgtaaggtgaaaatattgtaagtcaaaaatgcttaactgccccacacttaagagaatggtttctactgagtgcattatcaattttgcactattgtaaacttgaaccatcataagttgggaaccatctgtataggaaaatacacagtatgtacagggtttgttagtgtctgtggttccaggcatccaccgggggtctaagaatgtatccccccgccccgacagataaggagagactattgtactagcatcgtactacagggacaaaagataccataccacatattatttccttcaatgaaaaccaaactcaattataatttttaataagcaaatctatctgtacaaggactaagctggccaatttcagttacatgtaaaccctctttttctttttttaactacattgaagttgttactttgtacaatataaaaacaatgaaatactagcttacttttaaagaataaccctaaaagacaaagaataactacagtacaaatgtcattcagaaatattacaagaaaatgcaatattaatatacctaagaaaatcacttaatcaactaaaatttattaaacattaaaagcaaggggctaagaagcccagaacaccaacaagggagtagattatggtattcaaattattcttgtagcagttctcaaagtgtggtctccaagaccctctcaaggagtctgggaggtcaacactattttcataatgctaaatcgttttttgccttttagactcttattctcttcacaagtatccaggggagttttccaggggctatatgatgtgtgacaggaaagctgactgaatgcagaagcagatatgagaaggaaaggacactataaggctcgtaaacagagaagcctgggcaacatagtaagaccctgtccccacacaaaaataaaacattagccgagtgtggtggcacacgcctgtagtctcagctactcgtgaggctgaggctggaggatcacttgagcccaggagtttgaggttgcagtaagccataactgtgcctctgcactgcagcatgggtgacagaacaaaaccctgtctcaaaaaaaaaaaaaaaaaaatcataaaattctgaatcaatgctcttcttaccaaattggtttttcttttagaaaatatgcttatttctaatttaaaaatattcattaacatgtgttcattatttacaaatattttttatatttcccacttttaacttataaatggcaaatatcagataaatatagcccacataaacaaaagttctttttggccttcaatagtatttaataatataaagaggtcctgagatcaaaaagcttgagaactgctaccatatggtaatttaaagttaaaaaaaatcaaatgaataaatggctgttataaaacaagcacaaatactctcaaacaaaaaaggtcttacacctttgctatcctaaagacagcccccaaaaacgtagtttgacagtcagaaaagagaaaatactaggctagaagggatgtgagggggatgttaaacacgaggtggaggcagatagttagatggataattattcatgcaaattagagaaactttaactgaatggctagctggtaagaaggtaaacaagatagaatggtggttacagaaaaaaatgaaaatcaaatagcataaactgaggtaagaaacaggaaactagagccaaattaatgaatgatatgagaaaataataagataatagtaatagatcttataaaaaactaagttaagaataaaccacacaaggcacacttaaagccaagtccaatggcatctaattcaaaaaggtaaagcaggcagccaagacgtctttgttgctcacacattttcccaataaaacatatttcatatcgtaaaaatgtagatgcttaatctctgcttcttctgacctgtcataatacatatgtgaaacatctagacataacagctctaaagtgcataattattcctgcagtccccaaaaggtaatcacgctatgagacaggaaaatagtaattggaaaacaaccagttaaaatacctattgtccaggtttgcaatttggtaaaaacagcatacaattttgtaagatcatcctctgttatgcaatctaatacatttttctataattgaattaaagtaagatctgtagatgccaccaaaaagaatgagagtgctcaagatgttctccatcttcaattccacaacaagggtctcttgggagcctcttcatctaggaattgccaggcctaaggaaactcttcctcaagttctagactgcctgccagatgcaatcattagagacagtgggatacctatgtattctgtgctgccacatttaaactgagtatatagcaactaacgctctgtactgataaagctctcagtagcactttgataatctctggctgtatatttaagagtgacgctagggaactgttgcccattagaagtcgttccagtaatgtacagaaggaattaatctggattaacaaaggtcccatgtaccctattaattctttacaaaccttataattgtgtcttttcaaaagaaaattatatgcacacacataaagatatacaaaaatacttcagaaaacttgcctgttcatcattatttgatgaaatgtgctatttcagcatacaaacatggtttggaaagttaacatgtcagtatattaaaactcagtccattttttttaaataaaattattcaagtaatttaaaatttcatcagaaataatcaccagaatcttactatcaactaagttatttaattctcacaactgctttcaaatgattttactttcatttttccattattactaaccactttctataaccaagccattatttttacccttatgttgatgtcattcattaaaagactcttttatcagttaagacatcattttttattaaagattactttgttggatatctaaaaatatagttaggggaactttctatcctagtttagccttgtaaaatttcatgacatgatataattttgaattattttgttaaaagaaagtgtgacagttgagatacatgaaattattccattaaaattatatttttactatcccgaagtatcatttaagcaaacttactcgtttgaagtcattcatatttgttgcctggactggagtaccaataaaagtaaaatatgaaattcttgttgtttcctcttcaccttgattcgactgaacaaatatctaccaaaaaaaagtttgcatttataattacaatccttcttcacaaacatgctttaagtttaatcaatttccttaaattaataacataaatattctccattctttgtaaaaattaatctaggctgggtgcagtggctcacgtctgtaatcccagcactttgggaggctgaggtgggcagatcacctgaggtcaggagttcgagaccagcctggccaccgtggcaaaaccccatctctactaaaaacacaaaaaaattaaccaggtgtggtgactggcacctgtaatcctagctactcgggaggctggggcaggagaatcgcttgaatccaggaggtggaggttgcagtgagctgagatcgtgccactgcactccagcccgggcaacaagagcaaaactctggctcaaaaaaaaaaaaaaaattaatcaaaattatataacattaagactagtactcctataggataggactactaattatagggctgtttgccctgctattctcactttctccagagatgtcatggcaagagacccatatatataagttcatggtaacttggtgtgatagtatggcagagtcacaattaaattctctctctatatgtattttttgacatggagtctcactctgttgcccaggctggagtgcaatggcacgatctcgactcactgcaacctccgcctcccaggttcaaacgattctccagcctcagcctcctgagtagcccaccagcacacccggctaatttttttttttttttttttaagagatggagtcttgctctgttgcccaggctggggtgcagtggtgccatctcagctcactgcaacctccacctctcaggttcaagcaagtctcctgcctcagcctcctgaggaggggggactacaggcacatgctgccacgcccggctaattttttttttttttttttttttttaaatttagtagagacagggtttcactgtgttgcccagggtggtctcgaacttctgagctcaggcaatcctcctgcctcagcctcccaaagtgctgggattacaggtgtgagccaccgcgcccagcaattaaattctttatagagaatgttgaaagggtattaagagttacaattacaatgggacagactatcattggaaattttattaaaatcatagtttttcactgaggaaaatctctaaagtgatattctttctgatattcctgtatccattctatttcctagaatattaaaagaaaaaatagtattgggaatcagctcctaaaacaatactatgtgcctcattttttttttaagcttgactctatatttaataactcccctcagcacgataaaaactaaaagttttactcattgatcctttgtcatacattggatttttgaaatttgctccatttctaaaaacacaatattctaggtgctgtctactttaaaatattgcacctatctcttttttgagacaaggtctcattatgttacctaggctggtcctgaactctttagtgcaagtgatgcccctgcctaagcctcccaagtagctgggactaccagcgtactcccatgaccagttaaaaactgcctctcgtgatttaaacaacatacttctttcattctgagatgccactcattcgtcagtttttattgttttcataggcagccatatgttatttcaagaaaatatttgataatgagtatactaagtttaatataacaattttctttgatttcatttgggtaggatatttctaatacttaaaactcaacttgattataatttttttttttttgtcacccagactggagtgtaatgacacaactgcagctcactgaagcctcaatctcccaggctcaagtggtccctccagagtagctgggactacaggcgcatcaccatgcccagctagttcttgtatttttttgtagagatggggtttcaccatgttgcccaggctggtctcaaaatcatgggctcgagcaatctgcccatcttggcctccc

SEQ ID NO: 15181 - DNA, 5042 bp, Human
aaagaggggagccctaggatctgctaggagccaaatcaaggaaaccgagtgagaactgaggggactgctcacctctgaatagagagagcaacagagtccacccccctgcataactcttaaattgccagggcaacatgtaaggctgaggactcaccatcacttttttttttttaataattgaccttcttttttagaatagttttacgttcacagcaaaactgagcagaaaggagagtctcacaggcatcctgtcctcccacagacacagcctccttcatatcaacctcccaagccagggtgatacatttgttacaattgagaatacatggacacatcattatcacccaatgtccgtagtttaggattcattcctgttgctgcacattctgtggttttaatatttaaaaatgtataatgacatatgtttaccaccatagaatcatccagaattgttttactgccttaaaagttctctgtgcctgatctatttatctctcactctccccaacctttggaaaccactgaactttgtactgtttccatacttttgccttttccagaatgtcatatagatggaattatgcaatgtatagacttttcaaattggcttctttcactttgtaatatgtatctaagtttcatccatgtctctttgtggcttgatagttcattcccttttagtgctgaataatattttattctgttaatttatccactctccttctgaaggacatattgcttgcttcccagtttgggcaattatgaataaagctactataaacatttgtgtgcaggttttttttgtggacataccgttttcaactcatctggctaaataacaaggagcgcacttgctagatcatatgatgaaagtatgcatagctttgtaagaaacttacaaactgtcttcaaaagtggctgtatcatttttcatgtccaccagcaatgacagtgtgctcctgttgctccacatcctcatcagtatttggggttatcagggtttttgattttgaccattcttataggtatgtagtggtatcacattattgttttaatttgcaagtctctaatgatatgtgatgttgaccatcatttcatgtacgtatttgccttccatatatattatttgttgaggtgcctgtttagatcttttgtccatttttaatagggttggtcagttcttattgttcagttttaagacatttttgtatgttttggttaacagtcccttatcagatatgtcttttgaaaataattttttcccaacctgggagttatcttattctctttgtggtatctttagcagagcagaagttttaatttagcgaagtccagattatcaattattttctttcatagatgcccatcacattttataccagaactagaaaagatgaaattcttggtctgaagttgcagttatcagtcagcagaagagacagtccacaaccctgcttggagtccagatgaggatcctgagtgcaaacttgggacctaaagagcccaggacagagagagcactaaatgcttctaggcaggggtggtgggttgaggggcccctagacttccctcatctgggtcccagaaaactaaagagtcaatttcacaacaccaatagagggaggctcaggccctgccaagagctgacatgataattctaaaggtaatcagagtggatcctctccaagccagaacacagaaagccccactgcgagccttgttgtcacccagtcagccccaggcagggttggcaagctgcagcctaaggcacattgtaacttcctcagctggcttctcaggggacagaatgactaagaacaatagcccagtgaatacttagagcagtgttctcaaggaatcctgcagaggcggcttctgaaaagccaaggtagtatctgcctgctgaaggtgttctcaggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtgcaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactcctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagagacagtgttgcaactgggcctggcatgtttcagtgtggtgtccagcagtgtctcccactccttgtgaagtctgaggtatattctttacttttgattaagaaaacacttaaccttctaattaatggagagccaaaggggagttggtgggaacaccatgtataacatatttgtatgtaaaatgatttatcttttctttttcctgtttttcagtgttctttttttaaattgtagatttatttagtttcagaatctaagtttatgaatggcatgaatcactcatttattaaaatatatcaggttggagagtgagaatttttgcattatgtaaaacaatttaaaaatcttttaagtctttttctgtgatctagaacaagataatatggcattggaatatggaatttgtgaaaaggaaattaccttgcaataaagttggtgggaccaggaagtagagaaaaaaaaagtaaaatgtggtcaattcttgctttgttttattctttttagtctttctttgtaaaactgaagtatatgtacccggatctgcttagctttttcaggaatgtgggggaaattaaatagcaatacatttgacttcctggtcacttacacttcaattgtccaaatattaattgagcagctgtactttggagggctcctggctagtaccggataagctaagaaaacaaaaaacaaacaaacaacaaaaaaaccccaatccctgcccacagaattttagaatccaacagcagctatcatataacgaaggtaatgagatactccttaagacctaaagacaggtgaaaaggggataaaaaagaaggtgggggtattaccagcagtggaatctagtgtaaatgtcctaagcaaggtaactgagacttcgggaaactgaacatactgcaataggaggtaattttatgtcctggcatagtgcctatatggggcgcactgagcaggggtcacacactcagatggtggatctcacacttgagagatggagactggaatgaaaaattgcctttaacagttactttgggattgtggaaaaaccagaggggatctttgcctggagcagggattgaaagtggccggtgctcttgtcccagtgcaagtgaagtgaatccagtacacaaactaggtgttttatgagcgtagtccccagggtgtttctgagaaataaaggtgatactcctttaagactggaaactcataagccactgggctaatactctgctatcagctggggagccagaacccattccattaaaaggaattttttttcctttcatgtgtttttgcaaattctaagggagatctagatttttgatggtggtaaaatgaatgaaaataagactggtttggatgaaaggtcagagttggtccttgaaccaaagcctagaaggtttgagttgctttcagctgagaaagacaactccacactcaaaatatgatt

SEQ ID NO: 15182 - DNA, 62474 bp, Human
taaaccagccttgaaatttttaaatccccaagacatgcacctacacataaaaaaaaaaaaaatttaagaaaaaaaaaagacaggtggccctgtcacacacagtctcatgacagagaaaaagagaaagagaaaagagtaagagacagagataagagctagaggacgccctattcctatcagcgaccaccattcaattctatccaatgaagataactttttcttaatgtgttatacctacaaattatattctcacatagcctgtatataagtgacaagcaaaaaaggaaagtaacaaaagttttcttttctttctcttctttaggtttatgaggtctgcattgttaccaagaagtgatatggtttgcagctgtatgagcttaacttttggtatcctggttcttttgtgcccatttggtttgactagaccagtttttgttagctactggtgcaatatacatgctgtcagaggtagagtgaaactttttgccactgaggagaatgtagcaaaacaggaggagaggaagaggaggaagaggggaaggaggaagaggaatcagagatagagctcagagttagggatttttttttgtatttgttttcactcagggtgccctgaattaaaaagtaatgagacgtactgtactaatccttattttacacactagtgttaagaataacagtgctgtttcacatacatcacagcttctagagataaagacgtgtgggtatgacatacctcatttttgggattatttaacccttcgtagcctagaacatataatagctctgtaagaaaggactgtccagtgtcacaagcagactagaaagcagagtgaggtcaaaggattctgggagcaccatgataaaatataacccattcagagcctggttatgtgctttcatttcactttaagcaggtgtgctggcagatggacttccaacatgtagatagatgtatttatttgctcatcagaactttctaaactaaaaagtcatttaaaaaaaataacaccacccaaacaaaattaaaaccaacttgtatatgaaaatacagggaagaaatgcttttaaaaatgttagatttaagagacttaaagcaaaccttaggattgcctctatgcagatacttaaaagccacttaaaactgtttccaaggcctacatttaaccctccccccaccccccgccccaaagctaatggattgtttttgattttaaagaaatgcctggtgtatatgtatttggagaagtgtcttcccagccttgtaaactttggttgtctacacagcctgcagcactgctgactttcctaaagcacacaaccacatcctgggctactgttttcaaaactaacaagtagttctggtctggaccctggacaacgaagggttaatggattcatactataccttgctgaacatgtttaacctgctgatcatttggaaagtagtactggtgcttttcaaaattccgattttggtccatcagatcagtctttggctgacttccctttttgtaagaatactgtataacctggcattcagcagtgttaaagctgtcaatctacacctcagcatttggagctctaatgatttttacttttgtaaaattagaaatacttaaacgaccttacagcaatatgcatgcactgtcctttttttttaaagtaggatatcttgttattttatttttttaaaaaagtccctaataatgatttaaaaaaaaaaaaaagaaaaattccacgactactctatgctacagctaaacttgatgaaatggctctagcatatttaaaaagaatttgctcaaaaaaaaaaaaaaaaaacaaaaagcatgcctagggagtcattgtgacagtgcaaaatacatttatgtacatccctcttacaaaaacaccaatatgttagcattccgtgaagcatgctggttttcaggaaaaaaaaaaatcctataagagagtgaaatagcagctccgaaagatagcttttcttcttttcttttcttgaggacaaccaaaaagagtctttttttcctttttttttttttaactactagagaaatatcactaatacatacagatataaaagcagcatagaaagatacaggtttctcaccaactaggaataaagagactaaatgtgggcatatggttaaactacaatgcatcttcacatttgtccaacacatttacaagaaaaacaccattgggaaacctcacaggacagaagtgttttaacaccaagagaactactagtttttaattaaaaatccaaacagggtggggttgaaaaattttggaaaggggctggagctgaagccaccatttttaaaattatttttttcaatataaaatgaatgagctggaatagacccaatgtcttactctgtggaaccttgcaaaagtgaagaaacgttgaagggttatttagggcagctggctgatgtcaaaactgccagaatgctaattaactgcaggctgagtctcttacttgtgtgtgtgtgtgtgtgtgtgtgtgtgtgtgtgtgtgtgtgtgtgtgtgtgtgtatatgtgcgtgtgtgtgtgtgtatatatatatatatatatatatatatggagccttttgtattatggcatttttttttcttgctgctgtattcatacatcccattgcaaatcatctttcatttttcattctgttgacctggatattattatttcttttcagaaacaggaaaaaaaccgaacatctgtgtctccttccaatctgctgcacatctgcgcgttttgtagcgggtcttcaaagttcagttagcaacccacggacgccattcatcttcttgttaaaatgtctactgctgtatccaatgctcatgcccttgagggttttcctcttttttttttttccattattgtatataaagaacattgtgacttttaatattagcatttttgctttcaacagcaattagcaatctcttggtttgctgtttggtaaagcatcggttaatgaggtcatctagtttaaaatcccagctacttgaaaataacagggaggaggtcaaatctatcatttcatgttatattctctgctctcttttcagttctctaaagaaaagatatctttgttatccacaataagtcattacgacccgttactggccctctgtgttttactaccacctcaagatacagttaggttctctcttgctgaagtactgaaataggataattcatctaataaacaaacaaacaaaaaaaacaactttgagcatctgaggatgaggaattggtttcgcgttggttgtgttgtctttcctccgacagttctgagttcacgtctagcgaggggttgtctctatggtggaaggggttcccggggtggttgacctcggagtggctgctggtggtgtgtccatcgggctcccagccccgctgttgggcgtgacagaggagctgactgcaggtgtgtctccctgctgctgggcctgcagggtctgtccacagatgtgatggtgcttctcccagtctttgtgctggcaaaatgagccacagtatcgggctgtgttacagccactgcaggtttcactcgctttacggccacaattccagcaactctaaaggagaaggcagaagaaagcaagatcccaaattaatacactgttaagacaatagtctgacaaatatgttaggcatcactgtagccttattttcaagaactatacagtcaggatgaaaaatccaggtgttcacgtatggatacaaacactaaacacagaagatgcaggttttgatgggatggttgtccaaactgctctgccaacaactactatggcatctgacaaagcagttgaagactttttaagttcttactataacatcctttctttttaggtttggttatctttgtatgtaaattctcccttcactcatactgactagcaattactatttccaaatcttttcccaatacctataccacaatagtcagacacagagatatatctgagcagaagcttcttccttttagataccaaaaggaatcacaaagaaactaccagaaccatatctatattggattcaaataaatataatagagtagataagggattctattccctgctccttcagactagacaaggtgaggcaaagtcctttaacctctctatgtctttagttctttcagtgcatccattcagtgaaccttacaaccaaatgctaggactgtgttaaaacaaccccctttacctcagctccctggaggacaggatcctcagtttgttttttctccctgtatctgaagcacccagaatgggtgcctgatagatagaagtgttcaataaatatttgtgaaatgaatgaattagactacgccttatttggctttgagaaatgagaaatgctaaaaccagccaaataacaattctatttgcacacagttctttccagccaacggagctgctctgctgctcctgtgtgcctcagcaactctgggaagtcagaaaagcagagggaactggggctcatttgggagtgatgagaacaaaactcaaaccctagtaagttcactgccagttgtgggcagtgttttgcaagacatgagaaaagtgggactgaggctgccaccaggatttaaactttaagataaatgcatcacgaattagagcacaaacataccagagacagaagagcaccttttggggacaggccctaagcaggcaaggaggaatgaggaagaaactaaccttcagggatcctcctatgagtgtggtggggagggggacctcacaaagctgactttaaatgtttaaatgttcctagtttctttggcaagaccgatcccattatgcaaaactgtagtaagtaatcttagctttatgtcattcaactttttattctttaacttcattggttttgattatgtccttgaaaaacaaacttctgactacaatctggtaaccccaaacagctgacgctatgtgcttgtgtgataagaaagatttttaaagccctgacataggtattcacaggtctccctactgtgttctctacatttgctttgcttccagcatgctggttgtgtggcttaaggtaagctcatgagctgctgacaatactatactcctaggaaacgtcagcccatcaccctgtgtatggctttaccactgtgcaaaacgtgcaagggaatttttagcagccatcctaacattgttaacaaataaatgggctcccagaggctggcatgtgctgaaagcctttgaactcaagaactccaatttaaaacttttagaaagagcccagctccacgttcttatttctttaaccatcagacattgctatgttgagcagaaaagctcaaacaaaaaacagaaataaaaaagaaattacaatccaacacggaaaaacaaaacaaaaacaaaacaaaaacttaaaatctcaaactctggccaatgacaggtgttttaagtgactattgctgaggaaatctagaaacttggttgatatgtcaaaaaatgtcataagttaaaatttgaatgaatagtagtagaacaaaacaattttttcctacttcaattaatttaagaaactatctcaaaagatgtgaagctctgatcgcaagtctcattaccataacaagaagcctttctctctcaaaattaattcaactgcattgcatgtacaatggttccacaaagacgtgagcaaacgtgggcctggcccacccttcaaagctgtgaggtataatactcagtgctcagagtgaagttaacttccttgaggtttaggcttttagaataatgccagctggatcctggaacaaactcagcaaataagctatattcctaaattacatcagaatattccaattagagaacagagactcacatccaaaacaatattttaaggaaattaaacatctaatctgagtcaagtggcttctttaggaaataccctggtgtgagtcctatccgttttttggcagaggcacgttttggcagacacagggtggtaactgtccaatactcaatggctccttcagattgaaatcagatgtatgcaacattctcaatttaaactgattaaacacacagactaaaccaggtaattacagatgcatgtgctgggaagtggaaagggagacagaatgggggcttctttattttttaaagtgttttcaaagatgggaacaattttacaaataaaaaagtggaattgtgccaaatacagaaacagatgttttggatcgtgaagctgctgggaattgagccttcttgcatagtattgtctggttctgatccaggagttaaggggtctggctagttttacctctagtttcattctcaagttgtttgatactattcatttaccacccaccactgggacaaaagaaaaaacaaccttcagctgtaggaagttacaaaaagagcaattttaatgatctggttaaaaaaaaatctgcaaatttttatttctcttgacattgcattgcagtgaatgtgtagggaactttagtgagtgttcaactaacaaacgctccaatgcgcatattcattcttaaaagctcattagaaaactgaaagagcaatttctattaatatatttctcttggatgctctagtgaatttactgttggctaatccatacctgcaagactgatgcctgatcagtggcactcagcccctgaatagtcacaattctggaaacagcggaaggtgcagaatcttttgagtactccaatttggatcattctaagctttctactgttcacaaaggtggaaattgcaaactgtgtctaacagccacgtgtctatccacaagggctgggataaaggcagtcaatggcttaatctaattttacattttgcagtttgtgcattttatattcaagatactatttcctgataattgttttatttatttatttttaaatgactgagcttccctttcaggcctctaaggagtgatgtcactgaaattaccataatagtgtagaaagctcacggatatccatatcacagcaaatttcattcccaaagctcatggcactttatagtattcctttatttgtgataatgttattccctttttggcataaagaatattttcctccctatctgaaaagtaagaataagtcaattgaccaaagttaggttgtgactcagatgaagaatttgtggctgaacacgaacctcccctttgctaaatatactaaatacaaggctatatacagaatcaatggactgaagcttttgaatgccaacactgcatactgaaggtattcgacactttgtttcaaatcagcatttctctttgtccctaagaaaaacatttagagaatgatctttctgtcgtacaggcatatatcccttctggttcttactgcagaaaaatctttttctgaaggacaaaatatcttttattttgtctctgaactgctttaagtctctccaggtcttacatatctataattcttcagaaaaacttgcacaaaatcgatgtgtaataaatttaaatataatagaatgattgtaattgaaactcctcaaatgttaagaatcctacagaaggcaacacattgacttaaattcacattaagattgcatcatcatctacttgcattgcacttgacaatttaaaatcattttcacatgattgcagtttcagaaactgggaccctcaaaataaataattttcacagtaaaaggcttgccccaagtcacaaaaatataaaattacatagccaaagtttgattcacccagatgtttggattacaaattaaaaatattctttctaaaatgccacactttgtcaatttcagatcttttattagctctcattgtggcaagaacaggttagcaggcacttaactcccaaaaatggacagaaattgaaccataaagtcagaggcagcaaagacaaggtgtcagagtgtgtaatgaaaatggcacaggcttcaaaagccaggccaacttcatttcatttccaacttcatcactttgtggctttagaaccacaagccacttacttaacccttggagcaacagaacatgtaaagcaggaataataactgcaggattattcagggttatgtcagtgctaagcacagtgcatgatgttcataggtcctgaataaatggcaggtactaccaccactccctccttttggtactgactggaagaaagagagagtagatacagtccttgctccagatccagcaccttacaacctttagaattagaaggctgatggtcccattcaaattaagtgctatcacccatgggcactgacagctacaggagaagaacattaacttacttctcctcatacttcattagtgactaataatttcttccgcaacttcatttgctgtcctcaaaatttctgaagatttaccattgctgattacttccccgttcttccttattaaatgcctcttgttgaaatttcccctactaaaattctctttcttatacaataacttcttctgctgtttgttcttttccctgtagttgacagtgagggagggagggatgctggcataaagaaaaggaatatcttttccttctcatgctgccccttgtgagatcttgtggtttcaatgatcagctgtaagcaaattactctcaaacctgtttctccttgttatcttcttcctgagctttgtgctcctatttcaactgcctgttctgtaggtacctccaccaggatgctcctctaagtcagtattccctaaacccaactctggtgggtccatttcagtctttggcaacactcatgcccaagactttgtcactttattgcaaacccctctttctttagcccctggaaccattcagtgccaaaccccacagactacttctgtggtctctctccttttcaatcgcatagtcactactctaattctctcgccacccttcctgttaggatcatttcttaactgtttttcttctccgttttcctctttcgttcttacatagacacactgctcatttgtaaggtgacttttcttttaataaaatacttctcctcatctcattggcacctctccaccaccttgcaaagcaggcagatcacagaaacgttatcccaaattttgcagatgagaaaaccaaagcttcaagaggtgagcaaccaaaggtcaatcctagcccagtgccctgtctactataccatgaacatctacggaatcaaacagctggcatatatatatatatttataaaatatatatatataattgtacatattgtatattgtataactatatatatatatatatgtaacatagcatcatagctcatgctctgagagctccaaatttttctgggaatcaactggtctgatgagattgtgaaggctttgacaggacccatgctgtgaggtccctatgttttattcagagtctacacaggtggcatttccagtttgggccaaacttcacagattccactgaggttggtataactgtgcagctctgcacctatataagaatgataaataaaggctgttttaatctgggggaaaaacatcactttggtagtttaaaactctaaactattagaacaataaaagtatttatctgtttctgtgctcacttgcagtttcttgcttcaatcacctaagctagtataaggtatggatctcaaagaaagctgtagaagtttccttggaaatagctgcaatctgagagcattcattggaaaaagctttatctgtacacagataggaaatgaaaaatagaaataaatatggagaaaataaaagaatttaagatgatcagattcagtaaatttctgatttatgctaatgttggcattatattctgggttaaatatataatccactgggaaaagagaaagtacagtaagcatcacattgcttagatatctgccgcaagtccagtgtcattctaactgatagtaataccaactatcagcctataaatccaagtaaagtttgagaactaggtagaaataatcatgaagtccagtgaaaaatagatacagtacacaattaggaaaaaacaaacaaacaaacaaacaaaaacctcccactcctgccatgtagctactaagaaggtggcctgaaagtcgggctacctgaactaaggaccagctcacacttactgaccatgagacactgagcaagtggcctaatcccttcaaggcacagctttttatcagtaaaatgaggaaagtaacactacctactttgtcagagccgatgtgagaagtaaacgagctaaagtatagaaagcacttcataccatgcctggttcagagttaaacactcatcgtaggtcgtcttatttcatctcaggcaaaacaaacttcatgcaacctccgataacttggctgactgtgggttcccatgagcctgggatggcctggtttaccggactggtctgtctaagcaagagcagtctttcttactccaaaaggcatcccagtttggatgataaattttacacgcccccctcccccgcccacctacaaataatatccatgagttattcattcctgcctccaagccttctttctgctggtctccccagtcaaatgttctcaactcctctcctccttctgaaacatttccactgccaatctttcagaaccactgttttttctaagcagaatgagcatcattagctccgttttatacatgtgaaagaaaactgagataggaagagaaagggcaaattcagaaattacagagagaagaattcagaggtatctagagttaacacaaatagcgcagaagaaacataaatggccaagctaggcctagaactctggtcttctgatcgcgaatcttagattccttcttacaatccctatgaaggaaagagaataataatgtgtgtatcttaccacatatacgttgttttagatttggattatatagttcatacctgacctaggtaagagatgggcagatgtttacaataggtggtggcttcaaataaagaaagggaaagggaggaaagaatattgtttcagtaggaatactttagtaaatactgtgattttttaaaaactgtgggaaatatgagcagataataatatattgtgttatagctttcaaaaacactattttaaaaatcttttaaacaaccttgtaaggtaaatgaatatcgtcccattccttaagaagaaatggaggctgacaggaataaaatgaattgccgaaggacctctgagacagtaactgagctggggccataattcaggacttctgggtcctcctctcagatactttctgccacacgtatctgcctccgagctgtgctagcagaagacgatcatctgatcagatgaacatggcctttaagaggtgggaccattcaacttatcaatgaagacaggacacctgacagtggaagggggcgctcgtaataattatattgggacactaggtgtcaatggacagctccacccaaagtgggaggtgtggttgccctgcaccctaggttacagtgcactctccggtaagttttgcacattaaacttctaagaaatgagaacattcatttttcttagaaaacagaacaatccataaaatacttaaagcacaaggcaatatgggccttattgggcgtaaagagatctttttttccatctttctttcttctattcttgggaaattatttacagcatttttggagaaaagaggcttaatccttctagagatgattcctccccaagtcttaaaagtggtccttgcactttaaagaataagaaaacagacctaagctgcctgtctttatctgcatacaaaaattatcttaatgatccctatgaaaagatccttatttcattgttacaaaacaacatagggactgaaagcatgctgtgagatcctgttgaggctctgccatttcctagctgtgtaactttagccaggtaagtttcctcatccatagcatgactcaaggttcaagccatatactagacacttccactcttcttcagatcatgataaaattgaagcttttacaggttcagtggttttctcaaaaatcaaagaattgtaagaattggagccaggaattaagtttgaccctctgaattccaaaccctttcctctaccatggtctgctttaaaattcttggggaagtgtcactgaagacactggtaatgctatattaaagatcagttcccccaagaggtcaaaaaaaaaaagaaaaacaattattacagaagatcattcttacattagtagtagatatgactgaataacctatcacagatactgtttaacagggtttatttataatgctaaatattggtgtcaagatcacatattttctaaataggttttaggaataaagacacaaagcttataaatactgaaggaatacagcatgttactgcctgagtacaaagacttaattgacaatttcttcctagacatctgtctttagaatttggtgacctaaaaagtactcttaacatacctaacagccctaaaatgttcatgtgaaagtgacagttttaatgatatgacatcaactgtgcctcacgatattgctcatttgaacagagaaggacaaattctcctcaaaagatgctaataatgtttttaaaataaaaaacataaagtccttatatcttagccacaagataccaataaaactgaatttatgtctagtttaattgaacaatggaaaagtcagcagttaaagggcagataaacttccctttgtccctcttttcctgagaaactttcaaatgttgaaaatcaattccttttgtccccttgttattcatctgctacacattaaatagaaactctgggcattgagagattcctgcagagtctttcatctacagaaaagcctggtacaaattaaatacttactctccctcacaaattatagatatgtattgtagtagaccattgatttatcagtccatgccattgtgagttcggcttggtgagagcagcccattgtagtcctttatctaaagttactctggggttaaggatcgtgatgctatattaattaacgtggagcattactattctgctgattttgcaggcaatattttaaaaatcatgttgttagatattgtgttttagttactttgcagatctttgagccatttaggctagctgtgtgtgtgtgtgtgtgtgtgtgtgtgtgtgtgtgtgtgtgtgtgtgtgtgtgagaattattatactggaacaataatatatgtaacattacctctagcagcaatgttatgctatgaaatgaccatcatatgggttaccacaaataatgtggaagtacagactgtctctaagatctcttagaaatattcagttgatgcaaacattgttttagcattggactttaggaccaatagctaaggcagtgatttcaatcccaagcctgccagatggctttggagaccacagcttacacagtatctattaaatcccttcaattggaaagcaagcatacacatatgcacatgcacacatacacaacagacacacacagccgagctatgagtctctaaataatgctgcgaagttataagaatttcactttgatcggtaacctaccaaacattcaaaaccttttttggcaaagattaggtgttcaataaaaagacaaatgtgatcagctcttggcaaatttcatgaataccttgactttccccacactgttctaaatttttttccaaatatttatctaaagtgatcaccttgaatgaagaatgagcactctaatgaatgaaaactatcttgtttatttggagcttcccaagatgcctcacctcgcttgaatcctcctgctgattgataactgccagtgcgtcctccgccgcctgccgtttggcctcggcgaccgtgcgctccatcttggccctctctgttgtgatcatgtcgtgggctttccgctccgcctcagacacggccttctgcagctccgtcatcgcctggcgcttcacctcattgacggcctcctctgtgtgccagtcaggccaaaccagacaagaaaacacctctcagttagccgaagtcattggatacggattacttttcttttaattttttttttctttccgaggctggtctcgaacccctgggctcaagttatcctctgcatcaatttcccctagcagctggaattacaggagccttccagccaccatgcccactatctgattacttttttgtagaattctatagaagaagcatgactctcatccaaattattgggcagttccagcagtctaaaaactagcagatcttttgacatacatttaggaaaacaaagggtgaaaatgtttctttaacttgaatttatggaaatattttttgaaactcctatatcattattataatttttttaaccaaactaatgcctccagaaatgattctgagaccagataagaagttaaaggacaaggtcattcgcaagaaacctgtctgaataattcagacacataaagtcagttttccacaatgctataagttaacatgaatataggagggtccacaggtcaagagttcagaaaaaaaagagaggccgagaatggattttacacataaacaaataagtgcaaactattagttgctggcataatctacaacacaatagtgaaaaggtaactcagatagcaattaagttactatagaccttttaatgaaaaatcaatgctataatggatgatccagttttacttttgaaaagtcatttcctgagtaatataaatatgtgcctttataggttaaatgatagaggttttaaaaaataatctcatttttacattttaagctgttgtccatttactttaccaaatatatacagtggttttgcataaccaactgttgcactagacaaatataactgaatcataccacaggccaaaacaatcaggcctgactatgagtctgcaaggtgtcaaataagctctttatttttggctgaggaaagggtgcaaagattcaactaatgtacaacataagactgacaactaaaacaagtaatttccattttaaaaaattaactgttctaattaacaggggaaaatatcctccccctgaattagtttatctaattttcatctttattcaaagcaaaatgacaatgattaattgaaaatttaataagcagtaattattaacttggcaaacctagtaccaattaacactctattaaaactaattatgacatgtttcattcaagtgtttgcacttaattgtttcacccacttaaaaagcaccttaattaaatgttctgtttaattaaaaacatagattcctaataaaaatgttttactgtagattaaaaatgtaagagatgcaagtactcctattgtttcttcaattcctctggtttatttcacacatctattgtccatgacttgagagtcatcagaagctctccactagtaattaactgtcatgacttttgtagcctctgtcattttagcagcattatatctgaagtacatttctttgcaattactgtctgctaggttttataaactaaaatataagtaaaagatccatagtggaaatattaactaaattatattaagccgttgttagctgctttaagatatgcatttaaaatctgtacagaatcagagtattgcaaacagcttatagcaccttcttcaccaggaggtgaaaagatgcctttattatcctatcataaatgacttggggcacaagggaagtactgcccttctaactatacagccagggtctaatttagtttgaatattcaaggtgaattaaaattctatctaagtggtagtacagaacaataatttttgcttacgatcaaagctgtagcttgactaattgtatatgcaaatcaggcaatttacatttaaattatgcattcctattctaatcccacaggcatatacagatcagcaaagagaattggtaggacatttgcaaggtgcttgaatatttattaccaactgcaaacattctctgatcatgtaaaaagaaatatactgaagaaaacattgttacaattttaaaaccatctttatgttagattttttccagtttcataaagacctttgtaacttttgagtgcatttgttactttcgctttaaaaaatactacttttagaggagaatatggccttgaacaattttttggatttctaatctttaaaaatgtgtgttgttatgttattatattgtgttattgggggcaatgtgaaagatttgcatagggtctgtagattaaataatagtcttctatcagtgataaagtcttgatttggtaactgtactgaagttatgtagaatattcttgttcttggtaaactgacattcaaatcatttaaggtaaagagaaattatgtctgcaacttactctcaaatgattagaaatatatatatatttaagagaaagaagaggatgaaagggaggaaaagagaaaatactaaagcaaatatgataaaataagggaatctaggtgaaagttatagaggaattttttgtactttttttttgcaactttcctgcatgtttgaaatcatttcaaaataaaatgatgcaaaaagctatatgatgtactttcaagcacagggtatacttgtaattacaattttctgtgaaagtggatgcatttgttatgctacatcaagttttgggtgttctgccccttttgtatttttcaaatactttattcacctatgttttgcaacaaagataatgtataataatttcattgcaaagacacactttatagattttcttcaaaaaatttttttgcccatagccaattttagaaagctaggataaaagctttcaaattgtaacaagctgagtgcagatgtcacattctgcccttggtgttttcatcatgttggatgccttgacactgaacactagaaatgccatttaagaaacctataaagataaatattataagtagttactggagatttctagatgaaactatcatccatactttgtggatttaatatactccttaaaatttagcatatatccatagaaaactattcccaaactgtttttaagcagcagtttagggataccactgtgagaagaatacaaatttaatgtcatattttagattgaaaacctactgtagatgatagacactgtaataaataatctaaacacttcctagataaggtttaacccttcttggagagggcaagcacacaacaaaaacaagtagtgctctttctctactctcttaagtccccaaaacctaaattacacccagaattaggtttaaaaacccccaaaacagacagtaaagaaaaataatagtggagtcaatagataacaatatgccatgtaggaaaaaataaacaactgattaagtggaaaatacatagtgcagttttgaatctgcgtccaattgcttaccacttatggtaggacttcctttgtacatagctattcaagttgactttccaacaaaggtgctatattcagaaaaatctattctcacttaatagcagtcaaacaaagacttgagcagataatagcacaaaaagaattcggattacacaagaccttactggtaatttttctctatgaactatcaagaatttaacttaaatatacttaaaaagggaagtgcagagaaaagactcactcctctgaacataaagtcacccttcttctgtccaaaatcacaattatttgtacctcttattggaataagttgcactgacagcttagaaatggaagagaaaaatggtcagaaggaagatgttgcccgtcttttcaggtaggtggtacttggcatatttttaacagcttgggaatactacatgactattacagtaaatctggtaaaactacacagttcagcaacatatgtattttaacctttaagctaaatggacctatctaatttgcgtattggacgtgcaagacagctttctaattcttaatctgggctactaaacctagaatgctatcagattttaaagctcattatcactcttacaaaaacaggtatttcttggaaaatgtataaaaatacttggataagatacatgtgactagagagtcagcaagttacacagaactacaaacacagctgagtgaaatcccaaagagaaatcttctgtagaaaaaaacaaaaaatctgtcccctgactcttcaatttgcactgtttgtagaagtagcatttcccagtttcccaactcaaaaagacaaactgttttaagagctggagttacagcagctgaaagccacagtatgtttttcatggcctctttaactcttgaaacaggtttatgtttcatctcctgagttggttttcataaaggtttttgcttgctaggtggttccaccaaaattctcacagatctggacttctttaagcccaataacaagtcagtgggtcatgaggagctttaaatctactattacaaaatatagagcagcatcttgtaatggaaagcagatagtgtatatgaaaagcaaaaataaatgtttagtaactttgtcatttcacttaaagagtaatttagctctgatcgttgaatactaattagtacagaagaacaactttaaaagtcgattgtaaccaaaaaattatctgagtactttaacaagtcaactagatttgatgttggtttcgttttttttttttttggatgcaggagaaaaggctgaagtacgcaatttaatttctaagacactggaattttttcatcaaagaaaaaaatgcatgcaagctaagacctcctatgccaagtttcagcctgaaatcattatggccctgaaaaaaatggagttttataatggaaatattgccagcttctcaattatagtgaaactggcagatgttactaaaataaaaatgatttcatcttgtaatcaggcctggtttaagaatattaatcaggtgttttgtttagtggttttttttgttttgttttgtttttgctgttgttgttgttagcagtaaagtcctttcttgtcattcctcacatcactacattaacaactgcacacagctgccagaacacgaaactcatgtttttaaacaattcttaccagctttcttccagatctcctctggcacgtatccagacgcaggcctgtgaaggaattcccgatgcgcgtctatgaaaaggatgggaagggggtggagagaggaggagagtactgtaagcacacttgtgtcatcgcacagagtgaaagtaagcaatgcccattctcctggcttctctacaaaaacgcaattttaaaaggctaaacatttcacttcttgaaaacacataaaaatagcaaggcctgtcatcagagcccaaggaaaacagagggtcattggtctaaatgccatgcatgctcaaagccaaagcaacttgatttcattatacaatatgatgtttgggaacactgttctcagcactttctgactatggagacttctatagatatattttgttaaggaatataaattgtatttggtagttttcctttcatgagtcaaactggtggttaaacaatcaaatgttcaggtaatgtaatttccacagagctctgattctgccacctttcaatgaatagcaagctccactctatggctaaccagttctcatacttaattcttaaaaatctcagtgaccattaaaatttttcacacaaattagatcatatggatttgacatacgtgaaagccagaaagactcatcagaatggattcacagacattctgttgagcagagagaattagcccatgctttccagaaaaggaaatgaagttccactttaaattaaatgctgtgcttactaggcgtctcaaattttaaaagtttaagaaaacaactaataactttgatataggaatgctaacttctaaaatatgttcatggaattaacacaaaacattttatagttcttacatatgctcaaaagtaaacaaagtgtataccgtcttccatagctaaaatatgcatttcatgtcttccatattggattttcaataaaagcctccttatatagaagagttcggtaagaaaaaaatcattttaacttttataaaacttaattaataagcccatgataaattctgaggaaaactgaaattttctctatgtgtacagtaaatgttgagtagcatatatttttaaatgctttatctaatggttatgttgaagatgaagacatttagtccagtctcctatattttatggtgctacacaatgtcaaaaataaagaaaagcacgatgagtttagctaagtatatgttgttacatttgaatgctttaaatacatttgaatgctttgaattcttgcagggcacacagattatcaactggcaagaacattagattttctcaactattctgaattagcaaaaatttactacagcttggtgaggaatatatggaaactatatcatctttgcaattttttaatctaaaattattccaaatatttaaaagtttattttcaaaagtttacactgtgatgtcatgactacttaataataggatggactggaaatatctatgcattctcctgtgtatattcatttctataaagtaaatgacaaaaataaaaacgtttttactgaagtaactttcattcttaaggcgagataaaactgctgcataaacaacctaaaaggaaatgtgatacagctaattagatttatcaagattatcttccttaccactataactatttccagaagaaataaagtgcaatcaagttcatatttagccatgtgacacagtacaacacagagatttacttatgacattaaaagacaacttttaaggagaaaagacttggatttaagcataatttattggataagaataagaacagatctgtaaagtttgaagaaagaaaaaaacgtgacttcaaagtagcaatttttttttcatttattgtgttaagaagagacctgtagttaataaaaacttatttttttcttttttctttttttgagacggagtcatgctcattgcccaggctggagtgcagtggcacgatcacagctcactgcaacctgtgcctcccaggtcaagagaatctcctgcctcagcctcccgagtagctcggattacaggtgcatgccaccaagcccagctaacctgtatatttttagtagagatggggtttcaccatgttggccaggctggtctcaaacttctgacgtcaggtcacctgacctcccaaagtgctggaattacaggtgtgagccaccatgcccagcctataaacattttttttttattaaatagtcaatcattatgataaagaacaggaaaggtaatgtttaggtatccaaagtccatgcatgaaagatgctaattaccagccccaggcaacataggctgaagaaagttagttctagcacccagtgaagctagctattgaccatggaacactgggtatgttagtttgtccatgtctcagatgcctcatctataataaagtgaggacaatactactattatttgagagcactgctgtgaagattgaaggaagtacctcctattacatacacatcctaaactcccattatctggtacttgctattatcctcattattatcattattattacttactatgtggtctagtaagaatggctatataattatttccttttaaagtttatcttttctctcaatgttaaaaatccaaataccacaaattttgaagagaacaaagccattgaagaagtttggattaagcaatatacaccaagtaattttttaaactcccagaatctatgtcacttggaaatagaaaatatttctatagttcacaattcactgcctttgtccttggaagcaaaatcttcaaatttcttagatgacactttcaaaaattttacttgagcctcacccatgaatgtttataacacccaaattgactcaaatattaacgtgccaggctcaattgaccttccaccttctatgggctgcacaggtgtcttgggggtacatataccacactggaaagttgtgcaatgtttcactttggctataccttcctaaatttctcactgacatactgccatgtccacataggcccaaactttaactgacatagaaacccaatagaaatgctaaagccaattatgcaaaagttttcttaatgctaacctaccttctaaaagacagtttttcaaaatagcagaatctaaagggaaataattatataaacgtgttttacaatatcctctccagttctaagttagtgtacttgataaacatcaggtctaccaacagaaagaacagagtgattggtagtaggtatactcctcagaaatctatttgataccttgataaacactactttaatagattcagaaaccaaatgactaatacatttaatatctcctcttctgattaagcagcagcaatatcaaaatctatatagggaaaactgagtttgaaaaacaaaacaagggacaattctctcctaggactttactattttagaatactggctaatctaaacacatctacctaaaacatcctaagattctaaggcttagattcaaaagaagctaattcttacccgttaactcttaagtacctataaaatatcaattgctagaaaaaggaatcatcattctaaaatgtagtggtagatgcaaagacagaagaacgtctatgatatggtctaaaatgttaaacgtatatatatatgcaactactgaaagatgaaaacattatagaaaagtccttctaaattaagtctagcttgctttgggatgcaaattgcttggggcggggggtggtggtgagagtggatgaggatgaagggagcctcttgaaaataattcacatctatgaagagaggagaccaggtcagagtgacagaaaatggtgtaagaaatgtgaaagaacagaaagagcaatctatgatgtatgaaagagatggaagatgcactacacttacgacaggatggagaccattggatactagatactgcaagggccgccatcaatatacatgaagggatgagctgatagcctttggagaagcaatgtgacctcatatgacccaggacagcaatgctcaaagctgggcagcacctaggtatggccttcatcctgtagtgggcagaatgaggctgtgatcatgataatatctattacaaaaaccatcaaaagaaagaaagagttaagtaattttatctttacaaatgccacttgtttttaaggataatacattcagaaatcttcacactaggtttcagaagcccaaatccaacctagaagctagcaactgctttaggatttccatcttttacaacaaacatacttaatgctccaggaagtaaccatctcctcttaattttaaaagatggacatatttaactaatagtcccatatttttaaacccaatatagttaagtacagtaggcatttgcattatgaagtcagctgaatgactgtgagattaatttcatgatgtgatttaaagaaatcaatacaagggtacaaaactccaaacatttacatgcaaatatacacagaataacttgtttgtggttttcatattttgagagtatagaagttgaaatatttcattggctgggagaaatctatttttccatagccttgtattatgaattagggtcccaaaggtacaacagatttactacatttaagacaggaatcttttctaatctctgtgcctattaaagaagccacctgcttagaagtactttgtagatgaaaaaatacttatgaatccactgtaacttcacaatcttgaatgccaaggaaaaactttactagtttcatttaccactattctttaaagttctttttgattttatgttttaaattttttaattttatattttgagacaaggtcttgctctgttgcccaggctgcggggcagtggcataaacgtggctcactgtcactttgacctcctgggctcaaggaatcctcccatcttagcctcctgagcaactgggaccacaggcatgcaccatcatgcccagctaattttttgatttttggtagagatggggtctcactatgttttccaggctggtctcaaactcctggactcaagggatcctctcacctcagcctcccaaagtgctgggattataggcatgagacacttctactcccagcagaaagttctttttgagaatgcacatctaaataacagctaagacataacacttctactatgtgtcaggcactgtctcatatgtttttacctattaactcattatacagaaatgcttatgaaatatatattaccatccccattttacacgaggaaactgaagcacaaagagattatgacctgccaaaggccacaaaactaatatgaagaggaatgagtaattcgaatctagaaattctactgactgagtttgtgctttcagtcttcatgctagatttcccggggatttagagagcaatgagaaattccataattcaatcatatgacaatcataaaacttgccagctagcagtattttaaaatactaattcctctaccaacccacttgggacaggggatggtattaattcaacaaactcctaagttactaagcctttttttttttttttttttttttttttttgaggcagtctcgctctgtcctccaggctggagtacagtggcacaatcttggctcactgcaacctcctcctccagggttcaagcaatactccggcctcagcctcccgagtagctgggactacaggggtgcaccaccattatctggctaattttttttatttttagcatagacggggtttcaccgtgttagccaggatgatctcgatatcctgacctcatgatctgcccgcctcggcctccccaagtgctgggattacaggcgtcagccaacactcctggctctaagtttcttataaatgctaagcttgatttttcattacacttaaacaaacaaaactttttgatatttctttctctggcaaatactaaactcttaacaaaacagagtgaaggtatttttctaaatttactaccatgtcatcacaatgttcatacatgttttaaaagcacagggaaagtgcatttatatttcagagtttatgtccagcccctgacattagccctaaacctatcattagaaaaaaattttggccaggtacagtggatcacgcctgtaatcctagcactttgggaggccgaggtaggcagatcccttgagctcaggagttcaaaaccagactgggcaatacggcaaaaccccactcctacaaaaaatacaaaaaaattagctgggtgtggtggtggtctacctgtagtcccaattacttagggggctgaggtgggagcccagaaggtcaaggctgcagtgagccgagattatgccaccacactccaccctgagcaacaaagtgagaccctgtctcaaaaaaaaaaaaaaaaaaaattaaccctaacgatgtggaagacttctagaaaacaaaaagagcgcacacagatacaagacaaactacagaaagattctagaatagtcaaaagccagtaaaaaggaaagtagtttaaaagaaataaaatgtcaggagccaagaaagtgatgtgacaacattctgagagaaaaaggaaccaaagacaaagaaaggaaaaagagctactaaggagattctgacaagcacttcggaaaacatacaaagtgctaaccagcaactgcctttctatacatataaaagtaattctacttcaatggtcaaatctgtcaattctgatcacattatcttgctcttctgtggagcataccatgtaataaaacttaaatgtataaataagtcatactttgaaaatagagacagcagtgttaaaatttgctttctaattttgttaagagttggatacttggagttttccctggaaagtaaatgagtaacaacagtaaaaacgataaatatctattatttcaagaaaatctattttatgaaaagtccttcaagatgtcaacttgcattttatttaaagaatagaaataccattatgaattcagtgtatactcagtgttaaaaattgtttcagtcagaggttattcaaaaaagagattttaatatcttaggaaaatactttttttttttttttttttttttttggagacagagtcttgccctgtcgtctaggctcgagtgcaatggcgtgatctcggctcactgcaacctctgcctcccaggttcaggtgactctcctgcctcagcctcccgagtagctgggattacaggcatgcgccaccatgcctggctaattttttttttttgtatctttagtagagaaggggtttcaccatgttggccaggctggtctccaacccccgacctcgtgatccgtctgcctcggcctcccaaagtgcttggattacaggtgtgagccactgtgcccagccaggaaaactcttaaaattcaattagtaatagattaatcgagttattttactaaccccctatactcactcaatactacagatatatttcaaaagtgagaatgggattgagtttaacaggtacaacacatcaatcatgaaagttacattctcccctgtgcagtccccaaatataattttaaaatgctaagaatgtgtgtatgactaaacgttcccagtgtttccaagttagggatataagtagggcaatattttgaaccaaagatatcttctataatatattctgaagatctcatttgagaccagacagtagtttaagaagcaaaataattaggctaaaagaaatacatacaactgtgggatacggagatctaaatgtatataaagatatagacatatccatatctttatctgcgcacatgcactccattaaacacttcccagtcacagaaaatagatttatcagccaataatctccaatcctttcattacacacatcaatccattcaactccaaagcctggaagagggacttagaaagcacttaatgtaaatgattgtggcccataattacaaaccacctgtcctcttatttacagccatagctcagtcccagaaaatagtacacaaggctgcaagaatcagctagtaaggatgcacagtgaaaaaaaactgtaaaagcactactggatgctaaaacttgcacactgcagagttctacacagattttctctaaagttatgatagtgtcttaatggcaacttaggattctgtgacaataaagaacataatgtcttaatgttgtctataaacaaagaaattaaatgcttgtaccctttgactaatacaacctacaaaagcttaaggccaaacaaatatctcaggtttaacaaaaatataaatccattgaacatcactaaaaaatagtatagtttgtatacttttaaaaaggagtttttttaaaccaagtttattcttttggttatgtagcagggacaatgaacctctcttcctggagaacatgatatatacctatatcaccagaatctgtgtgtagtagtagtgactatacacaaaatggcccttgttctatgtgctgataactcgcttaggtatgaagtctgatcaatttcggagatgtttcttttatagtggatggcagataatagcaatctggtcagtttggccgactgaattgaggtagctatcctatggcttgaacactagctattcccttgccttcttccactagacccaaaggccctcaaagaaagaaatgaagactttttccttcattagaatgcctagcacattgcctggcacatagtaagtgctcaataaataagtactgactcaatgaatgtgttcaatagaataagccaaactagatgttttaactccctaagttttatttactttaaagctctcaatttttgcctagactggacggttataaatatcccctctgtcctaagcaaatctctgatgattaatcaatttttgttcataataaggaaataaacacaagatttttttttccactctgctctaaatagtttggcttcgaccaatattggctcaaaccaaacgtaattctgttttcgttgcttgccttaatgtgacctgacaaatacaattttgtttttaaaatatgcttcagaataatgcttgttaggtaaattaactgccttagactctttcattatttaatacttatgataataggcattcggcattcagagatcagcagaaatctacaaacctaagtgcataggaaactacactggctgggaacaaattgaaaacagtaatgtgatcaacagataatatacttcaagttttaaactttggataatcagccatggtactaatgaggccaaaattatgaacttaatctgcacgttttgcagcatggacagtaacttgagttagcagatgggtatggggccaacgcataagataatatgagagaacaagaatccacagaaatccaccttcgtaagtttactcaaaaagtattcacacgtaatgggtggcaatgtcaatgacaaaaccgtattattaatttaggtaaaagttcacaggccacacaaaaattctttcaggttgaagatttctttcaacatatatgggattatattctatctgtaaccccaacaattcccaaatatcaataagaaatagttacatactaacattccatttctaaggcacaactatattatgagtcctattataaaactagataaaactagaattaatataatcatgattaagtaatctaagttaagatcaaatcacaggaagggtgctacatctttatcattaattttaaaatagctgtaggcaaaatatatagcttctaggtctctcttcctggaggcggggggttgagaaaaaagtttaaaatataaatatatatatatatgattcaactaacaagattgtcttacaggctgttttctgaattaataatttgaaacatacatccccatgtgcagtgataacattggtatgcagtggcagaattcactagagaccttgacggaagtgcctaagccccaggcccactccctgagattgtttttgctgttttgaggcattacgaaggagcacaagttttagttatgcacatgaaaatctggttcagtgctgaaacgctgccatcagctcaatacactcacctggaaaaggaatttaagttttgtggctatctctgtctatgccaatctgcccaaattcctaacagatagacaagacatattggaggatatgtaaattgtttattgtcttaaaattccttgcatatcctttaattttaaaaataaaaatgaagtcagcattaacagcataagaaatatgtgttttcgagatactcatctgaagaaaagttacctagtgcaactgggtctgggttgacgggactctgctgcctagagtggctgctgctactgccgccacctttttttaagtcctcggcgtcactgtaccgccggatccagtaattcaattcttcccggtctgcttcttgacaccgccttagtacggtgagagatcgccttgttttttctaccatgtccattatgcagtttaacagctatttgggaaaggggagaatagggaagagcatataaatcatcacaattaaagattttgctgagtagtgaaacaaaccatttcaggacaatgaaggaagcaattttatccctgaaggtttcagtctagtattttctatgactagatttgaaattcagagccaatagatggaaaattcaatgggaatgagaagataagtgttatgaacacgagtcagaagggaaatttcacctgaaggcattatagccagtaaatccacctctccaaatactaatcccattactttataaattaaatgaccttttcacaatagaacagtagcccaccgatctggctttgagaattcctttccaagatctaaacatttctctcaagtgactttcatatcaatttagaaatcaaatcctatattctacttcagatattctcgctcatttttttttcaaggatagcaggaaaaacaatgccttcaaaggatcaccaagcttttattttatcacataacctcactccagttgttttccaaacattttttaatcccaaatgattactgatgtcttacatggtcaagatgtttccactcttctgcccattctctgtctgttagtctgtgatcaatcatttcttcttgacgtgtgccatgcaaccctacaaaaatagagaaggctgaataaccctaaagcattcagtacacaacccataaacacacagactcatagcaaggactatgtgggcaaactcgatgtaaaaatacgtttgattttggatggagacatgagtcatatttagattcagaattacctaacagattcctcatagaatgataaaatactagaactagaaggaattttagaggtcacctggtcagaagcctttattttacacataaggagacagttaagtgacaccaactccacaactagttatccatgcaacactctgtaagtaaaaatatattctaactcttaataaatacaagaaaccacaagtagacattaagtggtttttaaagcattgctgtcctgcattaaaaataaagacagcataagtcattttacataggaagggttatgctttcccaaaacaagcatggtaaatttttctacatgtcagccttgtgtaaatgaatacaatcctaatacatatacctccgtgataaaattagaccatgaagaaaaggcttgtataatatggagctacatatactcattcagtttaccaaaaattaaaaaataaaagtaaattggatattcttcaaaaaaaaattaatataccagatataatttgacaaatatcataaatccaagtgaaccaactgaaaatcctaatttgaagtccatgaaaaagtaatacataagtgtttaccaagtgagcaccaatattaattaagcggttagctaggatgctcattaaaataggaagtaaatgtgtctcactaaaaagagaggctgaaaggctccgaacagagaaatctggaaacgtgttattcctcttacatattcactttatattctactgtataggaaaagcccctgggctgtggcattattttgcattttaaatgatcaaaactattatttttggttaccaattttcaaaatgttactctgaacagcaaatagagtttcttatagtttggtttctagataactgggcttcctctcgtggaacttatgtataaagtttcttatagtttgggtttctagataactgagctatctctctgtggaacttatgtaagaattaaatgaccataggagttataagacactgaattttactttttgtgagatttaagtggttataaatccctttttttagctgatttacacaaataaagatgagtcacatgactgttcagccaaccacataaaacgatttcatttacaactgatggaagtgaacaaatttatgatagccccttctcagactaaataaaaagctaaatataagatgctttgtaccattcctgtccaattagaacatattctgagatatattttaaaagttaaaattgtcaatgccacctattggtaaaaaagtaaaagtgcaaatatgttttattaatttgcataatataaagacattgggaaagaatagtatttagctactgctctgttgtgattatttcaagttgaaatgtttgcaaatatgtaatttttgttaacttatttgttgcctgggttttagagaaaaaccactactgttaaaattagtcaccatacaaaacaaccagaaagtgataaggatataaatgtgacagtgactttcatgttagaggcatctgaatatttgcctttaaggacaagaattccagaggtctcaaaagcttgaaaaattcagcagaagaaatcaataatgacacaagctgtaatgcctggagtaatattaatgagcaacaggatatctgtggtggtgggatttcagcatttgtgaaacagtactaagcttcatctcatttttaaaaaaatattaagtgcattagaaacatgtttgagctcaagtacttggtgaaaaaatgtaagattcatttgccgcttttgaactttgaaagtcatttgttagatataatcaaatctttaaaaataaaaaataaatcaagattttatgtttattaatttctctatttaagatacttaaatattcagcagcacacaatttttatttatagtcataataccagagggatgtaccgggggaaatatctcataatcattaaatagctcataatcacattttcatttgtgggaaatttgacactaatgttgagtctcaactgattattttgttttagaatattttaactaactaggataaaactctaagcttacttataaactaatgctgctaagaagttactttactgaaggattctcgtgagtatatgtccctacacataataggcatttataaatcgtaccagactaagtatatctttatgacaatttttatattctcaaaatggcagcctgatgtaacaccataatttgttgctcatacatcaagattttattttacattaacacacactaaactctgccagactttagggatggtttagtagctgcacatatttatagagattagcactattggttttataagctaatataattaaaaggtaaggaacatggtctgaagaaaatcacataaaaccaatggatacagatataattcataaagggatattttatattacttgatgaaaacataatcattgcacataagtgtaattacttccttgctgattactgtatagtgcactggaactaatatttcacaaaatagcacctgctgcctaagaaacaggccatttgctaacacatctacaaaatgggatcccttgaactggtctcaccgtgacctgaagactccactgctatttaaaaacatgcaatcatggttttcagtccttaagtcataaataagtggtaaggctttgtgtagaagggagttgttatcacatttgattttggggttaaaatatcaatccagatcaagaaatagcataaccacctttgaaagctcttcagaaatggtacctgcgagaacattagacagactggctattaagaaagcacaaattatatgcatagccatttgtctgacacactatataaacgtagaaattactgttgtggagaaccagaactactaatttactgtcttacaaccaaagcctcaatcacccctcctctcaccctgactctctttctgctttctaaacatttggggagttgggtgtagaaaggtaaaaaaggccctacacgtggagcccctgtttgctagcaatgtagttggaaattgaatgtaaacttctatatattaggctctctctgcctgtggcaaaaaaacaaaaaaacaaacaaaaaaacaaccaccatcactgtaatcaagtagtgaatatctggctggctgcattccccagaattctgtatcctcagctccactttctggttttctacttgcatttcatcccttgctctttccagtgtccaggtcactaagtcgccctcatcaggaaagtttgccagcaattagttacaaggtagagattaagtcctgttagtgggtgatgtggacacaggagatggaaaaagaagaggagactgactattgctctcagtgagactcatcactaattaggaattgaagacatcccagtaacagtgtacttactgataaccctctgatacactatcatctccaccactgaaccactgatcatatgtttaaaaacttaccttgttcatcttctctctcatttttcatggtagacatttgttctatagaaggcaatgtcttcaaaatgctttactactttttttttttttttctgagacagggtcttgctctgccacccaggctgaggtgcagtgtgtggggtgcagtggcatgatctcatctaactgtaacctctgcttcctgggctcaagcgatcctcctgcctcagccccacaggtagctggggctagaggcatgcaccaccatgcccggctaatttttgtacttttagtagagacgggattttgccataatgcccaggctggtctcaaacttctgagctcaaactcatctatctgtgtcagcctcccaaagtgctgggattataggtgtgagccactgcacccagacaaaatgctttacttctaatagttttatgcaaagaaggaatgaacacagggaaatagaacacatatttgcccaaattcacttcttcttcagtattctgatccttgacccaaaactgtcaatattaactttaatcactggcattttcaagtaaaaaaaagtaccaaatcattccttgggaaacatctgttaagccacagatagcatgccatatcacactttggaaatatggaatatcatggaggctcaaaaaaatcaaaataaacgtagagactatctgaaacaaaagatacaacacaagaaaatcaagtgatttttaaaaatatttgtggcaggcagactgcatatgaagtctcatgttgaaagagaattcaagctaaaaatttattttgcatttgttaccaacacaacaattgagggtcttgtattaatctagatgccctcctccaaagaaatttagtgtactgtcttaaagaatacaagtgattaggagagagaaagtacagctgttaaaagtctattaataccaatcaagtttttttcataaaggagacaatataaagcaagatatgagaatcttcatccctatcacagatttcaagcctcaagttaagttcagaaataatggtgcaagtcttcaagcacccaatcccgtaagaagtgaacaggtccttcagtcttacccataggtctgtttctgtccctgaggtccctgtggctggggtgtcgataggagtccctgtagtggtgggcaatggccatatcatccaaacggtaatgctgaggtggaggtggggtagggtgaggcaggccattgggctggtaggataagccgttatttggactgtaccgctggcctgggctaatagtgcatggtcgcttgcttggatgttctgagtgcaaaggctctctgtcaaagccattttctttggttctaaagggggaaaaaacaagagtttgtttcatcatctattcagaaaccagcacagttcagtcactcatatttgagcttggaataaaaacagaatattttttattggccagaaaccttctaaactcagcttcccagaaaacatacgggaattcactgagacctgtgtcgagacctaaatgatcacaagcctgcagacaggaaaaaatccttcacttctcatcaaattagcaaatatcttttcagttgaagctcatgtggttaagtcacaaacaagaggaaactcaagactcctgtagataacattttcattcaaaaaacagtgcttgatttctaacaagttaccctaagaccgactgtatttgatgaagattcatcaaggtaaaacatcactactctcttgatgaacacttaaggtacacctattccacttggtatctgacttctgtgtcagagaatatctaagaactgtgttgtccaatacagtagctacatgtggttgtttaacttaaaatgtaagttacttaaaattaaataaagcttaaaattcagttcttcagtatcactagccacatttcatgtgctcaacaggtacgcttggccagtggcttcagtagtggactgcacagatacataacatttccatcatcacagaaagttctataggaaagtaaggatcaaactgagcaaataccgtatgcaatgcaatgtctgggaccctgacattatcttgagtcaccaaggtaatcaatcagcagtcatacagagctagcctggcctagaaggaagatctaggtcaacccccttattttaaagttgaggaaacacatacccagagagctaatgtatcctgtctggggttatcaggtcacatggcaggacgggaacaccctgacgacacaccatcaggtgatgcacagaactctaaacttggctttcagaaggaatgcattctataaataagacctgataactagtcacgattccttgattctcaaataaaagtaggagtaaagcagtaatttctggctgtatatatttctactgcatagagactagcccctaatatattcaataagatagaaacaaaccatattcaaatttgactaatcactgctcccaaacttactttttacttacaagaccagcactcttatctttagacaggtggtaacatctattttcccagggacgttttctcataagaattctaccagttcacagtggctgcagacatctacatgccttctttattttagatagtaaaacaacagcatagaggcacttcttctactttcccggcatctagtgatggcatccagtctttgtctgataacactagagcaattcaggtggaaactgaatcaacaacagagataatcaggggcaacaggattctacaatgaaccatcctttatggccctttagggtgggcgccccagtgacaattcatacacaccaggttgagaagaataaaggacttagagacagaaggtataggcatagaaagaactgagggtaaatcttcagagttttatgttaaagaacatgcccactacatactaagaaggatgcactattatggagcgggcaggggacccttaggactcagccgtgtgacctccagttacttaactttctggcttcaatattctgctcagtaaaatgggactgataggaaacaacatttgtaaaaacaaattaagaggcaatctaatttatactttaccctatctcaggcttttttccccccagctcctcaataacagaagctgtaaactattacagaaagaaaataaatgtcctttaaaaactctacatgaggccaggtgcagtgactcacacctgtaatcccagcactttgcgaggccgaggcgggaggatcacctgaggtcaggaattcgagactagcctggccaacactgtgaaacctcgcctctactaaatatacaaaaagtagccgggtgtagtggtgcatgcctgtagtctcagttgctcgggaggctgaggcaggagaatcacttgaaccccagaggcggaagatgcagtgagccgagattgtgccactgcactacagcctgggcaacaaactcaaaactctttcttaaaacaacaacaacaacaacaaaaaaactgagggtaaatctgcagagcttaatgttgaagaacatgcccactacatactaagagggatgcactattctgaatagactggccaatattggaaatgatggcaaagcatggcccccaagggagtggtggccaggagtcctaatgctgctcccttcaaagtatgtgtctacactaaaacatactgactccttacatattgatcactgatatcagactaaaatatccaatgtagctcagacattacctaattgcattgctttaaaataatttttaaaagtaaactgaaacattctagatactgatttatcatctaagaatatacccatgtgattctaatctgtatttgcatatcccacaaatttctaaaaaatacacttcaatattcaatgcatattatcagcataaatcagctggaaaatactgaagactattagtggctatgaacgtaatgctaacacagcacctaccttactggcattgtggtgtagtggaaagagcactggactgggaatcaagagacctgagatctagtcctggctcttccatgactagctgtgtgaccttggtcaagtcacttaacctctctggacctcagtttattcatctgtaaaatgaaagggttggactagatcagtggttttcaaactgtgccacctgaggtgctgaaggtaggcaatgaagaacttttccccaaaacaatcaagattctcaagatttaaagtgccagaggaacccacttcttattatttgtttcaatcactggggttccacctaagatttcatttttaaaggaaaaagtctgcggctaaaatcaagtttgaaaaccactggactagatgatttctgcagtcccttctagtttgcaaactctgcaattcaagtattctatatttacaactaaatgccatagttatgcagatcaaaacacacagtgctgatagtcctctggccaaaccataagtatctaaggcaaccaccttagccaagttctccattccttggtttgaacaatttattatttataccttattttttgtgcaaaaattagaaaatatcctcttatcttagggcagcccctgcagaatttctaaataatgaaacatctttgactgatttgggtcaaaccaccccaacttactagttttctctctccttgatcaatgaaggcaaaaacaacaacactggagtaattttaataattcttaaatggttagatacacaatttatcttcatccttagataaaccctttgttcagtgctattacttcaatgacccaattaaatgggaggtaaaaagcattttttttctaaagcaagggcagtaatgtcctaaaaggcaggctagggcctgagtctgttctctcacttcaatcaggtcttactgtcctatcctggggcccatcaccctgctagctactgaaataataaaagctcatcacctcataaggatagtttacattctaacagttgtgaaacattaacacttgcaggggtgtagtgactaatacctgtagtcctggcactttggaaggctcaggaggaaggactgtttgagcccaggagtttaagaccagcctgggcaacacagtgagaccctgtctctacaaaaatcaaaaagttggctggacatggtgacatacacccatagttctaactactccagaagctggggcaggaggatcacttgagcccaagagattgaggctgcagtgagccatgatcacaccactgcactccagcctgagcaacagagtgagaccctgtctcaaaaaaaaggggaaaaaaagaaaacacaaaaactttcactgtccacaaaaataaagctatgaaggatctctctggtgcttcctcaaattactaatgtctacttacaaggccagttctattcaaagcatgtatgttcagaagggtaactcaaacaattaattgccatttgtctgtctgcttcttagaaatgcctacaactacctatatctcatttgctcggttgaactccatatttgcattcttcattgcccttttcagtgtatcaggcaaaattagcaaagacttttcattgtcccataccagtatacccttgaaataactcaaattctagtagaaatctgaagtgagaggtaactgtattatgtcttaaggatttctgaaagttttattttatttgttttttattttttttatttttatttttactttttttgagacagagtctcgctctgtcgcccagcctggagtgcagtggtgcaatcttggctcactgcaagctccacctcctgggttcacaccattctcctgcctcagcctcctgagtagctgggactacaggcgcccgccaccacgcctggctaattttttgtatttttagtagagacggggtttcaccctgttagccaggatggtctcgatatcctgacctcgcgatccgcccgcctcggcctcccaaagtgctgggattacaggcgtgagccacagcgcccggcttatttgttttttaagtctacctgaggatgttatatctccttaccaggagacattttcctcaacacaatctaaccacttcaacatttagatcccaatcacttctctctcgaggtttaatgttctaagctcaggggatccttaggactcagccgtgtgatctccagttacttaactttctggcttcagtattctgctcagtgaaatgggactaacaaattaagagacaacctaatttatactttaccctatctcaggctctttttttttttccagctcctcaataacagaaactgtaaactattaggaaaagaaaataaatgtcctttaaaaactacatgaggctggacgcagtggctcatgcctgtaatctcagcactttgggagggtgaggtaggtggatcacttgaggtcaggagcttgagaccagcctggccgacatggtgaaaccccgtctctactaagaaaaaaaaaaaaaaaattagccaggcatggtggagcatgcctgtagtcccagctactctgaaggctgaagcagaagaatcacttgaacctgaggcacagaggttgcaacgaaccaagatcgcgccactgcactccagcctaggtgacagagcgagactccatctcaaggaaaaaataaaaataaataaaaacaaaaactctacatgaaatatttttaagatgatgattagctagtgtgtgctggtaatccctttagtaacatttatataaaacagtgtataacattcaaggaaacggggaagtatgaaaaaatccatcataaaatcatgacataagtagaacaagaggacaaatctacatggcagaagcgggtgtaagtttttttctctacattaacattttttttaatgtgaggaactaccactataaatattgttttaggggaaggcaaattggtagagcacaataaacctaagaaagaagaaacttaatttctaatattcatcctgtcatttatttatttaaataaattatgtgccttacacactcacttatctgagtttcgacagacatttcacaagtccaaactggcctcatttctcttttgctttctgtaccatcttctacctagtcacccgagtagaaacttgaagtcactctacaactttcttttccaaatccaagtcctattgctgatctcaagcatctctatacgggtccctccttcttgccccaggatacctttatcttggcccttgtcacaccatggtcccactttgccagtatcccccagagccacaggcccccagatttgtttgctgtttgtctccacagcccagccaagtcccatccctagactgtagctccttgaaaaatgagtaagagtgagacactgggtctaaaattcttttaagaccaggcattgaagacttactttattttattcttatattttagaagtctggagacttactttattttattcttatattttagaagtctgtatctaaatcttaggaaggtagttctattaaacgcagaccaaagacattaataacatcaaacacatcttcctttccttttctaacacgtgcagtttgttaagattgccatagaatgactagacattgaatcaagggggggaaaatcactctcatcatcattatttttaaaacataattcagcaaaagatctcttcaggaattgttaggaaagaggtgactttagatatgaatttcacgtaacacacttttattggtattgaataaggtattgaaacaaaatacattacaaattccccagcgtccttaaaaagaaaatcaaacctaattcttcatgacaacctgcagtggtttctctgttttgctatcactctagagggagggggacatttagatgatgaagaacagagagctgaatgccacaggaccatcattattgggccaggtggagagaagcacctttaatctctccattgctaaacaaccacctagcagtgagaactttctgagcagtgtgctaatacctttagaagtaagtaagaggcagatggatacgtgccactccagacacacaaacgtgatgcccagaccttcaaggattgcaatatgcaggttgggggagccatctgagccttccctccagcagcgagaaggtggaatgcttccgtcacgtgtctgaagctgaccatctgctcaacagttaggctgttactggctgtttcccttgccttttctaatctctgccactgctgaagcattcaatttttgctgctcctgctgtttggaactctgctttcttattcgaatctgtcacctgtatgtttctattggagccctccagttttttctggtcagtgaaccaatcacagcatttggttcctgggctgtctgtggctgtttttattgtatttcagagatgcattttttaactaaacaaaaaaataaagatgcctggaagagagaccatttaatacactactaaaaatgactgcattaagtttaatttgaattatttgttcaatagtggtttttgttctgtttgtagtgttttgctttgttttaggtccccagtatgtgtaatgcactatcctgcacttcagtggcagtacaaagatgagagaaacatggtccctcaaccttccataagattattatttagggcagactttaattctttaccattaaaatgatttaattggagctacaagacttctatactttcatacaggacatgtatacagaaggtaccattaaaaacagaacaaatgtggtatgtgagagcagaatgagagattactccagaatgtgtactcataaggacagaggttttggagtcacatagagatggcttcaaattgtggctctgctatttgctggccatataaactcaagaggcttaatcctctaagagcctcagtgtttctgcctgcaaaatgggaaatgattatctcaaagctatggagagaactataggaaagaatctaagaaaagaacctaacatgaatttggcattcaataagttaatcaaagcattttgttttcaagcaggggcattcagaggctgatgatacagaatcacggctatgagagcatgggcatttgagtctgagaacccagggttagaatcccattagggcttctgacaagccatgtgacttcacacacattatttggccttctggaatctatgtcataggatagtgaggaaagaagtgctatatgttagtctgtcaattatttagcacagggcccagcatatctgaagtgttcagtaaatagtaaccattattatattatttataattgggaagctttcattcaaatagtagatactgagttaggccatgaggtattaatagaattatggcatataagaattaggaaagacagcagaaaccatcagctggaatagagactaaggcgtgaggagtatgcagtaaagttagaccctaacaaagcagcaagaaatcaggctaacaagttaaagttgaagctggaatgtggagagaacaaaatgccccgtacaactgtgttatctttaacatataaatgtaattttgtggctcggtacagtggctcatgcctgtaatcccagcactttgggaggccgagatgggtggatcacctgaggtcaggagtttgagaccggcctggccaatatggtgaaaccccgtctctggtaaaaatacaaaaaattagccgggcatggtggcaggcatctgatacctctctacttgggaggctgagacaggagaattgcttgaacccaggaggtggaggttgcagtgagcccagatcagtcactccagcctgggcaacaagggtgaaacttcatctcaaaaaaaataaataaataaaaataaataaatgtaattttgtgctatttcactgaaaggcctcccaattgatgtgattaatatttttaaaaatcactccttgcaactgtggaatacataatagatgcaacacaaactagaataaataaatgtgtcataaaatccctacatttttttcatagaaaaccgaatgcaggttatacaaatttaattcttatttgcacaactgaccctacaattccttgtaaagtgtatctattttttcttttagaaagataaaaatagtgaaatctctttcattttacagaaacaaaaaaatggacctattcagtttagttggtgtgtactgtcataacaaatctcacaaatacaaccaacatgattttaaaatgattgcctttgatcctccaaccttcagcattttctaactgactcattaagccaggaacacaggctagctgtggctcttctgtcgttaaaaatatatataaaacctcagaatgttatactatggcatctacccacttgagcaactatagaaaataaatgagggaaagtaaggtgaaaaaagagaagcttaagtcttagttgagtttccttatttaaattctgcacattaaaacatattttatgcaactggaagatttcaagtatgcaaatatgcttgtttctccactaagaagctttgcaacattaggcaatttatttgggccttagtttgtgcaagaataaaaagatgggggccagctgggtgtggtggtgcatacctgtagtcctagctactcaggagcctgaggcagcaggttcacatgggcccaggagtttaagaccagcctgggcaacatagcgagacactgtcttaaaaaaaaaaatacagataacatcccatgagcaaatccataaatttaaaatatgtgtgatttttttgttttggtatgaaatgtaaaaaggcagggtgtggtggctcatgcctataatctcaacactttgggaggccaaggtgggaggatcacatgagcccaggagtttgagaccagcttgggcaacattgcagaccatgcctaaggaaaaaaaacataaaaagaatggggcctggtgtatctataagatccctcccagctgacaaattacataactctaaagttcaaccaattatttttagagaataatgtttaacccttgggggaggaggaaatacatattaatccaactacatggcctttgcattgaaagtttagaagcgttaaactgagagtaatgtaaagcataattacattaaaataatggcatataagaaggggattcatacttaacatccatcatttgagatagtagggggtacaaaatgggaaacaaaacaaccatgttacccacacaaaagcaaagattatttggtttgatttcttaagcaagaaaaatcctaaaccagaaaagtagcataacaggtgagaacacaatactgaaggcaaattagatcgaaaagctgtgatatcaaagctctgagaaaagaaagacagcaatgataatcatcctaacacaattattttctttaaatcttaataattttaatccattctgcagtctcaaagaaagaaagcattatctaacagttcttttccctcctcctacacaaaagtgcttgtgtctttacgagtcaccacggtgagcagttttaaagagggctcttagcttctactctctatctgtaagagtgttcatttcgtttacatggctccaaaacaaacgatcacattcctttcttcagcatctcccaccacagaatggtaaaagaataaatgtttactataaatgacgtttacatattaacaaagaatagaaatcagaattttctacttactttccctaatattttaggaaagaaataacataattttataataaaaattatctttttctactttgggttctacaatattctctcacagacctacaaaatcagtaacacttgttcagagacactccccagagctacatttaaaagaaagtagaaaacatttcactgttccatacaggaacaaaaaacaaaaaacaaaaaacaatttcatagacttccctagagtactcatttctctgtaaataacaataatgtttaaagaaaaaaaacataaccagtgacaatcatatttaaggacaagaagaaagttaaatttgccaaaacccatccctgaaacacatgatgactgtttagtacattaactcagcaatcgtcacagaatttaagctcccaaagttgtaaacaaaatatagagcgctcttttgttcatgacatgtcatgaacaaattaccaaaatgtgttttctcctcaggtgtcagtttttccctcttttagtgactgatggctcccagtgttattacagaaacagattgatctttttaatgagccagtttaatagactccaaaatctcaccgtggctgctcatccatgtcagaccatatgcaccaacaaaacattcagtaaaacaaaaaaagctctgctgtcagacagctccatactctataaaatttcatatagtagatctggatatacagataaataaccagagaagaggaaaatgcatatgcaaacaagatgcagaaaatatatgcaaaaagaaaaaatactgtagaggcccatattttcttggctctgatcaaattcccacaagatacaaatgtatttacacaacatattctcattacccttcctcctaactctaaggaaacccatttgccatctttgagatataatgtatatttcagtgccccatttgataaagaatgttccatccaaagattaaccatgtgaactctgactctggcaaccatccatgaaaaaccaaagggaaaatcagaccaaagactctttttaggagagttctacctgactgaatgcatacactgatgcatgcacagcgacagagcatcaaaacaagaatgctgagcctctgtggaatttaagatgaagttttcatatcagtgttaacatactgcccagcacttaccttaagactgtgcaaggatagtcaaaagtcacaatacattcaaatatgaaatactgggaaagagctggtgggaaaatagctggaaatacagagaaatgaatgaaacagattttcatattccctgttatggttatttagcagttcagaatgccagagtaagttgtgtccattttcaattttgcctgcaggatcatctctacatttatcttagctatctaaatctttccctgttacactctcctccaccccaacaaccctaaataaatttccttcttccaattttccatcgagtctctccttcattcttttaccatggagctaaaacatctcagtatctgtatgtcatactcattttctgcagggtaaatcagttcaggtcaaacaggaatgcacatgtaaatcacctattgttgagccacctcttggttttcagcatcatgtggacatgccactcaggcatcaggattaagcagttccctttaaaagctaaagcactaagtgctctattttactcttaaatgtgaccaacaaaatatgatttgcaagaataagaaagtagctctgtttgtaggtcatatatgaaggtaggcctacaatacgtcaaaaggggactaatatttaactgtttgctttaggaattttaaactattaagaggttctatgtcaaggggaacaaaattacagagattgtagcataaaaactgcttaacagaggattatgtaataacagtatgtaaactggctggcttttaaataacattctgatttgcaaagcagctaatacatttaaggatagctaagtcagtcacaaatagatgtctctgagcagctccaaagatcttaagctcctatgaatgtggaacataactgtgtcagggtgttaacctctcaaaggctgttatacccatgcctgatgaaatgcagcaaaagagaacagataagcagagaaagaaagcaaagtatatgctaaataagtttttgaatatagtttcattgtaaaattctccatatttcaaaaacactatgcaaaatgatgctaataagactttgcattcctatatcagaagataattatagatgaggatgaggtattcataaaaattattttactacggtaaatgggaaatttcatgtgtatgctttattcaacaattactctgtagggtttaatggagaagtggttttattttacatttcttagaattcttagttatgagagcacagtatctgatagaacagtatctaacaagtaaaattttcagcaaaaataccatctattgtctctactgtataactcttatcttcactcagttcatctagtgtcccagaagttttctcttagttcatatacaaaccaaaacaaataactactgtactgtgttaagaaatacatacagacaagcttccaaaccatcacattttaaggaaactaggaacagccaatttcagaatattgaagtaaaatatgtggttgggttaaattacataatgaatgagaattttaatattgatgtgcatctaagagccatcagtggtacttggcaaatcagaaaaatcattcgtcttcaccatttcgctttaatactacaagcagaaaagattaacctacacaaaagccaaactgtcccaggccagagattcaaaactctgtaaaatcccaggccagagccagattctcaagatggccacaatggcttattgctattgtgcaagaatgacataggccagcggtttaattgtgacatgaaatgtttcctcatgccacaggtatgggaaaaaggtcatggttcatccaggctcctcctccctctcacctgtctggagttcgcctcttcccgttttcgttcacatcgagaagcagctctgaggagtcaacaggtgaggtggtgctggcatccagaagcagctgttcatgctgggcgaggtactgggcagggttctgtttggccagtcttgcgcagtggaggagctcacgctgcagcaggggcaagttggcctgcaagggaatgacaggaatgagaggacggactgaaagttttcttctgtcctgttgacttactctgcttttcgaacactggagaagagtatgcaatgcagctacatcaaaggtcaaatgcatgccatgggctggaaccacaggcacaattctcagcactgggctaccatgtgcgcagattgccctaagtgtgaggtgactgacccttgtacatcactttacctctcttttatttcttcactgataacattgcaagtggcacattatttttagggtccctttatacttgaatgtatgttctacggtatgtgagaacctagctccaatcataagaacttttgttctccacagggaagatagagggtataaaaaatatatacacagtccaattaatttcagaatagtttccctgacacactcaattttgtatctggtgactcacaaaggtcaagcaggctaatcccagaaaatatcttttgtcaagtactaacttaatgaaaatacacttaaaaatatagacatgaacatagagattattttccatagtcatcaagttcagacaatagttaagtaatggcctgggtacagtcacatatcccagatggaattaatgcataaagcagtatattctagtagtctacaaaagtaaactgccttctttgtatcagtcttattctaaggaatgaatacacacacacacacacacacacacacacacacacacacacatatttcttctaatgttagaagaaatcctgtatactggtcactcttcctcctcagctaggtcagcaccttgaataaagaacgggctggttgataggctgatcggtaattctggcaatttcaaatgtaataagagagaaagaggcaatttcacacatagtaaaggcattaaaatgaaaacctaagaaggcattttactctgaacttactttgacattataaatccagattgtcattgccttctctttctcttatttttattattgtttggggaggggcagtaagggagaggaaaggagaagatactgggaagagtgaacagcactcatccccaatcacacttaattccaggaaagatcaatcacataaatctctttgcaacttgaagatttcatttgtaggaaccaggtgccatgtacaccgattaacccatcaggtagaaaagcatttctgaatacaggagaggtcccagctgcctcaatttttgggcccaacagccttaaaaaatagccttctagagaatcatggacaggaactacggctggctacttgtacctcaaattcattttttttttccttcagtgctctttatttctttatgtagagccaagtttctggcctatatcattttcctttactctgaagaactccttttaacttttttttttttttgtgagttccaggatacaggtgcagagtgtggaggtttgttacataagtagatgtgtgccatggtcgtttgttgcacctatcaacccattatctaggttttaagccccatatatgttagctatttgtcctaatgctttctctcccctcacccaccaaccgccctcaagtcagttttctaagagtattaatcaagaaaccatctcataatcacaccaaagcatatttctacacaagatataaaatactaggatatttgctaaagataaatgcatgccatacactgtaacaatggaaatgacttcctacaggataacaatgctaaaattaaactctttgtaattagtaaagatgaacatgtgggtaatatattgtatatattttttaaactattttttgtcctcagtaaagagagagcttagataccttgtgtcataaaataataaagcaaaaataacatttctatgtgaacatttttaaagtttttaaaattcatcctgggctgggtgtagtggcttgctcacgcctgtaatcccagcacttccagaggctgaggtgggtgtatcacttgaggtcaggagttcaagaccagcctggccaacatggtgaaaccccattcctactaaaaacacaaacaattagctgggtgtggtggcacgcacctgtaatcccagctacgtgggagtctgaggcaagagaatagcttgaaaccaggagatggaggttgcagtgagccgagattataccaccacacttgcctgggcaacagagcgagactcagtctaattaaaaaaaaaaaaaatcattctgaagtacagtcatgcactgattaacaatggggatgcattctgagagatgcattgttacatgatttcgtcacgcaaacatcaaaagcgggtacttaaacctagtactacacacctagaatatatggtatagtctacggctcctaggctataaacatgtacagcatgtactgtactgaatactgtaggcaactatagcacaatgacaagtatttacatctctgaccatagaaaaacacttcaggaggtcaaggcaggcaggtcacttaagcccaggagtttgagaccagcctgggcaacatggtgaaacctcatctctacaaaaaatacaaaatcggttggatgcagtggcccatgcctatagtccctgctattgggaggctaaagtgagaggactgtttgaacccaagaggtcgaggctccaatgagccatgaccgtgccactgcactccagcctgggtaacagagcgagactttgtttcaaaaaaaaaaaaaaaaaaaagaaagaaagaaaaagaaaaggacacaataaaaatatgatttataatcttatgggactaccattgtacatgcagtccatcattgtctgaaacattatatgtagcacatgactgtatatgcataagatttaaattgtccaaaacaatacactgcaaagctctctgctcttggttctttagggatcccaaagataagaaatcctagaacaagaaatggagtaacaaatgaggagacaaaaaacagtatcttcaggactctattagcagagcatgatattcagaacgatgaggaagcgggggggaagtgaagactgttgcttgactttactaatactgtctcccacattcttcttatcaaaaagaattatttgggtgccacatatctctctctctctctctctctcacacacacacacacacacacacacacacacacacacacacgagactatgtgccattctgtattaaatagagtcagctgggacctcaggtaaaggctctatctgaacatatagagacctttctaaaacaatcatattccttctgttaagaatgccagcaatattgaaccaagcaggcaaacatagttatgccagctcagagagacaaattcctgaatgataatcaggagaattgactcacaggctggacatcttgtgtgcagatgtcttttggcaaagcattcgctggctcccatccagaaacagccttaatatattcagtacaagagttgatttttaagatacattaaatagtacttctggagagaagttataaaatgcacatttatttggctatgtgttatagatagatagcaatttcttagtttcaggatgaagcaaatatattttcacaaaagagactatagaaattgggtgtggttaaagcataaactttttcattgatgtctaaaaattaagatactaataagaaaagatgctgtatctatgactgctttcactgaagaagttttctttagaattcatcttatctgtgttttggtaggctcctaacctcatgtttaatacattcattgccacacagctgagtgactaatgggaaacatgcatgcctccagtttcaaatttaaacgtatggatggtacaagacaagaggcttccacacgtggtactcagtttaatttagcgattccataaacatcttcttccaatttaaaaaatatggtaatacaaagcaattttgtttgctctaattctggtgccagattaggtaattagaatggtgtctaatatccttccagtaaatgtttctccataaatgcaaaatggaatagagggtctgcgggttacattagcttaatgaaaacaagactttaatgcatattgttacagcagtgtttgaatgcacttattaaggcccgagttcccacaaccatatggtttttgtcattaatgtctcctttgaggaaaagcactaaaattagaaaaaaaagttatatctttgattccaatgatcccaactaaatgatatggtaaccatatggtgtgcagcagtgatagaagaatctggaagtgtccttgtaagctttttaaattttttttggctgccaacttgaccctgaaaggagcctattttttctttcttcttcttcttttttttttttttcttttttagcacagaaaccagtggtatttgcacaggaaatggcattcatatgatgaaatctttacagaaaacaacgctttctgagaaaggcaaagattctagtctcaacaaacttgttcaaattgttcaacaaacaatttgcttttaaataagaatatagtattatagtataagccattttgggagaaaacactaacacattatacctttaaccttaaatgtacaacttagaaaagaacgaaaagaatataattgtaatctgggtttccacacaaacagatctaatttctggtttgtaggtactcacaaagcagaatatttcatttcaccttaataataacaacaggaaagactaatatccagaaagttcagaattggggctcatttcagacaaacctttctaggcttctggatacttacttgaaccttatgtgtctgatacagttttaaaaatagatgaaatttcacacaggatctgatcagttatatttctggtgtctcccaaacaaagttctaggaaccagacagaaaggtaaatcctccttggcaaataattaaatcagaggcttccttgagtgctcattttgaaagtgaccttcaaaggggagtgcaaatgaaactttcacatttatcaatctgctaagcccactgttagtataaacttattgagaatccactatgcccaagcaatatgcttacccaagtaaaagggatcttagtaatctgcttttctaccaaaactaccagttattttagtatccatcagtgaattaactacccgctatgctgaataaaaatgttccttctttctcttgtgaactttgtgtttgtttgttttccagttgctttactgaagtggcagcagttggaggagacagaaagctcacagcagagacttaaaaaccatttcgaatcccacacctcaatcagtcctcagccaggcacaccttggacatgtcacttactcccaacttcttcactggcacaaaaggatgacggtctgatcttcccgttaagttgttacaaagataaaattaggaggataaaaaaatcctgaacaactacaaagctcaaccaatcttctgttcactctaaagacaagcaaaatgtaaaataacatatctcatatgaccaaaaaaatgaacaaaacctttattcaaagagacttctaaactcttcttcaaactttacttcttttcaggtaattatttaaaacactccttgtaattttcagactacttaggaaatggtcataaatacaatcgattcagatagttttcatccattaaattaaatcaaagagcccctaaatgtactaaaaaagcacacagttatgacctagcaacaatatggtttaaaatactttacagaccagtgaactgtgcaataccttcaaaaatgggatgacaaaaggtctcagtgggaagttagtagcttcttgcagtttggaatgaaattcttcaattgtcaaagtggagttctatggaagaaaatatgtagtataaatacattagcctgttggtaaatagtaaaaacacaaacaaattaattattaagactggtacaacacagtgtaataacaagcaaacatactgacagaaaccagtattttcaataaaacctattgactttgtaaaaatgatcacacagtttattgcatcactcacttctaaaacctacatctgaaaatgaaacacattatgtatagtactttgaggataatgtgcatgatcactagcatggtttaattatcagagaagtctttgcaattatgaagaatcttctaatattgcctttatggaaaacaaacacacttggatgtatttaaaagcataacagatcacttaaaggaccgagggcaagtgtcagaattctcagtcaagatttatcccacgtgtcacatcagcactactgctggtggaaatattcttctcctcctcctgtatttccatcttgtattctttctttgtctgccaaagcatctttgctcagggtgaacatcaaagttgggtagtgtgctatgccaataaagccaaagaaaaggtttgacccttctgtgagtcaatgagttttgtagaaggtgaaagaaaaatcccaattatcgaagacattccacttatcctagaggcaactgcttgacccaaacaagactaagcaaaattaactcagattcacttctaacctaccttatataaaaaaacaagccccaaatactcaggatttgtatcctacaatagataatgtgtgttggtaaaagcatctacttaatgaacaacaaagcaattataaaggcattgagtaaattaaccctcatttcattcgttttctttagtttctcaggcaggatcacaactcattctcaacttcttcagtcccttcaataattctgatgactgacaaaatttgggaatttgtgacctaacgtcattacaatattgctccacccacttttttgtgcatgtttccttttataacaaagtacacgagcaccaagttctaagttcttcatacccccacactcaaaacatcttcatatgaaactatgaataaacaataacttcctatgtgtaacaataaatgtcaaggagccaattttttaaaatctatcattttgtttctatgactccttttcaaaaggacagtacttccggtccagtgcagtggctcacgcctgtaatcccagtagctttgggaggccaaggtgggagtgtcacttgagcccaggagtttgagaccagccagagcatcaaagtgagatgatgtcacaaaaaaattagccaggtgtggtggtgtgtgcctctagtttcaggggaggctgggaagggaggattgcttatgcttggaaggtcaaggctgcggtgagccttgctggcaccgatgcgaatgcattgggtgacagagaacgggtatgggtgacagagaaagaccctgtctcaaaaaaattactaaaaaaaaatgtttaaaagaaaaaacaaaaaagacagtacttcctaacattttcttaactccacctaagcatcagcatgatttagtacctaggttcaaatctgtcactaccagttgggtggccttgcatattttacttaacctctataacctcagtttgcccatgtgtcaaatgtgtataaaaatcactccctcaaaaaaaaaaaaaaatcactctctcaaatggtagtcctgagaattatgtaaaatggcttgtaagccaaatgtttaacagaagtctgctactcaatgaatatttactgcctattatatgcaagttataatgaattaatgtcctcccctattttcctctctaggcttttagattttaaaaaatatattttttaaaagtatttcacacaaaagtatgccacttgggaaaaatctacttaaagctaccaagtttttctgcattttcaattatggaaccactgttaataaagaacatgtcaaatttataaggcaattttcaaaaaaaaaaaattttgctaagaacaacacattcaccatttacttgatacaattattactttggatttactttgtggttccttggtctaacttatttacatgttaaaaaagcttattatgcaaattcaagaatgaataaaaaggaaaagataagtgactgacaaaagtatctgaagtatgccaacacaccttttgtgaaaatcaccttcctgtcttggaagtttatgaggtggagctgatggactgtgagaaacatggaagtcttttgttcttggagtagggaggagaggcagttaatggttaaaaattaaattgcaaaatctctgtcaaatgtgggatatagtgatttgaagcatgtcttctgagctagtctcttacccagacttctaattctgaaacttcttttgcaaaacacaactggtatggctttgcccctgataggtccatataataaaaataaataatctatttcaagaaagtggagacgaccataaccctggacaatgaaagaactgcatatacgattcatagcttctccgtgactcagtttgatatgggagactagccttcctaaatactcgaaaatcctccacttctacagaaaatcacaacacatggaaaagtgacttagaacgcaaaaaaagatatatgttctattttctagtgtgacaatgtgcagaacgtagtgtaatatgcaaaaaccaacagttctcttctcaaactagtggtttcggtaattctacctataacaaagatttattttttttaacaaaaaagaattagtgtttaccaggagctggggataaaagagatgaggagttactgttttatgaatacagaaggtttcggattgaggtgatgaaaaagttctggagatggacagtggtggtggctatacagcaatgtgaatatacataatgccaccaaactgtacacttaaaaatggttaaaatgatgaactgtatgtatattttaccacaataaaaaatttcaatgttattcatcttaaaaatgacactagataaaagaagaatgtgttgttacaaattcttgttcatctgggccaatgataaaaatccgctaaagcaatgaaattaaaatgagcatccaattagattgagtgactcaacataacaaaaccattttgtcatcattgaaaaccactaggcatgccaggaaagtgtacttactgaaatactgaaatacacgtgcacatacacacacacacacacacacatttatatatataacatgtttatggccaatataacaataaatttgtataaccatatctttattagtcaaacagtgagaaaaaaaactctggtggggtcaatatataatgcagaatttaaaagactgtcactatagcatgaatcagacttgcacacaatcttcagatgtagaaactattataacaaaatacttgcgagaacggtgtctacatgtctgagtctcccacccacactatcccttacaccaagaaaactgggttggtttccatttgcttaccactagtcccagaacgagggtgcgaactctttctcctatctcgggtgaaatgtcattgccaaactgctgcagggtagtaaggaaccttttcagcttgctgagttgcctggcaccacaggctgggggcagctgttgattagccagagaggaggaggaagaagaggaaggcccattgctgaagccattgggtggtgagggggcgccattcaaggctgtaggagaatggctcgtgccattagttactgtcaagagcacaaaatcagaaggaagtcataaacttacagagaacatgcatgaggaaattgccaccaagtttcctaccttttacatctactagttttataagtttttaaatgttgggactttttaaaaatgcttggacttcacagggttactacattctcaggtactctataactaaatgggtctactcctcatactgagtgatggtatcctgcacagaggctgacaataaatggagtctgctgcaacccagggccagccctgcctcccatgtgcacatatgccaaccacctgaaatgtttcaaaaatagaacagacagcttcggatgtcagctttttgtcgcaggcttacatcaatataacaggactattcctttccaaactgctcccctagagaaagtgtacatttggtggagactaaatttatcattgaacatttttaatcatgttttgtacacacaactgacagctgtgtttataggaataggactttcaagttttaaccttccaccacccaattagaaggctattttctccccctcatacttcttaaccacttctttaggaaaaatgcatattttatgtacaaagccaaaatggatatggtgtttaacaaggagttacttcaagaaatcaaaaagggacacctaaatccagccaagagcatggagtggtgataattcagtaaattcatttctgataaaatttgtttgaacatcaagacgataatccctgtcactctgtaacccattaatatgtacattaataagtacataaaaagaaagcaaaaagttgataatccataagaactagaattaaaaatctgcatcgtttgcattaaagaaaatgttgattttatcatgttaagtcaattaatttgataagcagacctttatcaaacccatctttttaatataattttgatatagtttgaaaatgttttaaagaccatgttatgcttaaaagttcaattttgacataataaaatggttctcttgtcacaactgagtatcataataacctgtcaagaaatgccagctcaccaggacatctcacaggagacatatgcttacccctgtggctttgggtaacaacaaaccaaatataagatgacacggttacaacttggcattgcacagtcacctgctccttacacatttggaaaggtcttttaaatggcagtgcaacactgcataaacagcctgagatgcgtactttgctaatcccttatagtcccaaagatctacttttgccttttagttatttttcattcatatggatttcatggcacatggtgtgcaaaatagctgcaaccgataacatttattagtttcacaattccttgatgacaatttcaaccaggactttgagatttattaaaacagttactcactatccctaatgaaatacacaggaaagaatgggaagttgcaattctgtcagaattctctatcctttcctttggactgtactgaaagcaatacactctattgagagaactcagaacttgagccaagcaggaatggagtaaagttttaataagagtctgacaggttcaagacaagaaagacacgaccgggtgcggtggctcacgcctgtaatcccagcactttgggaggccgaggtgggagcatcacgaggtcggaagttcaagaccagcctgaccaacatggtgaaaccccgtatctactaaaaatatgaaaattagctgggctcagtggcgcatgactgtaatcccagctactcaggaggctgaggcaggagaatcgcttgaacttgggaggcagaggttgcagtgagctgagatcgtgccactgcactccagcctgggtgacagagcgagattctgtcctccccctccacccaaaaaaaagggcaagaaaggcacttctcacttcagaaagttttctgtatgatattgttgcatatcaataccctttttaacacaaggatattatattttaacattatttgtaaccacttgaaatagatgaaaatggtgttagaagaagtaacctagaaataataatagcacatttccatgttccaagtcatgctgaacaaactaaaataaagagctccacattaagatgaattagaagttacagtggtaacaactggaattacagaccaaatgctgcttcatttgctaaaatcatagcagactgcaacttcgaagcaataatgaaaaggaaggcaaatattggcagtcacacaaattagacctaagctatgatacttctgtgctcagtacctacttactggcaaacaaatgattttttttggttcatttctgcataatacattgatgctgaattttattttcccttgatttttcatttgcagaaaaaaatttaatttaaactttaaaactgaaactcaaaagcctgaaatgactacttacacgttgtcggtgtaaatgaactggttcttggagctccttgagtagttgggggaggtggcattgttggaggagtcagcctagattgcgtcttcacatccacaggtgagtctggcattgtggagtgcttctcagtacgatctggaggatgccaccaggaacatattattttactccttaagcacctcagtttttcaagtggggtttatcttttttaaaagcaagtgaacagaagaaattcaacatcttctatcaataaaatacacttatctactgacgtttaaatcaggattttatcatccaaaccccacttaagaaggtatagcacagatggcaggacctcatttgtaactaggttatattatatcctattgttatttctggcttaggcagatgctaccttggtagtgttatatgcagcagcacaactgcactggaagctgaagccaatgttagcaagaggtagaaaatagatgaggaagtgggatgataatgaacccctcatgacagctcagaaataacaaaaacctgaagtctgttatgcaggtgagatactggtaggagccagctctttgtaatgattttctcttacacctgccatccctgtgctgtccttagttttctggcctattagatgaaataggttatcgtcttccaggcatatttcgcatttcaatttttcctgccctgttttaaaaatcactgctacataggtgaaatgtgttatacaatgaagtgaaactattatttacttaaaaggtgtaaatttatgacctgccattttaaaagcatgaaaccaatactccaattaataatctcaaacagagttaagaatgtaaaagtcccaaacagagaactaaaaagaactagacactgctaatatttttttcatgagtatgtggcagatatgaagaaatttcctgattacccaataatggacattcatacttcagaactgctgtaagtatacttttcccttgacattctgaactgtttttctcaatctaatctacttatcaaagcaacagaccttttgatctgttcaaagcaatttcttaacactttggttataataaacatttaaaagttgaaataattttggtatcattttaaggaagctgcaataaaagaataaaaataatcatcattcaaataagagcatttgcacgatgagctagtcaacagcagtatcagagtctctatttttggttctttagatctaattctttcacaaatgtgtaggcacgcacatgaacacacacacacccaacgtattttgaggcacctcttgcagttatagacacaaatatctcacacttgggcttttagaaaagtgaagtaactattaagaaagaacaagcctttaaaaatgttataataaccacagtgagaaaatctcaaaatcacttaaaggtcaattattgaaagaaaaagaaaaacccaaattactactataacaattccaaatctacctcacttttgttcaaagcaattgcttaacacttgggttgcaataaaacacaacatttaaaagttgaaataatgttgatatcactttagggaagatgcaataagagaatgaaaataatcatcattctaataagagtatttgcacaataagctgttattattattattgatgagttaacagcaatatcagggtctccatttctgaatctatacttctggctgaataacaacggatgtccctatagtgaataaaagtgttctgagtgaaaggatggtagagacacacatgaagagcattttcacctttatctattgttaaaaacttgtcttcagattgctacaaccagtaagtcacttattctagaaaaatacagaagttaggcaggcttaaaaccgcttcttcaacagttaaattcatttgcacattctactcacctcaaccaacctcagcaacaagggaataaatagcttcccacttatgttgcagctgagggaagaggtacagcagcaaatacaagtctccctaaataaaggcaaatatttctgtcatgccaaggagggagggaaaaagggaggcttgccagagtcggctgggagataacagtgggaactgctggtccatctggttttcattctgctaacactcacacggaactgttagagaaggcagtccaga

SEQ ID NO: 15183 - DNA, 9153 bp, Human
agagtgagactccgtctcaaaagcaaacaaacaaacaaaaaacgaaaaccaaacaaacaaaaaaactctattgccattgtgggtctataaaaacctacccttaaactgaaaaaaataaataaaaacttgctgcaaaaaggacacgttgtggtctaattaatggctgaaggacagttctatataaatagaaattatttttcctgattgcttatgatctaattgtcaaaatagtgttagtattcaattgcctgtatgagtaattactctatcatatgtaaatgtttacatctcctcttacatctgaaacttgagtcacattttgaatatgtgaagtgtgttagcttcatatagggggaaaaaaactactcgcttatgaaataattgtaggtcgggcaccgtggctcatgtgtgtaatcccagcactttgggaggccgaggcgggcagatcatctgaggttgggagttcaagaccagcctgaccaaaatggagaaaccccatctctactaaaaatacaaaaattagccgggtgtggtgatgcatgcctgtaatcccagctactcaggaggctgaggcaggagaatcatttgaatctgggaggcggaggttgcggtgagctgagttcacgccattgcactccagcctgggcaacaagagtgaaactccgtctcaaaaaaaaaaaaaaaaattgtagaaaaggtagattctatgtgaatatataaaatgagctccaaatgatgaattaaaacaacaatatttcttattcagacaaaaatagcatactatttgtccctaaaaatcttaaaaagatttaaaatttaaacttccttgggttaacctgccaagaaagtccaataagcttctgttttgactgcaaataaaagcacacatacaaccagaataatctatttttctagcagcatatggttcctttgggaacttcagaaacaactgtgtttgtatgcttcagaattgtcacatggggaagctatctgagaattctcaaggcctgtttttattaaaggtttgtaatttggggcttggcccttgattttaaaaaatttacatattttagaggacaatgttatctcaattggttccatgtaaacacaaacaattgcagcttagatattttagtacaccaatgaaatgaatgaactttgttctgaatgaactaagaggaataaaggtattgctttatacctgtccctaattcaacatgtgtcacaatgacaaaggtaagctagctgcaattcatatgtaaataaagactaaaggtttcagatgttctatttctgcctccttccaattttagttataaaacataattatcatttggaactcaagatgaatagatttagcttaaagctttctcaattaagattatgtagtattagaattgcttgtttatttatttatttacttttttttttttaaattagagacagagtctcactatgttgcctaggctggagtacagtggctattcacaggcacaattatagataactaactatagcctctagcttctgggctcaagccatcctcctgccccagcctccccagtagctgggactacaggtgtgtgccaccatgcccaactgatttatttgttatatttttaattttaggaacactttaataaagttcaacaacacatttggattgctaaaaaaatccaaacttgtaaatatttttctcccatacttctagagggctctcttagtgaagaagaaacagttatctgttagtttcatctggtttctctctcttattacgtctaagtaaatgtaaatttaatatttttatttaaaaatagcatgcataatatgtatccagttttataaaattatttctatgtaccaagttatttatgcaccgatcactcctaatatctgagtgtctacatagagctgtcaagaaagatgttcacctaatattaatgatggttacttctttttttttttaagttcagctttttattgaacacgttataaaagaggtttagtcaaaaagaccaaggcccatgtcatcatcagactccttggattcttctttctttgcttccactttcttctcctcagctggagcagcagcagtggagggggcaggacgtcctgctggtgcagcaccagctgctggagcaggtccaccagcccctacattgcagatgaggctcccaatgttgacgttggccagggcctttgcaaacaagccaggccaaaaaggttcaacatttacaccggctgctttaatgagggcattgatcttatcctccgtgactgtcacctcatcgtcgtgcagaatgagggccgagtagatgcaggcgagcttggagacggaggccatggcacgggcgagtgtagggcaggcgctgccggacgcggtgctagtcgcaggatgaagtgagggccttaccccaacgcggccttagcttcctcggaaggaccgagcagcttggcggcagctgagggaaggggtcggtttcttctacatagtaagattttgttgacatttttttctttgtagtgattttctgttttgcttaaaatttaaataattaaattcagaaataataaagtcattactttcaaatataagaaaaagggcaaaattcatctggtagccacagtcattgcatttatttttgccagtggaaggtcccagaggaattagataatgcttctcatgtgccaattcttgaataattaaataaaaatgtctgtgatatacatgggtgtacacatgagtcaaataaatgatagataaggtctatcattcatttcttcaacagggaattgagcatttgagtgtcacatatgttcaattttcatcctaccagttggaaacaagttctgaattgtgttgataaaagtggaattcacgattagcaaagtaataagaaaagtatacctttagcttaagtaaaatggagaatccaagaaatgtggaaaactattctatcatttttctatacttataatacaaaattaaagaaatgttaaaagcaagtttataaagatataggcacactttttaaaggatgcatatttttagtaagctttgcagttttctagggagcaacactaaaatattctttaatttttgttgtagcaagatttataaaatttgatagtggtctgtgtaacatacatacaaacacaagtctaattaagcctcaagaaggttagtaagggttaggtaaccatactaagaaaatgctagtccttccattagttttatttagaagttggcttatttcactagcaacttgatcactcggggtatgcctgagaggacttaaaacagattttttttttttccagatggggtctcactctgtcgcccaggctggagtggaatggcgtgatcttggctcactgcagtcttaacctcccagggtgcaggtgatcctctcatctcagcctccttcctgagtagctgggactacaggcgcgcaccaccacacccagctaattttttgtagagatggggttttgccatgttgcccaggctggtctccaactcttggaatcaagcaatacgcctgcttcagactccccaaatgctagaattacaggtgtaagccactgcacctgactgtcagatatattctttttctaatggtattaggtatcttcatttggctgaaattatttaaatcctttggaggatctattacatagctgccattgttttggcttgcccagtattcgttttctgtccctctaacgacctgacactttttctgtgggaaaaggaacagctgattcccgtgcccgtgatggtgatacctgccctggcgcctgtgccagaattacattccaggtgttgctgttgcctcctgcgtgtggagtaccctccgaacctagtttcctagccctcctagagataactaaagttaatcatttttcttttttaagctacctttagtgggtccaatgtttgccactcagaacacagtgtgatgcactaccctcaaggaacttacaaactcagtagaaaggaagattggataagtccaaaaataatattaagtgctttattggcacttcacatgcttaggactgtgtccacacagcacaaaatgaagcggcaggctggcaagcatccagttgctttaacaaatttggcaatgcattgaaaacatagggctacaatgtcgatcataagatttctggagaagggaactccacaacttccactggtaattggctgctagctgcttcacagactctggcaatggagaagtgaagtcattcttttccccctccatctcttttggttcctaagaactttccttctcagctcaaagtgggaattttggactgagtgatgacaaagatcccaatactaattgcttctggcttagtttcatggttggattaattttaattccttctgtttccaaacccttctgtgctccacactgcactttgcatacatctttattatagaacaattgctgtttattgcaattacctgtatccatgtctgtctcctccagggcaggagatataacatattcatctttctagctctagcttctctaccatattcacttttgctgtgttgggtattatactcattttgcatattgtaattactgaagagatttttaaaaaagacttgtctgtttgcccactttggtcctgctagaaggtactccatcccatgcttgggttacagtgatgaagcaagaaagtctgtctctgtctcttctttttctgagactcttccggccactaacagcctctctgtacaggcctaccaatactgtccagtcagtagtagattaaggcagctctaggttctaattagcagtgttctatcttaacctagctgcttttaaaactgtatacaaagtttagtgtactcttctgcatgtatgttacattttacaatcaaaagaagtgaaataatgtacatttaaaaatatgtcatctcctaaatgagaaaaatgaggcacagagatgtggcctgatggctgaatgtacagccaggattgaagctacagtcatcagaacttttgtgttcctaatagctctctgggtttcttgaagccaggaggaggggagaacatcaggttacaattaagaatctctcggctgggtgcagtggctcacgcctgtaatcccagcactttgggaggctgaggcaggtggatcacctgaggtcaggtgtttgagaccagcctgaacaacatggtgaaaccctgtctctactaaaaatacaaaattaggtgggcgtggtggagggcgcctgtaatcccagctacttgggaggctgaggcagaaaaatcctttgaacccagaaggtggaggttgccgtgagccgagatcaggccattgcactccagcctgggcaacaagaacgaaactccatctcaagaataataataataataataattactctgttgaggtctgagtgataaaatgtcacctgacaccaaaagcactgcagtttatgtccccacagtagaaagaagggaagggctgcctggtgatggagggacagactgccagtggggccctttcccactcacccacactctaccagtcatttcaccattttttggttttgttttagtaaagactctggttaaagtatacatactcctcaaaaggggttatatattaacctactatattagttttccatttccatgtacaaattatctccaaacttagtggcttaaaccaacaggaagcatttgttaaacctcacaggttctgtgggtcaagaattctggagtggcttcactgggtgattctggcttaggatctttcagaaggttacagccaaatgtcagctgggctgcaatttgactgggcctaaaggattcacttccaacgtggttcgcttatggctggcaggtcagttctctccatttgagtctctctgtggggctgcttgagtatccttgcaacatggctactggcttccttcaaaacaagcaatctaaaaacccaaggtaaatgttgcaatgcctttatgacctagcctctgaacttgtatgctatcactttggaatgttctagcagtcacacaggtcagctctgatttagtgtggaagcgtctggacaaggacctgaagatctaggattgaggatcactaggggccatctgggaggctggcgaccacacccacctttagctccaattttaatttcaagttagctcagaaacaggagaaacatgggggtggactgaggtatggagggagactttaaagtggccccattgggagtgatagacccaaaagcaagctttatcagcctttccttgccctaaaggcagcttgaatcaggaagaaacagcctttgaaggaagttacagacctcagaacacacccttgcctaaaaagtatagataatatgattcttcctttaaggaaattgggtacagctgtgaaactcttgacaaatttcatgataatcactgttatctgactgggcagcagttttagtggctgctgcctctaccaagttgcagtgtacaatagcaatgtggtctcctcgtgacttactgtctctgtcttcagaatgtattgaacaatattaattcattggtggttgttttgaaaaacaggtttgtcattacaaatatgatataggttgggtgtgatggctcatgcctattatgtaattccagcactctgggaggctgatgcaggaggatggcttcagcccaggagttcaaaaccagcctggtcaacaaagtgagaccctgtctctacaaaatattagaaaattagccaggtgtggtggtgtgtgcctgtaatccctactcaggaggcagtggcaggaggatcccttgagcccaggaggctgaggctgcagtgcactgtgattgcctcacagcactccagtatgggcaatagagggagaccgtgtctaaataaagaaagaaagaaaagaaaatagaataaaaacaaatatacagtatacttatttccatgttctattttgctttaaaatgtttattagtatgtttaaaagctggtgtaagatcctcatagatgcattaatcaacacgttcacttgctcatttttcttttaattttagttttcaaaaatacccaaaggctacatccattacaaggtaatggactgcaaaatcttatttaattgcagtgaacatattcactgaaattacagaaaaggaaaaatatgtaattcagtacttctatcaatttaaaagaatcaaaataacctctggtaatgagcaagagagtgattctccatgctctccctctccatctcttccttccttctctcctcactgtagctttgtggattttaagaaagcaggagaccctgggccagagcatcttttgtactcagaaggccctggagacctgtggttgaaaactcctgggagatggatgtatctaacactctcctagcttgattttgatacagggctttagagtgactcaccaatagcaatttctagagccttctgcaaactgagaatgcttagccgcttaattgtgccaggggatccttgggccatgagcagttgcactgtctatgagttattctgttgtgttctctattcatttctaaggtggcgtgaaccttttttgaggtgactaactatggccttactcaaaccaatggtcttatttatgattcgtgaattgtcttattttaataaaatattttcccaggaatttacaagtaataattaaaaatagataaatcatacaaattcaggaatactttgtacactccaaattttctagcagatcctgatatcattacagatacaactatatttaattcaatctaagagggttacttcaaactgaattttcctgctgtctacttctggttcctcagggatcctataaaaaatccaaggaaattccttgctgattgcagagatattagactgcaacatatggtccacacatgtcattagtattcctctaaagaaaaatgcaaaggattatatttagaataccgggtatgtgttcagtggtttgaggtgacccaggagattattatattcttcttgtggaattttctgtagttaaaagatgaatccagaattctgactgtctggtttggacacgagtctatctgtaagtttttgcaggtgggaggcctgccaaattttcattattgggtggtgtcttaaaatctattcatcctcctcttaaggagaagatttttcaagtttcagagtttctcagatatattttagaggagtctttaaaatattttatttatgttttattttttagagacaaggtcttgctctgttacccaggttggagtgcagtggtgtgttcatagctcactgaagtctcaaactcctgagctcatgtgatcctaccacctcagcctcctgagtgcctgggaccacaggtttgcaccaccatgcatggctaattttttttttttttttttcggagacggaatcttgctctgtcacccaggatggagtgcagtggtgcagtctcggttcactgcaacgtttgcttcccgggcttaagcaattctcttgcctcagcctcctgaattaatagagatgaggtctcactatgttgcctagactggtcttgaactccttggctcaagcaatcctcctgcctgggcctcccaaaatgctgggattactgatgtgagctactgtgcctggcctagaggagtctttcgacacaggtaccttctaaagtaaaaaattaattatttatgaattatatgtcattggcccccaaataaaatgagttgagcttataatagtattgctagttttgcatctaccttaaataattctaaatttcaattcttcttgtcctcatgctttttttttttttttttttttttttttaccagagtcttgctctgtcgcccaggctggagtgcagtggtgcaatcttggctcactgcaacctctgcctcccagattcaagtgattctcctgcctcagcctcccgagtagctggtattacaggcgcccgccaccatgcccagctaatttttgtatttttaatacagacagggtttcaccatgttagccaggatggtctcgatttcctgaccttgtgatccgcccgcctcagcctcccaaagtgctgggattacaggtgtgagccacagctcccagccaccgcaattatatttgaccatatatgatgg

SEQ ID NO: 15184 - DNA, 9901 bp, Human
tttttttttttttttttaagacagggttgcactctgtttgcccaggctggagtgcagtggcacaattgtggctcactgcagcctcaacctcctgggctcaagtgatcctcccacctctgcctcctgagtagttgggacaacaagtgtgcactgccatgcctggctaaatttttgtgtttttttgtagagatgaagtttcatcatgttgcccaggctggtctcaaacccctgggttcaaggaatccctctggtctcccaaagtgctgagattgcaggcatgagccaccttgcccagccgataatctcctttttgccattaatgtaacaaaatcacaggagtgatagctcaacatgctcagaagttccaccaacacccagagaggaggggattattctagggaggttattgggcaccattcttagaattctgcctgctacaaaggtcgaagctgagggtttaaagataaagaaccacgtgagagccacaaaaccaaggtgggggtgagagccacagaaccgaggtgggggtgaggggctcagtgccagaatggaaacaggtcctctgggaaccggaaggcctcatcttcatgagggggacgagggaggaggtcaggactcacacctagaataatgggtgctccagggtgacctgccttgcaggaccatttactgggcttcagctgggatgcaggctcgtccatcgtcccagacgcaggtcagacccaagtgctttccttttggaagggcttggatttctagttaatgcggggggttgtacctttcattccaatgagggtcttctgatgttctaatgaaagccctgacaatgagggtgttatttggggaatgtgtacattttgtggggagaagtttcacagcttttttcagattccccaaggcatcaaagaaagggggaggtgggggaaaagaatcacgtattgaaagaatatcttgagaagcttaattcctatggctggaattaagttgcaataaacaattaagttgcaatgaagcaataaaccatgcttcgttgacccaattaagagacatggatgagttgttcaagtttttgaaatgtctgtagcactagactcacagttctgctgctctttgcttctttgctttcaaagggctcatgtcattggatcagagccacccggataatttcttttttttttttttttttttttttttactttttgagacagggactcactctgtttgcagtgatcacagacactacggccaaacacaaacctgagccacatgaactgagccaaacacaaaccctggctgggatcttgaaggtcatttagttcaactccccatttacagaggggcaaacaggttcagagaggaggtgacctgcccagggttatatatggagttgtagcaggggaggggacagcttgtcttcaaatttagattcatttcggttcatcacatcccaagtttttgtgatgacagtgtggggaaagagaattgagcctaacatgacccctccccagggcagggtgcgcggggttgtagtgtctgtggtcgctggcctgttgaaacccttcagtgcctctccgaagtcctcaggataaaatccacactccccttcctcaacatgcctctggcccccagagccatgggctggcctctggcatagcacttatcagaggtccgtgcccatggccatcggcctgtgggtccatcccttcagcagaccgtgagtgtcgctggctgtgggggttgaggggaccaaggggaccgagctgtgtcccctctgttccctggggcccagcccagtgcctggaccacagcatgtgctcatagagggtgtggaaagaaggagcaaaacaacatacgaacgcgtttcctgatactcctgagcctaacatgccccctccccaccccaagtatgctgggcctgccccacagccagcgagaagaagagattctgggaagagttgcaacaattcatctttatttcttattttcctctggagatgcagaatttggtatatttcaccccaggtatatttgggatagttggctcctcgctgggtcaggatggctgggtgccttctcccctggcatggttctcttctctgcagggcgaggggcagggagctagtagaacctcgcaatgacagccgcaatggcagacccaatggagcccaggatgaacttggtcaatccggagagtccagttgctcctgggaagaagcagagggtggacagagtgggacatgcctgtcggggaagctctgtgggcaggactgtggggtcagagactccagtgaccctcagcaggggctgaggcttacagaccccacccagttcccctctctgtttcccagtaccctcggggtctttgtttggggagaggctgctgcaggcatgaacccccatggtgaactccagagctagaagcagcctcgctcttcagggaaggaggctgcaccccagaggggaggagacgccccaggtaacccagcaaatctgcttcgggctgagtcttcctgagtgcactgttcctggcttgggctccttccctccctcctccatctccctcagagaaaccctgagagaatgtgtagagagagacagaggaacagggagattgaggttcatagggttgagattgggactgggtccttggaggctcttgccctcctcatcgccctccccagcaagccccgccaggatacttacccagtgactgcagagtagccacaaggctgcccgaggcaactccacccccattggcaatggccgccgcggacatcatcttggctgctatggaggacgaggcgattcccgccgcagtgaagcccatggcactgagcaccatgggcacagccgccatggccacaactgcagggaagaggagctgggtcggtgcgtgggctcagaagggacccccccagatacactgagtcaggcttggggaccccaggggatctggagaaagaggtgaactttgagcttgggagagactatgggcacggccaataggcacgaatcaaggggagcacagccaggcggggaaagtagagggaaaagctagtggggtcactgggcacagggctctgggccaagctcttctgggcagcaggaccttccttgggaaagccacttgtcctcagagcctcagtgtctgccttggccaaatgctggaccaggggagtggttggcaagtttcttatctttgctggggagcaaatctcattaggggagcagatgttgcccaggagattatgtaagaggcacattcagagcggctcaaagagacagctctagggctccgtggtgttgccacagagcacactggaagcaactaaaccaaagggagctgagccctggcatctctttcatgtctactgtgttcaatctctattgtttcaccctatgcaatcctgaccataaccctgaatgggcattaccagccttttctctggagaggaaacaggagctcagaggagttcaaagacatgctcagggtcacatggtgaatgttctgccaaggggaaatggcctctgccggctgctgccacaccctgcccacacgcactccagctcccagtctccaagccccctgcttccagcttccagtgctgtatttctagctccttggttcatacttagcccctcatccccacctcctcccctgaccacccatgtgagggaaacattggcatggacaaggccagctgctccccaagtccacctccctaggggcaggtggttacttgagccccttccccacagactcacctcctccaatcacaactgtagcaatcctggctggaaaccaaaagaacattctgtgagtagatccacactggcttcccctccactttctaagccgattgcccatctaaagggaggcagggggctgccccaggttgggagccacaagaagggatgactcctgtctaccgctctttgcttcatttcgggaagtggaaattctggaggagggtgaggatcactggggagtttgacctcagtgcttgtcctgaatgaatttacgtggccctgacctagttgattggttggttgatcgggggaatcagatgttatcttttcttttctgcctcccaaggcaggtttagctcaaacaaaaagcagaatgaaaatgaacaaaacctcatagatgtggctaggaaggcatgctactgtgatgtccattcccagtaaatacaggatacttggcaatgaaatctagggcttggtggtttgaccggggcagggaaaagtgaacaggatgggtgtcatgctttctgagcagggctgttagctcatccgaagcagggtcagtgtttattagtgagggagaccatgactttctcctatagtccagaaaaagctcttcagacactaataagtcctcatggcagagaaagatgtgcttccttttgcactgtgcgcctgagtcacggcaagcactatagaatgcttgaatgccacatgagagcaatgcttgaatggaatgaattgaaagcttctgactcttcaaggtccatgccattgttccctcctccaggaagccttcccagattcttccaggcagaactcatccttgctcctccatgactggagccactcacagcactggatatacatgatttgctcccccacacggtgagcccctggggagcaggcagaggttatgttccccagcagccagaggggccagaactgcaatttgggaccaggagttctaaagacagccaaatgtgcaggagtgagctcagccagctcccagggagaggccttagagtgatggtgggaggaagtaaagagacgcaggtatgaaggcccacccctgagtgaccagaaaggccacctagaagggttatgagcccagggaatcaggaatggataacctcgttagaaggttcagttttattggcaggcaagagaggtgatgtcaagttggctggcagcccagcagacctgcaccctgacacacaaaagccctcaggaactggctgcggtgtgtctggaggcctgcctgttaggctcagctgatgggcattcatacggcggagtagcctggccattatttcgtgccattcagaacctgccctaccctgagacctccctccaaccttttcctacttctattaatatttctttctttttttttgagacagaatcttagctctgtcacccagcctggagtgcagtggcacaatctcggctcactgcaacctctgcctcctggattcaagtgattcttctgactcagcttcccaagtagctgggattacaggcatgcaccaccatgcctagctaatatttgtatttttggtagagacagggttttaccgtggtggccaggctggtctcaaactcctgacctcgagtgatccgcccttcttggcctcccaaagtgccgggattgcaggtgtgagccaccgtgcctggcctattaatactttctgtcattgttcattgttctacctcctgttccaagcctggaagcagcacacccacacccttctgtcctgcccagagcacttggacaacagtaaattgtcccagttggtaaataagggacgatattatcttcttatcttcctctggggttgttatgagaattaaattgacaaacctcaagtgctagggtaagtgactagaacataaaagcgcttgcttaagttgagctgttattattttaattttatgaattgcttgatcttaaactgagaagtcatctgcatttctgacaaacagaaaggactgctgggcgtggcccaggcccttgcttgctcatcacacttctctgtactgagttgggagcccagagtggtgtgtgttgccgagggccagttacctccaagttgcaaaacagggtgccagtgagggaccccagcatgaaggagctagcctccagtgcccccagcaagggtctgaggagagagatgttggggctcagggcagctgaggatgacagggtcagcaaagggtgagtgcaggctcaaacagaggttagaggttggggcaggggtcagaagtcagggtcggagtcaggggccctgtgcccccattcaagcctgtgccatttgtgctggcggagttgggggaacccctggatgtccacccacggagacagaaaggtaaagggcaggggatacacacagaggagcacttgtcagcaggtagaagccaggattagatgctcatcgaatgacactgatggatctcaagaatatggttctcagtgtggaaaaaagcaatagaatgggatctacagcacaccatcctgcatgtcagttaaaatgcccgcaaacaaaacacaatacccattctgcaaaaatacatatgaaaaacagacacacattaaatatattagaaaggttgactttgagggaggggaatcgagggtgaaaaggaagaaaatgagaataaataaaaccagaaagagatctcccagaaactaatgaaaaaagtgagctgaagaattttgttaaaatcgatactctggatgtgagatcccataggacacggggccctattgacaaggtaaactcctaaaggagatgaattctgatggtgaatctgggggaagggagagctgaagagagtgggactcagtggtagatagaccctttccggctaggcaggaggaggcccgggcccagaggggagaggacctgtggaacacccagggctgggcatctggccagagtctgcctgccccgggccccctcccagatggaaagttagggtggacgcctgctgtgagaagacaggacagggcagcaaggctgcgggtgtcccccattttctctcccacgggtcccgggacaggacccccgcccttcccagccgcctcctcgcccccagcaccagcccctcccaggaacactcacccaggggcaaaactacggcagagccagaggccaccctgaccactttggccacactggtcactgctgatgaggtgagagcagaggcctccatgcctgctcgggttaattccgtggcctagagagtaagagatcctcaacttcagccagacctgccgaagggatggagctctgaggacgggatgggcacacaacctgacttgcttcccactgtcctgaaaaatgtgacgggctccagggggctagggaggctgctctgagcttgtggagcagcaggccttgaaaggatcctggggtgagggagggagggatgttggggagttggggctaccaaaggacctgtgttaggtcagggccctgagggactttatttccccaggggggctgctttctttctcctgaaagtcccagcgccaatgtcttagacacttccgggactcccttatctctccacggagcaattgaaaaagcaccaaaactaagaaatcagaaccaatcgcatttttaaggcatatacagcaggcgaggtgcctgctcttatgtaatctcctcactaacgtgaaaaagatgggaccctcctcctccgcatgttacagatgagggagcgcgatctggctcagtgatttgctccaggtcagaagctttccatagggaagcaacaccccgcccaggcatggacttgcaatggcttcgacttggttcctcctaacacttatctcttccccttgcccactttaccccaagccgccctcaaggcctgaggaaaacctgggcaaggacaaagctaattgtccttacattccagagtccagggacaggtggggctcgagtcccttcccatctgaggctccctgatgagaacaaaaacaccgggcagagagtggatgcttaaggcctcccctccgctccctgagcccacagcccacccaaggtccggggccacgggaagggtagctcctgcccaccctcccagtcttacccaaagaaggagagttcctgagaatgtgaagctgacctcaccgtcttaagcttggatgtgttcccaaagggtgtgatcccaggccttttaagcagctccaccccgactgaagcactgccccttgacacaggcaacaaatgagataggtttcattttccaggaaaccgaaactgcagacatctttctcccctcatgcgcagtccagaagaaaattcagttatttacagaaataggatttgcccatggcatcagtcattgtcagttaatataaaatgctttgtcatttaattcaaggatgggagtgtgctctacgcagaatgaagtcacaagaagtaagatcaaagttctataataaaatgataaatattactttctaatgaagaaggtgattttcagaataatagtagtccttgcgataggcagatgttccgtttttcaaaaaaagtctcaactgaaggcccactgtgctagatactgactaggcactgggacaggactgtaaacaaaacagaccaaaatatccatcctcacagagtttaccagcaatgggggcaaactaaacataataaataactaaatgtatagaatgttatttgatgaagcgctaaagcaaaaggaggtgaagcagtgacctaggcagaattatgggggggcagtcattccaggtggaggccacagcagtggcagagcccgtgtggcaggagcagcaagggggccagtgtggcctcagcaggtgggcaggggagagaggcaggaggtgaactcagagtttaacagggatccaggccctgtgaggccacaaaagcactgcaaggacttgatcttgtgtcctgaagccattgcaggggattatcatctatacctttttggggaaagggagatgaagctgagaaatgacacagtcaggctcaccctgcagctgctttgagaacaggcggaagagaaagcaccaggtcctggaatgtacatttaaatcttccacatgagtagtgtgcgagttgtaagattcaaaatggagtcacttgggtaaaacctcagcagacagagccagcaaggctttaatgggagggctctcacgcaagatgaggctctcccgtttgcctgctaacaggaactatcacaagaaatgtttccaaactgcagcttatcacatgggccacacaaggacagctagaagcacagggagagcgagccagttatgcaaaaacacttgcctggcacagtgtctcacaaacccaatccaaaactgcaggaacctgaccataactccaagattcccagtcctacctagcaactactgacacttggcggtcagaactcgccaggtcttgtaagatgctgccaccaccaataaactttttttcttcctttcctttcctttcctttcctttcccttgcccttgcccttgcccttgcccttccctgcccttctctgcccttccctgcccttccctgccctcccctcccctcccctccctttcctttcttttttttttttatggagttttgctcttgttgcccaggctggagggcaatggcgcaatctcggctcactgcaacctgcacctcccggtggagtgattcaagtgattctcctgcctcagcctcccaagtagctgggattaaaggcaactgccaccatgcccggctaattttttgtatttttagtagagatggggtttcaccatgttggcccggctggtctcaaactcctgatgtcaggtgatcctcctgcctcagcctcccaaattgctgggattacaggtgtgagctttcggctgtgggatcacagccattaaactttctttcaaaacaacttgcataactttcataaaacaaattgcattgaactttccttcagaacaacttgcataacagcctctttctctaaaaatccccagctttttcctttgttctccaaaacaaaaaggccaccctggtccatatttatgttgtgggattgcaatcctacttcttttgtattattcccaagtaaaacgattttacttaaagatttgtctccctctctctcttttttttttttatgttgaca

SEQ ID NO: 15185 - DNA, 4756 bp, Human
tggagtgcattggtgtgatctcggctcactgcaacctctgcctcccgggttcaagcaattctgcctcagcctccctagtagctgggattacaggcatgtgccaccacgcccgactaatgcatttttggtagagatggagtttctccacgttggtcaggctggtctcgaactcctggaactcaggtgatctgcccgcctcagcctcccaaagtgctgggattacaggcgtgagccactgtgcccagcctgattggtgcgttttcacaagcactgattggtacattttacaaacctccagctagccagagtgcgttttacaatcctagctagagtgttgattggtgcattctacaatccccttgtaagacagaaaagttctccaagtccccacgcaactcagaagtccagctggcttcacctctcaaagggatcttcctgtctcagcttcctaaatagctggaaatacaggtgcatgccaccatgcccagctcattgttaatttttttgtagagatagggtctcatttttgttggccaggctggtctcgaattccaggtgatccttccgcctcagactcctgaagtggctgagatgacaggtatttttttgaggttgttttgtttttaatgcttatggcccagtctctgagattcttattttattggtcagagtaggacccgggcctggttattttaaaagcttctaaggtgattctgatatgcagccagggttgagaaccaatagattagacattgtaactcttcattaaagacacaaatttctttttcagtttatgacttctaattagctggctgacttttgactgaaatcaccaaatattaaatttgaatttttttcaaattggttatgctacaaaaagtcttgagcaaaacggataggcatcctgtatatgacagttttaagccagcctattaaaagcattatatatctatttaaaattgaaaccagtaatatttataaaaattcattatcacagttacagcttcctaaactattgaacaatcctatcctcgacaataaatctaacaatgagaagagatttgagaacagagctattttaatcatgcaaacagcaagctcagtttctgtttcaaattctttattatacatcatggttgcacaatttgaggctggttaaatacaattggttttcaaaatctctttgaatattttctggcttactacatgcaaatgaccatgaaaatatttggcattttaaaattctgaaactctgaataggcacttacatgaaggaaaacattaccattcatagatatccacatgtagaacagatgctccagcacatggtggtacatggacccttttgccagtaaagttggttcctgaccattttatcaaagtgccatagtagtaaaacaggtttaaagaaatgtaatttgggttatttagcttactcataaagtaaggttaactgacaagacttgcactgaagtgcataaaaaatattggtacaaaaaccaatgaaccataagtgaaagtagtttccatacagcaggtttcattttggttcctacactccacatttagtgtatttgcgatcagaccccatgcatatgaatggatgactgcaatcttcttttttagagacttaaaacaaatgacttgaatttagtgttaaaaaattaagagactagatgaagtttcaatatgagtttaactagccaaagttcgagtttaataaacatgaaattacccagatctagataactacatgcttcacaggtcctcctgagtcccccatcccaaaattttcccctgaaaagaaaatgaatgtatgaagaaaataatatttgcatacacatggcaaaaagattccttaaattgaaatatataaatatgtttcaaagtatttatggaaaaaatagttttaacaaatctaaaatgccaagctaagtcaactccacattgcagaaaacacacaacggtactactggaatatagcaaaactgttacttaatatggccaaaaaaaagaaggccataatgacctgccacataatcccttggggaaagaaatctaatattcatagcacagaagacctcaaagaggataaaattctggaagccatggaatggtactcagaagtgcctgcggtgaaacactccatatgcttttctcaaacacatatgttaaaaacaaatgtagttctcaaaaatattgagatgccatgttttaaatctctgcaggacacaagaggccactcaggttttctaattttatttgaacacaaaatatttaattttttgcatgtagagaataagaggtaatcattagcctgaaaagagaggatttataatcaacattatgcagaaagaaagcaaaattacaaataccagcctactcacatgaaaatttttcatgtttacgctgatatatatctgagtgcttatcatcaaagtaggaagttaaaaaaaaaaaggcagcttaacaaagttccagtgtttcaaagaaagcacttttaaaaatgtatatacatgaacgaacatttcattatatcataaaataaatgctgcgctgtaagataaaggaagactaacatatatggagttttggcctttttccgccccctccagctgcaaccatctttaacctgctgaacttaatctcaagggttacaggagttttttgcttttctttttttctcctgttcagttcacatttcaggctgttcggcagatgcctgtgattctggagattcaaatcgctggtgaaagtttgttctctgtttcctcagtttttcaggagcttttctccataaaattatctcctagtaaacaaatgcaagatattaacaaattaatgtttgatatgatgccttatctctattgattgccacttcaattttaaccataataaaattaaattcttccctacaaaagccctcctcttttccaacttcttttccactttcttccagctctaatcttgactgccccttctacctctagtgctcctatcaccagcacccatgcattccaccaccaccaatccaatctgtcaagaagtcctattgttactttaaagaattccccaaatccatcctttaattgttcattgccctcatccaaattcaagttcttgtcacttagatattaaaacagcttcctcagaggcaagagaggcagagccctttctatctaatcctttattatcactagcaggttaatcctccagcacattgcttggattgctctttagtagttctcagtgcctccaggataaatctccaaacaggtattcatgcccctctataacctttatccaatttaccaacattattctcttccctcccttgaccattttcccccatcggccaaatggagttactctctgcctccaatgcaatccaaataaactcgccctacatcttccccagtcttcaaatctcgatttctctacctaactcttaccctaaccaatccatcctgagaacttccctcttctaaattcctaaaattatttgcttcatgaagtcattataggcttttttttttccccaacatatcagaatttaaacatccaaatgagtgcacatgggaaataacagacttacctccaatagtgccatgatatgcaattgattttgaaattgtaaaaatcatgtaatttatttcaaagttataaatcatgtatgtttaattatacaacattaggatggcaatactggaataggttttgtctcttctaaattactgtcaagctattatttaagtattctgttagtttatattatttttctttttcccagatatctacaatgtgagaacatggaggacagatcatgtttataaaaggtagtttttgtatttttcacagtacttaggacagggtaatttctaacttagctttgaacactcaactgacatttaactacatgtttattaatctgattcagaatacaaaagaccattctaattactatcttcattcaaaattcaccaaaagcttttaattgattttcaaatgagaacaagtttgtaatgaacactttatattaaacaaagaattagaggcggttgggcgcggtggctcattcctgtaatcccagcattttgggaggctgaggcaggcggatcacctgaggtcaggagttcgagaccagcctggtcaacatggtgaaacccagtctctactaaaaatagaaaaattagccgggtgtggtggtgcatacctataatcccagctactcgggaggctgaggcggaagaactgcttgaacccgggaggtgaaggttgcagtgagctgagatcgcaccactgcactccagcctgggcaacagagcgagactctgtctcaaaaaaaaaacttaaaaaaaaaggattagaggctgggcatggtggctcacgcctgtaatcccagcactttgggaggccaaggcaggcagatcactttaggccaggagtttgaaaccagcctggccaacatggcaaaaccctgtctctacaaaaaagaaaatacaaaaattaacctgtagcgagactctgtctcaaataaaaaaattattagaattcagtcatctcatggacattatgacagaattgtttaaaagggataaatcagcagggcacagtggtacgtgcctgtacctcccagctactcaagaggctgtgactggaggattgcttggaagatccccatcttaaaaaataaaaatagtaataataataataataataatgtatatttgttaagagaaagatattcaagacacta

SEQ ID NO: 15186 - DNA, 9871 bp, Human
cccctgagtagtaagtatgcaacccagggtgtcgggtgctttcttgtggtgaaacaagggtgtcaaaactgaggggactctccaaggtcctaatgaaaagcagctcctctaaacacctgaatcctttttgactccattctcatcactttaaggatgaagcctttctgtacaaaggctttgtacagaaattattaaaaactatattttacactaatgctaacagctaattgagcagaaagaactatgaagtacaaatttttctaaggttttcttattaatggcaatacagactttttttttttttgagacggagtctcgctctgttgcccagggtggagtgcagtggcgtgatcttggctcactgcaacctctgcctcctgggttcaagcgattctcctgcctcagcctcccgagtagctgggattacaggcacctgccacaatacccagctaatttttgtatttttagtagagacagggtgtagtagtatatattctactatactatagtagagaccactatgttggccaggctggtctcgaactcctgaccccaggtgatccacccgcctcgacctcccaaaatgctgggattacaggtttgagccaccgcacctggtcggcaatatagattaaggtgggggttatttcctaaaaacaaaagtaatccatatgtcatctaatgcagttaaattaaagatcacctgttgacactatttgaaaaggccttgaaaaaaaaaagggggccattatttggaatataaatcacccttataaaattctattatctatataaattggcctattttcaaataataatttagctatttcaattaccattttaagcaataaaaggcaaaaacaaagggaacctactgaattgtacacttaaacatgaataagaaggtaaatttcatgtgtattttatcacaacttaaaaattttaaaaaatactgaaaaaaaaacaaagggtaacttttggataatgtatgatactaagaagggcatgcaactaagtaatcagactgcttttagtaagaaaataagtttttttttttttttaatttctcgagacagggtctctgtcacccaagctggagtgcagtgacacaatcaaggctcactgtagcctcaatcttcagggctccagggatcctcccatctcagtctccttgggagctgggagtaggcatgtgccaccatgcctggctaattttttaatttttttgtagagatggggtcttgtcatgttgcccatgtcggtctcaaactcctgggctcaagcgatactcccaccttggcttcccagtattgggattacaggtgtgagccaccatgtctggcttgcttctctttttgtattctaaaattcaaaggcctaagtatcaaatccctaaatctccaaatactgtcacagataaagactcaataataaactccctccgaaagtttagacaggctcaggtgagagacttgtttcaaggggttataaaaagaaacaccagtgctctgcagaagaatcagtttttaatttttttaatgtatctatttaatggaataagttgatcatagatttgtaaaccaaaaggtaatttctcaagtatttggaaataagaaaaagcctccctaccaccaaccttttggtcatctttctcattctcttacaatcatcctaatcccctagtacacccttaccatatatcaataagggcaccataatattatgcaaagaacagatatatatgcctgatctcttattagacttgcaccagagactgttgaaccactccaggcatgaactccaaagctgaggcacactgaccaagcccctgggcatctacagaagcaaaggcgttctctctccagctggctgctccttctggaagagccctttaatctgggttaatcggccatagagcctctctctcaatggaggaatgtggtagctagggtccagaatgtttgtcactcggcgctctctctcttgcttccataacttgtatgggtggggagggaagaacggtcgtcctctctctcttcgaatctgtaacgtaattccacttacagccagcatgccccatactgccaggataatgaagtctaaaaaacagtagaaaaagtacagtttgaactctagtattttaaaatctaacataataatacaacccttcatggactaaatctgtatattcctttctaatagactttctggtgagttagtccaaacacatatgtagttcctcagttacaaaccaaggaatcagtagggaagccacagtcttatttttgaaactaggaattttctattacaggcatttgaaagtccagacaggttgtaaaaaaatcagttgtttggatccttggccttccaacattatgtaacaagtacccacagttgtttgtgtgttttttcagagggggttcggggaggaaggcagtgatctagttacacttcacatatgtacatcatggaacatcagattccaccacgctcatttctttcccattccactctacatggggccctactgcactcacagtgtaggtataggaatgcatgaaaagattcaaccaatcgtactcagcttctagtaaagcttctagcttggcaaaacactgtctggtacttaaaacttgcaagagttttaaggttttcaaggatttcaaggtctctaccatcaacctcttatccaaagggaaagctctggatagtaaagggaaagatttgccctaaaataaaatcacaacaatcacaattgtgcttatgcaatatatcttcaattctaggacatgctttttcactctccacatgtcaacatttctgaagtcaacatatcttacaatctgaacaattcatgtggtagtcatttttttcttcaaaaaatttatagaaaatctgtaatggatagaatcttacaagtgagggaaactatatgcttactaattaaaaactctttcaactagcaaactgcatgcttcattaaaggagggaaacaagggaataacttaacattaaatcaggttgtcattctcatcccttattccatccccacccataagtctcaaacatctttactgtcagtatttttctcccctctgagaatgaccaggtaaacctaaataatcttggaaatttcttaatgaaattcatttagtagatttttatcttcatcttaaaattttaaatgctttactcccatgatcctgagttatcataacagagggttctcacagcattgtatgctgtgttccctccttttgtcccagttgactttctttaaatttagtttccaagtgctctggttagcataggtgggtcaagactcctactgtgctgtcacactggtttttggatttaagagtcttaccattagtttgaaaaggcacatttgtgaaagctctgtggaaatccttgttgagcgctctcttgagtacgttcaaagtgatgtaggaaaggcttgtggaccagtaactgtcaatggctaaaaccaccgaataggagccaatgactccacaagtcagtatgttcagctgtggaagagtggaagagtttaggcatcatccatgttagaacaaaaatagtttataactctccactggcttcaatcacaggcaatcacatctgctccctcaggcatgaaaaaggaccagacccactcagagctgaacagaagttccctggaaagataaactgaaaacaaccttcaacatccatatgagttcttaaaacacagttcagcttatccaaatactatggaaaatatcttccatatgaaggaacttcaacaataaaatctaattagaggaagaatcactcttctgaagccagttgaaactaatgacccatcaggttggtgtactagagtaagcactaccttctctgctcccactgttaaaagcatattgactgtgatgctccatttggtggaaaaaaaagaaaaaaacaaacaccatgtggtaatcataaatagaacttcgttttcacagtaacaaggctatttagaatcagtcatctgatacaggtaacacagccctccccagtgaataaaacatgcaaaatgatgaaataagtgatcagctgaacacacaggataacataatcaataaatctaacttttgatgaaacacttactattcttaggcagcccatgaaaactactggaatgaggatagctatgcaagagaaagtgacccagaatacaccatcatcatgaaaaatctttaggtttcctgaaaaagcaaaaagaaactaagagtaaacaacagctttaccaagttagagttggtttcttggaacatctgaacacagatatacatcaaagccttaaagtaacaaccagggaatatgttggcaactagaaatgaattctaattttcttcatttaactgtcaatacaatcttctttgaaggatgtgttctagaaggtgggtgggaggaaccaagcaggtcaacgctctgcacttattaacaaaatcatttagaagacactggaatagtccaagctcttccattcactagctctgtgaacttgagcctcagtttcctaaccctcaaaatgacattgaattatatctccaagctctaaatcacctgttagctctacattgctgacttcatgatttcatactgcaaaataaaaaatacaagtaaaaggcattcaaagttaagccatgaacccaatgtaaacagtgagtccacttaacagatttttaccgtcaaagcatgtcctgtcatgccactgcacactgtgacatgtgatttcctcatgtatcaggaaagaggaaccaaccaactatctgctcttcccaaacccttctcctgctgctggactctaaaatgctgcacaacttaggccgacccagaacaaatatatgagaactcctctttataaattaagtttaaaaagcaagaataggctgactgctgtttaatactgacactggcaccaccattcagtccatctgtaaatggccccatacctcaagacctacatatccaggtcagagtggaagactgggagtccctaggctacaggactggaccttgagactccatattctctgaagccaacagcaatatgccattgaggtgaacttatagattctattctctagtttaactatattaaccttcacaaaatacatatgtggctttcttgtaaaaggctttcaagaaatctaagtattgaaaatagttacgatgcatgcatgtgaagaacggaccctttcagagaataagctcattgcttcccacataaggtgaaaactagcaatctaatcagattgtagtggtcagccaaatattttttaaatgctaatgcttaaaaatatgggtaggcctcttggccgggcatggtggctcacgcctgtaatcccaacactttgggaggccgaggtgaacagatcacttgaggtcaggagtttgagaccagcctggccaatatggagaaaccccatctctactaaaaatataaaaatgagctgagcatggtagtgtgtgcctataatcccagctactcaggaggctgaggcaggaaaatcacttgaactcgggaggtggaggttgcagtgaactgagactgcgcgactgcactctagcctgggagacagagtgagactccgtctcaggaaaaaaataatgtgtgtgtgtgtgtgtgtgtgtgtatgtgtgtgtgtgtatacatatataggtaggccaggtgcagtggctcaagcctgtaatcccaacactttgggaggccgaggtgggaggactgcctgagcccagtttaagaccaccctaggcaacagtgagactctgtctctactaaaaataaaagcttaccaggcatggcagcacacacctgtagtcccagctacttgggaggctgatgtaagaggatggcttgagccttagagtttgaggttgcagtgagctatgatagtgtcactgcagtccagcatgggtgacagaaagagatcctgtctctaaaaaataaaaatatgggtttgcacccactagcattgaggagatgatcactctaacggtccttgagctatgagatagttcataaacaaacatatataaagggtatatgctaaaattatttttaccaataggaatagttatgtcaaaaagtttagagacaactgctctagactactttataaagttgaaaattaagagacctctttatttctgttttctcattcctcacatctatcctatgagatagtttcacagatgatggaacaaagtttcaatacatcgtccaaggttataagctagaaagggaactagtgacagagccagaatgcatatagaaggttttttcctgactttataatttatgctcattctcctcatgaaaagtacattaaattactagaaattataacctatcatccctccatcctctaagcattaacaaaagaggggaagcccattaagtagtagttggtttttgtggtctttttgttttgtttttgagacagggtcttgttcagtcgcccaggctggagtgcaatggcaccatcatagctcactgcagcctcaacctcccgggttcaagcaatcctctagcctcagcctcccagagtagctgagaccacaggtgtgcactacaacacctggctaattttttttttttttttttcagtagagatggggaatcactatgttgcccaggctggtctcaaacttgagctcaagcaatcctcccacttggtctcccaaagtgctgggattataggcatgagccaccatgctcagccattaggaagtattttatttagcacatgtagggtagagccttgaatctgtatttcaaaaacatccccatgtgaatctgtcatttcgccaagcctacacaacactgcttttcatcagactatccagtagtcttagaaaaaaaaagtcttcagagagacaagggacacatgacttgtactctattatatcctgcattctctatagagttgacagcctcatgaaatggctatttttatgtctaacagtcccatcaactttattctagtattttaagaacattgtcacagaaaggaaacaaccaaatagaatacttttgagtacagatgctgtttttgtttgtttttgacaataatcaggaaatgtaagttattaaacaatggcaaagaaagttaacttataagttaaccagattttaaaaactgatagcaattgaattactttttaaaaacaccaaaaaaaccccagaaccagccctgtgctactgccccagggtgattaagtacctgagggacacctggggtttggcagcggatgggagtggaggttgagggtacaacagaagaccagaaacaaagtaccaggttccccgactcagctgccatcagagcctttacctccttatttcctttacctccattatttctaataaacacataccacttatcacaacaaatagatacaaagctacctctaaagacattctatatttcatctactgtgcctttgaggaaggagggacttttactagtcctggtgctgtctgaaagtgtcacaccatcaatgcagatttccagaactccacaggagaagcactgacatgcaacaccactccaggatgcaaatccaattaggcagtattcaaacagtcactcgaacacacaaaacatctgttacatatcgcctacccagtggagtaaagaaagtcactgacgagatgaggaaccccagcactagtccaacacagagcatgcagatcgagaggattccaaatcgccaccacacagctaccaagaacattccaccgacgcttccagtgacagctgtcagaatcagattcactgtacaaagagagaggatgaactgctggataaccggcagtacttccaaccgcgtgccttagacatacaataccgttaccagtgccagcttcagctttctgtaggtcaggcactgagggctcttcagtggtgccatgaagccagcatagagcaaccctctctagggaggggtctgggctgagacaaggaaattagctagggagctaaacctcacagggccagtgacaggcttggcttgtcaataaattgggattgagaaggaaaagttgacaagcattctgttaaacataatggggtagggaggtatctgttttcaggtaaagaaaacctcaacattttgcttgttgtacatctcatatcttcaacatatcacatagccagaacacaggtctataatcaatatggcccctcctttccctaagtaccaaggaattcaccatacagattaaaaacccagaaggtctgaatgagtagttcagaaaaggtgttcagagactagatggaccattattttacataagtaataggctgtcacacacaatataggccaaactgtagaaggaaaggtgaagtaaaacacagcacctgccttcttgaatacccagttaaactatataattttcacttaccatcatacttgataggtgtcagtcttgtaatcagtatataaaagaagaatcccatgatgataaagcctatgaagaataattctaagtggcaaaccaccaggaaaggaaaaaagcaaaacaacaaaagctatggttaagcaccctttttacagtgcaatttaaatatttaatctacaaatacatgcttaagctcctggaatttacatgttacagcattcagaagaaaaaaaaaatctaaaaggcagaagaaattcagcagccatgggagtaattattattaaacagatacaatattaaagtaccaactacaggatacactttcttgtatataggtcagtttccattgttaaattgttatttgttcatttcatagctcattttaatatatttatgttttctgcttaaaataagaatagcactttgtcacgtgtatgtgatacgaaattacacattaaattttaatagttttgtaagcagaaataaaatgtaaaaggtaaaagaaacccaaactgtcccaaagcaaaatataacttttatatcttcttttaattcatcctatcctgtttagaatgatcaatcattaccttcatccattaaaacacctggtaatgcaagtatacagataactttgttcccacaaataagcctaatcctgatcatggaggccatagctctacctattttcttaaattcttcacagctgttcttggtaatacttgtactgtatctcaatttcaataaatataaaatgatacatatcaacacaccaaaaaaacccagagtgaggcatggtggcttgtgcctgtagtctcagctacttgggaggctgaggtgggaggatcacttgaggctaggaatgtgaggctgtagtgcactataattgtacctgtgaacagccactacactgcactccagcctaggagacacagtgagactccatctctttaaaaagaaaaaaaaaaagctagtgataactttgagaccacagcttagcaactaagttctttgttacagaatcattctacatgttgagatattatatattctttacaatactctcttcccaattaataaaaaaagtgtcataatagcaggaaaggagttgctatttcaaacaatttaacataagtttaaagagctttattagatcaggattacatttgagctaccttgatgctcagttatacaacttgttgattaaataaggattttttaataatcgaaaacatcacttatataaaaagcagcccaaataattcaaaccaattcagtgagcatgatttacatcccagttcttcagtgtgtttcactgatgttgatgctggcattccctttggcatctgaatctctcaggactgagcagacatttcaaactcactgtacactgcagccccatagcctgattcatgtgaaaccaagtcaatcgccatcacc

SEQ ID NO: 15187 - DNA, 5976 bp, Human
  misc_feature (1)...(5976): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgggtgatcctcgacctcccctggcctgatgctttgagactttatccagttctgtatcaaccactaaatagtctgctttttgttttgtgggaactccaggcataaactgggtgagagtgttaccactcgcaggggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctagggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccatatgatcatttcaacgatgcagaaaaaaagtttcataaagccaccatcattactgataaaacctgtcaacaaggaagatacatagatgaaaaataagcacaggaagagatacttaatgtcattaaacactaagaaaatgcaaactaaaaccacagcaagataccattaccatctattaaagtggctaaaattacaaagactgacaatagcaagtgttggtgaggatgtggagggaaggaattctcatacactgctcatgggactgtcaaataatatggtcactttggaaaacagttcagtagttcctttaaaagttcaacagtcactaaccatatgatccagcatggccttctaattatttttccaagagaaaaggaaatctgtgaatgttcatagcagctttatttgtaatagccaaaatttgaaaacaacacaaagctcaccaattgataacaaattatgatatatccatgcaaataaagtgctactcggaaataaaaaagaatattgttatacacacaaaatcattaaatctcacagaaattattacaagtagtgcttgctttggcagcacgtttagtaaaattggaatgatacagagattagcgtggcccctgcacaaggaggacatgcaaattcatgaagtgttccatattttaaatttaattttatgataaagaaaaacattggagggctgggcgtggtggctcacgcctgtaatcccagcactttgggaggccgaggtgggtggatcacaaggtcaggagactgagaccatcctggctaacatgatgaaaccccgtctctactaaaaatacaaaaaattagctgggcatggtggtggacacctgtagtcccagctactcgggaggctgaggcaggagaatggcgtgaacccagggggcggagcttgcagtgagccgagatggcgccactgcactccaacctgggcaacagagcgagactccgtctcaaaaaaaaaaaaaaaagaaaagaaaagaaaagaaaaacatgggaaggatctggcaagatgtctgaataggaacgctctggcctgccagcgagaccaatgcagaaggcaggggatttctgcatttccaactgaggtaccctgttcatctcattgggactggttaggcagtgggtgcagcccatggaaggcaggcagaagcagggcggggtgttgcctcaacccaggaagtgcaaggagtggggggcctccctccaccagccaagggaagctgtgagggactgtgctatctggcccagacactacgcgtttcccacggtttttgcaatccacagaacaggagagtccctcatgtgactacaccaccagggccctgggtttcaagcacaaaactgggtggctgtttgggcagacactgagccagctgcaggagtgtttttttataccctagtggcgcctggaaccacagcaagacagaactgttcaccccctggaaagggggctgaagctagggagccaagtgggctcactcagcgggtcccactcccacggagcccagcaagctaagagccactggcttgaaattcctgctgccagcacagtagtctggagctgacctggagcttggttgggggaggggcatctgtcattactggggcttgaataggt

SEQ ID NO: 15188 - DNA, 5689 bp, Human
accatggagcataagaagcagcaatgaagaaatagataaccattctatcacacatgtgaaaacaatgctccactgtcctagtgagggggaaaaaaaagtaaatttgtcagaaagtgttcagatgggaagtacgggttatcactccactatgttgcaatttccattcttgttctagttctcatggcctttacacttgttcttccaaggttacacagatttttgttgctgttaatgttatgaagtcacgagtaaaagctttctgttattttttaggttgcacatacaatagattctctcagcatatataagacatagggacagagccccatgatagttagaaagcctgaagtggttaaagcaaacaaacaaaatctgtctttttctgatgttttccatttcttttggatcccctctaacagaaaaatgaagttcctggagggcagaccacctccccgcaacctgccccagctcctatcagtgcagggcaaagtcctgatgttcagtaaacactccctgagctgaaatcacattctttgtgtctttttagaaggtatttacagtttttacttcaaatatcctggtgtggacagtaaatagtaataaaggaaattcagaaactaacttaggaaaaacagtaacaaaaacaaaaaatggcacatttactacaaaagcatagccacctgtatttctaagcaagttcctccttccaaaactgaaaagtcagaggtatatgtacaaagagtttggttcactgaggtctattcataaaatggattagatggaatttgccctttactgaggtaatttaaaagtacaaatttgtaatatcatcttgaatctattttcagtgtccaagtaggtataactataatttgagggaacgctagtattagactttcctccccctacacgtaacattgaccaaagcaaataataaagacttgtgtgagtaagtgaaaaaacataccccataaagcctgggcatggtggctcacagcaataatcacagcactttgggaggctgaggcaggtggatcacttgaggtcaggaatttgagaccagcctggccaacacagtgaaacactgtctctactaaaaatacaaaaattagccaggtgtggtggcgcacgcctgtagtccaagctactcggatggctgaagcacaagaatcacttgaacccaggaggcggaggtggcagtgagctgagatcgcaccactgcactacagtctgggcaacagagtgatagtctgtctcaaaaaaaacaaaaatgtattccataaatatatatacctaccgtgtatccacaaaaattaaaaataaaaaaaaagttttaaaggaatgaaaaatacatttgtgagaaagaatgggtttcagtctactagtcatcagaagctatagcatacccatagatgatactttatgccataggtctaaagaagcaaacattacgtcaatgcttttcaaacttgactgcatatcatcccctggggagcttacaaaatacagtgatggcctccagttcagaagattctgaagtgctaggaggtgagatagagggtggaggaaggagaataagtttttaaaactccttggatgactgtgatttctagcaaggttttgggcctttctaattctgttttctagattgtcatacgctgttagagtaggtagacaacagacctggaatcttatccaaaatctgccaccgacctctctgactctcacttacctcataggtaaagtggaaataagatctttctcatggagtatgtgtgaacattaaatgagataatgtaggccatgtatctagcatagtacctagcacacaggagcacctaccacataataaatgcaaattcccttctcacttttacttaaataaggcttttttgatatttagaaattttaatgaggagcaaaaatctacacatggcatatgattctagcaatgctattcaaagttaaagagaatctagtttctattacacctctggcagggagacccagaatactgaagtaggtacctacaactttttattgatccaaaatctagacatcgaagccaagtttgctgaaacaaccacaagcactaaattgtgccaagaaggtaatatagtactttgcatctaaactggcctctgggcgctgcgacagtgtgtcctaaggagccaggacaggcacttttgtggttctcttgtgagtgtgtcccaaagtgcccttgtgattcaatgctgtggttttattttaagcccaggaaactgtcaccttacaggaaaaggtagcagactgcaagctatatgcaatattgtaaaagatatggtgaaaaaaactaggacttggagtcagaggtcttggaataatcagattttgccagtttcactgactcagacaagtcaggccacttctctgagcctcagttcccccaaataaaaatgaagtgatttgaattagatgatttctaaagatcctcccagctctaaaactctaggattctgcatgtgaggaaaccagtaatcatctcataaatctcaaatcctgcttgtaaaaggagcatatattttaaatatcagattgtttgaatagtttgagttttttttggacgttctttaaaaccaaaaggcatattcgagtatttctttaaattgctcatagtctgctctgaaacttccttttttgaaaagaagttttgccctttagggttgtgcagaatccatttcacaagcaaaccattcccacctaaatggtgtggtgctccaaaatcaatccttcactcagaggaggaaagcgtttacgttcttctcattggcaggccaagagctatagtattgttttgaaagtgcttgactattaatagcaaaatacgtgaactctgtttgaataatatacacaagacttaattctgaaagctaaactttgcaaaatggtaaacgcaaactataagtataccttcatacctcacacactcatagggtcttttgtaattttcaagttattttcaagtaccttatctcattcacctatcacactgactgtgtgactcaggtattattattctcattttagtgatacagatactgaggctccacaaggtcaagtgatttacccaaaattaaagagcagggctgggcctcaaagcctgcctgctgactccaagctcagtgtgctttgtcactaccccatagctgctgctctcatcatatccttagtgtgcttgatagtactggaaaatagctctcaggtttttaagtggtaagtcctggggaatcagttaggttttgtttggggttactgagcaaaggcctaccttcttagatgcctgctggggaggagtcctaaaacttcatccagtccaaagaacaagtcctgaataatgggatagtattctagtctacaaggcagaaaaatgtctactctttgccctacttgactaaagcatgccagcttggaagggtaccaaacacgttgagtcaactatttggatctgttgaaacagcatgtcatccactgtaccttaagtggctctttttccatgatacaatgtgaaatactgtagaaacgatgaagagggcacagagtcccattccataaatccatgctgttatcttttcccagcagtcatcagacagccgatggaggagggcactgcccacgatggccggaacaatgaggaactgagggaaagataaagaatggtgaatggaatattctggcttttatggaattgagtcttttactaaaaatacagagctttaccaggaacaattttagtaaaataatcttagagcaagtatttgtctctcctggataatcataacgagagccagatgaagttagctgctacactggaaagcaggtaataccactcagggtccaggaattgtgccaaccagtggggatacaattaagccatcaaggatgcaacatcattcagctgttgcaaaacagatggttttttttttttatcctaatttcattaaataaggacatgtttcattctactttataatctgatttagagtaattacttaaaatattcaaatgccaagcaggcagggtgtggtagctcatgactgtaatcccagcactttgggaggctgaggcaggagaatcgcttgagccctggagttccagaccagcctgggcaacacagcaagactctgtatctacaaaaatttaaaaaattcgccaggcatggtggcaaacacctgtagtcccagctatttggcaggctgaggtgggaagactgcttgggcctgaaaggttgaggctacagtgagccatgattgtaccactgaactccaacctgggaggcagagtgagaccccatttcaaaaaacagccaagcatatactcagatttttcagggaggtcctcattttaaaatatctgtcctattgcaattgaaatctcaatatttcaggacaggataattgaacaaatcaagtaataggtattataatgtacatagcaacacacacatacaaaaagtcagttgttgaagttatataccctgattttcagtttggatctgtacattccaccaatttgagagctactgcagaatgtaagagttttggggtcacttcatttttaacagagccttttaagtaagcaagagcaaaccatttccaaggcccacctattcaaaaaatcttgagaattttagagagatttgctttctgcatcatatttcatagtccacatggtcacaaactttaatgtctagtcatatgtgtatgactatgactagtaaacatcttacaatgacagaagctcccaggagaataaactactttattagatattagagtaagcatacttgacaaagaatacaaatgttagcaatttgcttatcttttttctccccaaacctacatttgtcaccttgcaacagactattaaatcccctagatgagactggcatgagtttttcagatgctgaagttttcgttggcccaagcaaaattagaacattaaatacaattgcatctcctccgggaagcaatggccactgtaggggtgagagtctatggctcgccttcctatttcagaggatttaagtacatttaagtacaataaagtttttcataaaacaaaatgtatttcatttaaaggaatgccctttatcttgagatcatgtccttactacttttcatgttaaagtatcttctcttcaatgaaatgatgacaataggggtgttttgtctgtgttagaaatattactggtccctgaaatccaaaaattcaagatacggtttaataagattatattttctgttctaaaaaaattaatatgggggttttgtcaggtctccctttacttaagtttacacaagtgttccttaacctgtgacacactcagaagagacaagttaaggtttattcaggttcatccgagtaaatattattcctaaaggtaagctgtgtgtttcaatatctgaaccattgtattgtaccaacagtgactaccacagttaaactagcctgttccaaacactcattgttaaagaagcaaactggtcttttctctatttcttgttttcagactgtatcccagccactatttttccctcaatgtcactaaatgcaagggaataatgaaaccacaggtaaagtaaaaaatttataatgacataagaaatgccattaatgtcacattaacaggaaaactgaaaatacatacata

SEQ ID NO: 15189 - DNA, 74730 bp, Human
  misc_feature (1)...(74730): n = A,T,C or G
ttttgagggggaaagatcaggagtcggttttagacttgttaagtttgaagtgattattacacatccaacacattgaagttatcaggcagacaacatgtagacagctggacacaccagtctagagtgcaggcaaaagacccaggctgtgagtaaatttggcaatctgtggcatacagaggcatttaaagccatgagattagatgagatcattaagagagtgcgtgtatatggggaaatgctccgaggactaagtctggggcactccggtgattaatggtcaaggagatgagaaacatccatccaaagagcctgagaaaagcaaacagtagagagcaggagaaagaccaagagaatgtatccagcaagccatgtgaagggagtgtttgaaggacaggaagtgatcaactctatcaaaagctgctgatttgccccttcttgccttgtgttttctcattagcaggtatcgctatcttatttatagttatgtcctaaatatatcggaagatccaggaagtaaggcagcggagagcttgtgagagtatgatgatcgagctaatctcaccgatctataaaacagagtcagccaacggtttctgatattaaggagaaaactgcagcattatacaaattatttagaaatgcataactaagtactagaaagaaacagctaaggccaggcacggtggttcatgcctgtaacctcagcactttgggaggccgaggtgggaggattacaacaaggccaggagtttgagaccagcctggccaacatggtgaaaccctgtctctacttaaaaaatacaaaaattagttggcgtggtggcatgtgtctgtaatcccagctactcgggaggctgaggcaggagaattgcttgaaccagggaggaggaggttgcagtgagccgagatcatgccactgcactccagcctgggtgacatagtgagacgccatctcaaaaaaaaaaaaaaaaaagaaagaaagaaagaaagaaacagctaaaagaaagttaggagtgagacttggggatatgaagtagtagggaagaggactgctgctattcattataaacctcaactttttaaactatatccttgtactactttgacaaaaattaaaaacaactagttagaaaagttttcatgaattaaaggcctacttctcaacttgtgggctgtgaaattacagccagaggccagcaattccacatgctcaccaagtatcatttgcacactaagtaagatcttatgcacgttatgtacaagatacatatgtagatactgctttcatcactacaaattaaattaaaagcattcctgaaattgtaataatattcaattattaaagatcatatcattcaactgatactaaaaatagccactattctatgatcatccatataattttttaactctttgtaataaactttgtaataaacttttggcaggcagaaataattctttctgcatagctgtaactttgtttgtatatctttccaacaattcagagttccttgaaaaagatatcatgttctaggaatctttggattcctatacctagtacagttgttgacatatcaacaataaatgatatttaatatatcctaagtgctttctatgttagctattgctttaagcactttacgtatattttcattttattactatcatggaaacacagccttcagaagttggtactcttattattcctacgttacagaagagaaaactgaggcacaaaagttaagtatttttcccaaggacgcaagagtgcaaatgtcaaaactagaattagaagctgggcaacctctttctgtgctttggctcttaatgtttatgtaaaatattaataagtgttctttgataaatcattgaaataacaaacccaggagcaaattcttttaattagtgacataaaatcatgttattcttggatggaacataaaatcatgttattcttttccccatgtatattttaaaggctgtttatttgacaatctcaccttttgctttttgttctggatcatctgtttttctatttgtttctgaaaattaaagacaaaacatagtaagtactatgcaagtcaccattcagtatctcaaaatataggacaatatttaaatgaattcaataagtataatcaaagaaaaatatatctgagcatacaattcaattttcctaaatcctgaattcattacacatgaagttcattagaaaagatcaagatttgggcatatttcaattacttatactaaaagtcaccaagcactgactaggcaccaggctaagtactccttgtctataagataagagagttggagtgggtgatgtacatcaactccaagtgtctctaaggtacaaagacatgtggatggggagaagccatcattaaagcttgttcaatattgttattgtctcttaaaaccagaaaactacttgaacaattgacatcatgtgctttaaaggaatgcagcatgtcacactgcttggaatattagtctgctactctaaggacttcacatatacacagatgatccattgggggagcttgtgctgaagcccagatgagaagccagagatgaacccaagaccccacctgtgtcagatgcactaagtaaatcacagtcagtgtctctcccacaaatagaattacctaggacagtgacacccaccaacagcctagactagccagagaacatccacccctcacatggaaaacaacagcatatgagctgaccatgtgtttttaacctcatttctgcacctgtaactccacatcaggactactgtgtaaggtaaattaggatctagttaattttcacggcaatcacttgattacagccctagtaggaacttatctgttctttgtgtatttctaggaatacggtcgtatgcacataggttggagagggaacaaggcagagtctgggagattgataaaaaaccagactctgtcctctcccacagaagctgcaagaggatgtcggtgagatcagggatgcggtcaagtgaacattgacacagatcactcaatttgttggtctggagtttcccacattcattcatataaaacatttcaatttggggagatgaaaagtaaatctgaggctggttttaatgcagggaagggatttttataagtcaagtgttcttgctcctttgagactctacataagaggaagaaaggaaaactaactttgaaatctagcgtgccaggctaagtgctaagcacatcatttatgaattctcttgtcttctcacaccctgtggagaaggtcttacctccctctttgtgcataggagaaaatagatggctgagaaattagagtccccaaagctatcaaggccagcagtttacataattccaaagcatactttttttccactgaaccactgtgtacctttcttcaaagagaagtgccagtcttgacttttgcaaagagttgattgattttatagggtttacagcacatacctcctgcgcagtgctgcaagaataatgcaggacttttttttttttttaaggacatgtaggtcttggtagaatgttctagaatttccgatctctttaactatagcctccttattataaagttaggtagctgaactagactattcaataccattcattcagcaaatattaactgagcacctactaatgtctggcacatttgtagtcatcggagatacagcaatgaagaaaagcataaaaaattccagtcctgaaggagctcttcctagtgggatcagcagtacctgcaggaacactgcaaccctccacatcccccagtcattgcataaggctaatgtgattagaaaaatcaagcgtaaaatgcaagtttctaactggactagatagaacaggtgggtgctggtcatgaaggggagtttagggctctccacagatcttcccactcttgggagggaaataaggaaggaggagtggtttgaactggtcacattccatatagaagtggaaggtgctgatcccgatgtgggagggccctggccgggtctcctcatgtcctttagactcacgtcctcccaggaacgtggagggtgagtgtggttggacatatgcccagaaacaagggccaccatctttcttcaacttcccatgctgtatctaaaagggggttggcagtctgacctaaagcctggaccagatcattccaggccccaggccaaaagctctcttattctcattcttgtcctcttctgtccttcacctcacatcaagaagctgagttctgagactcatttcggatatggagaaaatacacagagataatagtaatactttgcattagttttatattgttatacataaattactgcaacttgagcaaaaaaaaaaaaagaaaagaaaagaaaagaaaagaaaatacacagagaatacgttttaggctctacaagttttattgcttaaatttagcttaggtaaaggagctttctgtgagattcagcttaccccactagcactctgcaaagataataatgaagtgatactttgctttattctctgtacctatgcttctctgggagacctcatatgaacctcactgtgccaaagaggaaaatgacttgagcacgtattatatacaggcattgttctaagcacttaacacagactatcccatttaaacttctcatcattcataggaggtagttataattttacaaataaggcaactgaggcatagagaggctaaagaatcttgtgtaggattacaaaacaaacaaaaccaatttcagagactatattccataaaatactactttaatcacactctatatcccagtaatggggaattcattaactaaagggagctatatgctcagcccatccctgaaaattacaaaagtacaagctcacatgtaactcatatttagtctttaaatattcgtattcagaaaaaaaagatgttacactactctttacctgtcttaacgttttttctcctttaaatattttgtcagaacaataaacaccttactaaaaagaatgggatattgatctttaaatattgtcatgcaaccactaaagcaaatcgctttggtggattcagatatactgtactcagccaggcacagtggctcatgcctgtaatcccagcagtttgggaggccgaggcgggcagatcacaaggtcaagagatcgagaccatcctggccaacatggtgaaaccctgtctctactaaaaatacaaaaattagctgggcgtggtggcacgtgcctgtagtcccagctactcggtaggctgaggcaggagaatcgcttgaatccgggaggcagagcttatagtgagccgagatcgcaccactgcactccagtctggtgacagggcgagactctgagactccgtctcaaaaataaacaaacaaaaaacagatatactgtactcgtgttccagccactgcgctaatctgccagctgagcagttcttgctggactcaaggtacattcaaagtgaatttccacccaggcctgttcatccctctgagtgcattaccacactggcatctgttctttccctgcaccaggacatgagactgctctctccctaagcacccagactgaccagtcctcacgtcacagctttccagtctccttctctactagcacttccttagctcatgctgtatcaccatcacctattactagttagttgcctaaccatcttcctgcctgctctttggcctccctccaatggcttccaccttgcaccagctgccggagagttgctctggatactggtgtgtcacctcgggccagcaggcaccccacctctctgaccttggctttgctcacttgcaggcagaagtaatacttatctgctgagaaaactcagctccctgacatgtgcacacagtactccgcagagtgggtgcattcaataaaagtgggtctgcttaccattagtgtttatttttgtttcttctggacatgctggggctaaaaacaacctgttctagaaccccaggggcttcttccttatttagttctccttttctgtccagagaatgaagactggaaatggaaaagagaactttccatatccatttctgcccttccatccactcacgatgaaattaatatcctcccattaaaaagtgatatataaggtggggcagtagttctattttcagtcttttgaggaacctcctagtggttgtactaatttacactcccactaacagtgcatgagggttcctctttctccacatgctcaccagcattcattactgctgtcttttgataaaagtcattttaactcaggtgagatatctcaaggtagttttgatttgcatttctgatgatcaaggatgttgagcaccttttcgtatacctgttttgccatttttatgtcttcttttgagaattcagatctcttgcccattttaaaaatcaggttattagatttttccctatgaagttgtctgagctccttatatattctcattattaatcccttgacagatgggtagtttgcaaatattttgatgtattctgtgggttatcactttactttgttgtttcctttgctgtacagaagctttgtaacttaatgtgatcccatttttccatttttgctttggttgcctgtgcttttggggtattactcaagaaatcattgcctagaccaaagtcctggacaatttccccattgttttctcttagcaatcccactgctaggtatatatccaaaagaaaagaaattagtatattgaagaaatttacgcactctcatgtttattgcactatttacaatagctaagctttggaatcaacttaagggtctgtcaacagacgaatgaagaaaatgtggtacatatataatggagtactactcagccataaaaaagaataagatcctgccatttgaaacaacatggatggaactggaggtcattatgttaggtgaaataagccaggcacagaaagataaacatcacatgttctcactaatttgtgggtgctaaaaattaaaacaattgaactcacagaggtagagggtagaaggatggttaccagaggttgggaagggtagtgaggggagaggggagcaggaggtgaagatggttaatgggtacaaaaatatagttatatacaatgaataagatctagtatttgatagcaaaacagagttactatagccaacaataatttattgtacattttctatatctgtatcgaaatatctcatatagtcaaatttatacatctattatatactcacaaaaattaaaaatttggggaaaaaaggtggagcaggctgtccagggaataatcaaaacttctaggtgcaggacaaaatctacaaaggatggctgcaggggctatttaattttaatcttgcttcctggcaatgtagcatgatagtaaatgcaaaataagcattatctgttagaaatacgttaactggctgaaggtattcctttgtgattttagttatcaaaaatgctataatcttctaaaatactagtaaggataaaatgaactgattttattatgtaacaaattaaaaataccttatacttcaaaaataatgacaatatagagaattcttctgtattttattgcactcaacatttaatagaagacatttacattatttttagaaaatccaccgatgttgcacaatggcacatatttgtaaagacaaggctcattaattcagatatttggaattcaaaaatatttaaagttaaccacagcataatgaatcctcaacgtccagagttctacaaaaatccagcaaaacttacttttactcattcatcagttctatgtcactccttagtttccctaaaaaaatatggctttataaaaagtagcttctataattcacaaaatgaagagttttattataatttgagtatcatctctgtatcaccgacagcacagctttagaaaattattgcttttcttattatcttattatttcaggtttcattacacatcgagtacccatgcaggactcactacattgtataataactatgatctatagtgataaaaatatagaagtatctttgattttaatcctaaaagcagggggaaaaagtcaccttatcttaatgttaacaaaatcaagagctacccctaatatatcgatcaaaccacttcttatggctttgcttatagttgctcatggtcctttcaaaatgatgtggtagctaccttcttttctgacaaaggattattttcaacagagcaattatttctgagcccaaaataaaccacattaaataagaagaaaatcttcagtgtagaaagaaaaaggctcattgccgtgaaatagcagcaggcatcgggctctgtgagcttttcacacatcctcaatcaacccagctcaaggcgttactgagttcatctagtaagagcactgagcggtctctagtgctggaggggaattactcaattagccaaaggcagaataatctttaagttatgcaccagtaatttatacaggttttctaaaatttaaacaaatgctgaagagactatagctattatatgattaatctgaggtgccaacaaagcatttttgcatgataatagtagggccattctttttccttgtgtcttaacaaggaatttcagctttcccctctcatttaaaaaaataaataaatgataatttaaaactttcactgaaatattaatttttctaattaatcagctaaaagctacaaaaatttcaaaagtgttaatctgaacacttaaagctaatgtagaaatttttgataagaatatcagtgcaggtatatacaactcaaatcttcacagctaatgatgatctctgttagcgtttttaagagtgctaacacaaagtactcttaatagcttttaaatcatgtttaacacagtgtacacaagtcagtccaacagttagtgttaattactaataatatatgaaaaccctgccaacacaattgctgctacatcaccaatataattattaaccactgtcggaaaaacacacataaattcaggtaagactaaaagctgtctcacaaaaagaaaaaagaaatccaatggatccactaatgctatcaaaagggacatgcaggaatgtaacatgacatttttagaaatgtgtgtttctaaaaagaaaaaaaaatacactaaaatgccagtggactataattcattcaaaacatctttagtgttccttcccaaagatcttgatctgctcagtaattgcttcacaagatctatcacagccatcttttggagcgtatggttaggctggtcctcctgtggtggtaggggcagtctttttgaagctttaagtatctgcaaaaataaggggaaatctaaattaaaggaccaaccagacacagactgtgaaactgcttcattttcattctactttttaaaaaacccaccaacaaagtaattttttttttttggtgtttgtttttaaggacaacttggtaacagaataatcaactaccgaaagaagcccctggggatggcttgcaaagctgctgatgaaaatctcaggttctttcgagcacttgagaattaaaactgaactgaataatctcaatcttttaagaaacacagcattaaatttctttcttcaatattttcactctattaaaaagaaacagaaatctagtatggtatttgaaaaataaatacaagaagcagtttcaaggatcaactggacactataagctgcatttaaaatatattgctttaaaaattaaaataaattttaaattaaaataaattttaaaaaattaaaataaaaattaaaatatattgctttgaaaattaaaataacataaatggttgacaataaaagtatataagtattttaaaagaagtaaaattcattcctatccaactttttacaattttttttttcattcttaactttagtatctgatttgttttactatcacagaattggatttgtgttacaattaaactagaaaaggaggtggtgcacagaaaggccctgcaaaatcttgatataatttttaaagctggatcccaatatttcctttcttccttcctactttcctaagaatttctatctatctatctacacatgtgcaaccaaaactttttatgtaagtggaattgtttgggaacaactagacattctatatatacctttacatacccaacataaatgaatgcttctatttccccaaaaagacattacaaaaatattcatagcagctttcttcatagtcaacaattgagggaaaaaaactcattgtgcccattaacagtgattaaaaactgtaggaaatagttatgaataagagcaaatgactacacttaacaaggtggatgaaaccacagacaagatgtagaacagaaacaagttgcaaaaacaaatgtgtgtgtttatggatcttaaattcaagagcagacaaaactaatctacgatgatccagttcacaagagtggttacctctggttggggtatgactcagaggtaggaagagggagacatttctggggtgttaaaagctttacgtcgttttatcttgatctgagtaacgggtacgagtatatatgcatggaaaaattcaacatttgagcatttccacatgtataaattataccccaatagaaaaagtttatttaaatgagttttagattctcttggcattcaacaattttctggactttgatttgagaggaagatacatttcagaagtaccctgggaaaatggaaagttgttcaaagtataacaatgagtatttataaaaaggcaaataaactaaaagttctactacaattttgaacaattccaataaatgtctgaagaccccattcagaagtggttatggtgcaaatcccacatctccaaaaccaggaccgtcatctcttctgctactctccatttcttcctgccttctctatctccattaacattctgccattcattcacaaggactcaagccagaaatgtaggaacgtggactcctctccctcccccatcaaattatttccagctccagtttccatgaaatcaggcacctttccattcattctactgcagccaagctcccaccatttttggcttagcctacggtagctgcttcttactagtctctacctccttgctggactaacttctcaaattgagattagatcatatgactcctctgcttggattttttcagtgacttcttgtcatttttaggcaaagatccaaacttttattttttgagacagggtctcaatctgtcacacaggctagagtgcagtggtgcgatcatagcctactgcagctttgacctcctggactcaaggaattcttccacctcagccttctgagtagctaggactacaggcacgtgacaccaagcccggcttttttttttttttttttttttttttaaaaaaatggggtctcactatgttgcccaggctggtctcaaactcctgagctcaagcaatcctcccaccttggcaccccaaagtgctgacactacatgcgtgaaccactgtgcccagcagatcaacacttttaaacatagtatataacatcctctgagaagagacacttgcctacatttcccctgtcctctttcacccgtctggcatgctgtcatggcctttgtgctttgtaagctctagcttcctctgctctcctcctgccagctcctggagcttttatcaacacctgaaaacagctaaaactagcacaaggacatctgggaggctaacctcattctctgtcccacccctctgaagctgggtgagttatctctccttctgtgtgttgctgtgcacagctctgagaaattaattgtacttattttactccaccatgtacccacaggactgtgaaccaagcaagcacaacattgtcaatcatgtatcttcactggccagcacagagcctataccacagcagctgctcaatatatattttttgaatagatgatcaataacaacaatatatatataaagcacttatggaatattagctactaagaatgtaaagtcaatttccacccttgcccccagacctctggtgttgctagcctaaatctggttataggccttattgatcaatgttaaaaaatgctgggtaatggggaggcctgtgtgaaagttctggatggatgcaatggagtgaaaccactaccaatgctggaatactcagcagtgggataagctgcaagtggtatctccattttcaaagacaggagcagcagaattacccagaaaccatgatgctcacatacctgcattctgaagaacatggttacacaaaacataaactaacttttaaaattcttttctggcagggtataacagaaaaatagttaatagactcagtcatatgacctaaagtattgtttgagaggaaattttactccaatgagctttcacaagtaattccttcataagtcgttccatttgtgttgtgtatatttatgctgtcagattgctacaaatatgctgtatgatttcaagtaaaactatgagtttaaggagaaaggtgaaaacctgctaatggatgagaaattccaaaatcaatcttaaaaatctaatatccaaagtgattggcctataatatcagaaaaatcaaatcttaagcttaagcttccacatgcttgccaagaatccacgtgcacagcacttacaaatttataaatatgcaagaaagaaggcagaatgcaaactactggacaacttacttttctactatacatcataactcaacctttgacattcctgaggcctatgtgatgaactaatgcagattaagagaaagatgctgaagaatatataacacatctgattttaccacaccaaaactgctctcaaatctctcagctgtcacgtcttcatttatttaaaatcctttgaaaaacggcagctgacagtgtggactctggagccagaatgcaaggatcaatccgatttctaccacttgtcagctctgtgacctggggaaggttacttggccttgctgtgcctcagtgttctcatctgtaaaatggaggtaatggcatatctacctcttggggtcttagaactattaaaggtcaatccacagaacgtgcttagcagagcgcctacataatgcttaataaacatgaaattcactgttccctactttagatggaggcaatggtgataatgccacttgggattagcacattgatagttacattattatgaactttaataagctatattaagactgtataacttagtattaggataatcagagaaggcaaatcaatcgtcaattaggttccaagggaaaagaaaaagtgaactaatattcagcactttgcagaagtcctcaatttgagtcttccactgaataaaagaattttaaagattgaaaaatggcaaggaggtaggccctataattagtgttcctacaatcagatgcaaaattagactgtgcaaaaataccacaaatacagatttatgaagattgcacaagtgaataataaaaaaattgtaacatgtggtaggactaagagtaagacttaagacttatagaaaataagaaaaccaagtgcaatggttaaaaatacggccatgtgtcatgtagcaatgttttggatagatcaaatatatgatggtggtcccatttgataatgaaaattcctattgtctagatgcatcttagctttcataacgtcccagcacaacacattactcatgtgtgtggtgatgctggtgtaaacaaatctactgcactgccagctgtattaaagcaaaccacatacaattatgcacaatacataatatatgacaatgataataaaggactgttaatggttttactctcctatacttttacggttcttttagactatattcttacttgttaaaaaaaagtttactgtaaaacagcctcaggcaggtccttcaggaggtatccagaagtcattgttatcataggagatgacaactctatgcctgttattacacatgaagacctttcaatgggacaagatgtggcggtggaagacagtgatattgatgatcctgcaggcctaagctaatatgtctgtctgtgtcttagttttttacaaaaaagtttaaaaagttaaaaaaattgaaaataaaaatgcttataaaataaggatataagaacatttttgtatggctatatgatatgtttgtgttttaaactaatttttattacaaaatcatcaaaaagtttttaaaaattaggtttacaaatttaaaaaaattacagtaaaccaaggttaattattaaagaaaaattttaataaatttactgtagcccaagtgtacagtgtttataaaatctacagtagggtacagtaatgtcctaggctttcacattcactcaccactcacttgctgattcactcagagcaaattccagtgctgtaagctctactcatgaagtgccctatacaggtatatctttttatttaattttctataccatatttttaccatactttgtctacgtttaggtatgttttcatacacaaatatataccattgcattataactgcctatggtattcagtacagtaacatgctgtacaggtttgtagtctataagcaatatgctgtaccatatagcctagatgtgtagtaggctactctatgatgttcatacgtggacaaagtcacctaacgacacactctcagtctgtagccttgtcattaagtgacacatgactgtattgctgactctcagccttacatcctcttctggcagggtcaaactacaacaatgcagtggatcattcaaatttttatggtaccaagttacaggttacaacttctccatgaggtctttcagaatgtagcttctcttgatcttgtttggaggttccagcaggggtgctactcatatacccttgactgaagactggtcctcctgtatcggggacggtcatgctcttcaactgagcatgcagctttgggagggatgcacatggagtggagagggatgaaggggacacctgcctggccagccagatcagttgaatcaaccctgatgatcaatggggtgacagatgtcacagccagatggccctcacatccatcacagaggtagatcttgatctacctctaagatcaggctaattaattactaaacaatagtcatagccaaaacttactgggagcttattataggtcgggaactatgcatattaatcagatcttcatttgtatgtgctttggttcttaaaaatctaaaaaagcaccttattccatcacctcagaaacttggtgtttcatatttacattccaaataaactattgggttcagttataaaatgttaaaagtatagaaatttttggtctgaaaaatattatctttcatatcttcacaaaaattagatcagtattttaaaatatgaactataactagaaatatattaatttgtacaaacattatttttaggaatataaaataattttctgttaagtcatggaatagtcatcaaaatgctaattctgtaactggtcctgcctctttgatacaaacagggtactctgtgaagcagtattcaaaaatgaaaaggaaaccagcagaaggacataaatatcagctgcccttgccctgtccaagtattttaaacacaaatacacactgcctagtagtcatcatgtaaaaggtcaatttctccatggactgcttttctcattcatattataataccaacaattccattctcttaatcaaatatttgtttctgcagataattattattaatgtacatggcaggacaactatcaaaacctaaggcatcccatatataactaaatatattctttgattattttatccttttttatcattaaagaaagaaaattgaaatttagtatttaataaattttggcaggcacaattagttctaccaaaatcagtaataggaatgcacatcactgctacaaaattcatgttaaaatgtagaaaatataagtaaaggttgaacaaataaatatgacacaaaaataaaatgcagaaatgagaagaaatacacttgggaaagaggtaggattttccaaatcctgtttgatagaacattctttcccactatgagagtacgaggtttataaactcacttctggttgcaggtatagtttatgccatctctaaaatgcatttgaaagcataggctttggtggaaatgctgttaccattctttatattaactggtgacaagagggctcaggtagaggaaagtaggaaaaaacagggaaaagtatgtaatgcagtgaactaaaaggaaacaccctgggacactgacaagcactgggcagcctggactgtcacaaagcactaaagatgctctcaggagagatggggaatggagaggaagaggagtaatgtcacaatttatacactattcaactttcatcccaaggcaattctgattccatattctccatcaaatagcctgtcaatcaaagaggaaaacaaaaaaactctaacttccactactaccaccatctataatggcaaaatcatatgatcattaatgctcctcaaattctagctcagcagatatgtactgcactgaatctgatgtgcattttccattactttggttgaactgatcaaaacagaaaaattctaaattaaggtacagttaatctctctcaaaatttttatccttcgtagattcattataaagctattggtaatattaacaggatttttaaggataacaaaagaggaaaatacaacatacaaaatgtcatacctggtggtacttcctgctgttcttccacaggaaaaatgcttacttctaaaataaataataaagttataatctgttacatattgctgatcagtgtttaaaatatgcgttgccagatttaagtaatgatgatacttttcatagattttttaaacaattcaattgaaattttaataaaaacattaggcttctataccctcacaacaaagaatgatcagctacaacttagcaaaatgttgtgtatttctcaacggttcagcacagcaggttttatagtacctgcccgactaacctcaaactccactgcccagcaaaggagctatggactaaaacttatgctttcaccacaattttgcatcagatttgataagagagctgtggaaagacacttaaagtatcttatttcttctttaacatcaaacactatccttcatgaagttgttttagaaaactaatattccagataatatattctgagactagtcaaagatatggatgtgaatgtttaatatcctgtctttttccttggttgcttcaacccagttacaattaaagagatggtagatgtccccacccagtgatttaaagacatagtgatctgatttgctccatgaaattacatcacatattaatatcttcaaacctagcaacccatttaacattaccttaacctagagataagattatatcaacattccttttggtccttaagaattgttaacaatctttggccaaaagaaagatttttttaacagtattttctaaaacagaaaacacttatggagctattttaataatttttcttcttgcattaatttgcttctaattataaaaaatgacacatgctcaaaacagaatatttggaaatatttcacataaaagtaattgaaaacagcaacaaaaatcacacccattcccactaaccactgttagtatctggcaatattttcttcttataacagcagtacagtgactattgaatagctatgttgtgactggcttttaataggtttgcctgtttattttgttcttaattatttggagacatattaacactttatcaactttgccaatatttttctcagaatttcttttacttttgttattctacgctcaaaatattgtacatcataaagtattagttgctgcttttgttatttccaacactgatgttatactaagaaagccttattattattgcaagttaaattttcatctaaatttattacaaaaaatatacattcaacaaactcatatgaaatttcttctggtatatgatgtaataacatgatttctaaaaagtaaaccgtgaattaattctatcagcacaatctgggttacctattttatagcctacttttccttactccaggtctttttgaacccacttcattctgtatggctttctcttcccctaatttactcaaatggcttttggtaagatcactcacaatctctacgtggccaaatgcaactgataacttctcagtcctgaaattcctgggccactcaacaacaacatgaaacatattcacattttcccttctctacttctccactggctttcctcctcacacaatggctgttcaccttccacccaacctcacaatattagattcttagagctcagtcctgggcatgcctctttatcgtctctccacttgcttccaaaatgatcacatcagtttccatggatttaataccatctccacgacaatggctcccaaatgtttatattcatcttaaaactcacccaactagctcaggttggcatattcaaccccccacttgatactttcacttggatatatcacataactcccagagttaaaatgtctgatctggggcgttttattttctctcctaaaccagtttcttctataaggttggtgcaaaagtaattgtgggttttgctattacttttgcaccaacctaatacattctaataatagttttcttctctataaatggccccatcatctaatagttactgaaaccaaataaaagaccccctttattcctcatctttgcttcacaaccatcaggaaggtcaattaattttaattctaaaatatatctcgagttcaacactttcccctccattcccactgccatgatcttatttcaggctaccacaatcacttccttggattagtacacaatattttcctaacagggtgtttcgctctgcttccgttcttgctccattcaatctagtgaaagtaattcactttcacatctaaaacaaaaatcagattatgctatatcttaagaattttcataattcacactgtgcctagaatataatccaaaaagccttagtaggccttgcaaggccctgactgatctgtacctatctctttattgcttaagccagtttgagtttcgttttctattatctgcaactgaaagtaactttactgacacagatggagaataacagaagggtttaaacacagggctgatacaatgagagctatacttttggacagatcatcctaacagtatgtgaaagatgggtttggaggggacaagaacagaatcaagatgtctagctagcagactactgctattatctaggaagatgagaaagggctgagccagacaaggggctatacaagagctatggagaaaaaaatggatttaagaaatgtttagggagtctattaacaggtcttgggattagctatagagacagagggagagaggactcaaaaacgagttccatgtttctggtctgggaatccaagtatatattgatacaaccggccaagagaagaggagacagggaaaacaaggttggttgctgtgagagataagctcccctcactgtccactcaggcactacaggagcccagcacagaagctgcaggatgggtggcaggtgcatagccaggtgcctcactgcccaggacaggaaactcccttagcagcctctgctatgtcctctgtcaacatatcaaaatactgaaaagtcttaggaaaaaactatttctaaaccaagaaaggtagggtcaaattgcatagttcttttctataaaccatatgtagggtaggttggagaaagttctgcccagagattatgggtttccatcttctgattctcaccaaataaacatatagactcagtaatattcttcagaacattaatatccctcatagagaactgagtaacacaaggtgggaaaaaatctcaactcaattcagccttgccacacagagatggatcctgcctttacacaagggcccagagtgcctgtacaggggtctctcgcagcagctaagcggacacagacagcaattttagcctccccgattcccttatacctatctccccccatttcagtcaactgcaccattccattttcctttctgcctaaccaagctcaaaagcagtaacatttaatctgaaaggtgacaattagctgctcctaaattttaagagtaattgtaagagcaaaattctccctcttacatgctccccctggcaacttatggttgttaaagcagagaccccattccctcacaccttcacacccccacgcagagtcacccacaggtcccagtcttgggtcgaatatccccttggtcacttacagctatgaaacctagggctagccagtcacctgacctcactccagcttcaggtcttcatttgcaaaataagtacaaagatctccacgctccctgtttctcagtgcctactacgaggagcaactgaaataatatatgtgaaataactgtaaaatgctaactaagaactgtatttaaatctaagttctattgaagcgccactgtttaatacatgcaattatttttgtttttcagaaaccatcccttcagttctccaccaccaaaaaaaaaaaaatttgttttgttttcccaggtgagtcatgacataaagacccatctttcaacccgtctctgcccatagctatgcccttctcaccagatcacccctcaggggtggtaacctgctgctactcagggtagccctccacaccctcatcaattgtttgctgttacagtagcctgtttttatcactatcattgtacttctcataatccttaattccgttatttattatctgtttggccactggaatgccagccccaatgaaaagaggactctgtgttttcttccctcttgtactcctagctcctatgcactgtatagacagcaagtaggaaatgttcgataaataactgaataaacaaacacaattctcatatggaaggtaaaaccacttccataaatttatcttaccttctacaattacctgtgaatcttctacaggattatcctcagggggagcagttacttctaaaataaagaataaaatcagaatccattacatgttgctgaccagtgacacatcttacattcactcgccttcattcagattcctaaattaactcgtgtccactcagattgctaaatttgactctttttaaactgggtcttctgcagagtatttatattagaatattaactttaattttgatactcaattattttcttactgacttgaaaatgtcttgcattttttctacactgactctttgttccacaggtaggagttttaacaaaatacagggaaagctgacttgcagaaaatatgtgcttacagaaaaaacttacctgtgatttctatcccttcattttctagaggttcatatactgctaaaaaaaaaaaaacagaaacaaaatcccgtaactttcattgtaacacaaaaactgacaacatgctttaagggcagagacaatgccttatgcatctttgaacctgcaaggttcagtcactgggaaacagccgactagagagtagggtggagaagagtttggtctagggtaaaacaggcctggattctaattccagggcagccactttttactacctttttaaaattttactacctttttaaaattttcttcatgtctgtggtggaggttttgaattagccgaagctgtaccctgggaatcaactggatcctggtgttcatgggcagattccctgctttgtttaggaaacaattctcagacctctaacctggggccaaacacctctgccgccagcccctgagaatgaagcgttccccaccctaattagggcgtgctgcccttgcctccctcatttgctggcatgaggctcagtgcttcttctctgctctgctgcaaggaagtctcatctccacacaggcctctccagggcccagtggctcaaagcttcctcagtcaacctgatcttccaaaatacctccaattttctggcacactacaagaaaacatccttctttttcccagcatggttgtaagtttattctttcttattcatttaataaagaaaaattattgagcacctactatctttcagacactctcagtattggggtacagcagggaacaatgtttaataggtcgttttgtccttttggggcatttgaaagatgaaggagcagtgaatgtgtgctcactctgttgccctgagcagtgtcagcatttaaacatgctcaagcttctaagaacttaaaaatgcaataccactctttcttaagcttgcttctcgtcaccctctctttcttccattgaacaatctaatttcttcagtcatttacatctcatggctcatctcttcctctcccctcaactcactcccgcctgtcttcagaccctgaccccatccctgaaaaggctcctgctgagaccccctccagtgcctcatttgatatgatggacactcgccagccctcgctatatttttagcaacaccattcttctccaaacactgttgcccctggacttcagggtgaccatactctcccctttggtttttcgtttctcccactcaatcttctttttcacttcatctttttcttagccgtccttaaatgctggctttcttcaaagtccagccatagaaccacctcatgtctccctcaatctgctctccttaagggatctcagagcttggtcctgatgaccacgtaactactctgatggttcccacactcacaatcacgaagtagacttctcttctgagagtcaaacaccaccaaatggctcatttgatctctcctctcagatgcctcaaagaaatctcactatcatcatgtaaagaactggactcatgagcccctgccccgtgcttgactccagtctctcccacgttaggaaaagagcaccccctgtcaccaggctgcagaagcagaagagtgtatgtggctcttggcaccttgttgtctccccccagctacacccatgcatgaagacctgccaattttaccttctaagcatttctcaactttgcccacttccctcctccatcattgccaccacccttggtttaaactatcatatctgtcctatccgtccactgaaacagttccagctaaagtcacccgttgaggccactgcagcgccagatcagggcaggttttcagcactcatctcacatggttctcagtagcgcagggcaccactgaacatccctttcttgaaactcatctcctttggttccttcagacagagagagatgtgatgcacggaaagacccaatttggatgattacagctaacttaactgttctccctgtattgactcttgtctctccagtctgtttgttgcatgccagaccgatcaatcttttcaaaatgcagatctgacttggcagtgctcaaaggtgaagatgaacgtccttgatcttgctcacaggcatcctctgaacccagcccatttcaccacctcagccttactcttgcaagttcacgtcagagacctcatacgactctccagtcacctttctccttgccttgtcaattgttctcaccttcagctcaaacttcaggaaggccctgcctcatccacaaactaggtaaggtctcttgattacatattcttgttaccactgtacttgttcttcctagcacttatcacaactggaaatgaaaactacagtgaaattgcttgtttaatttctactaccctactaaaatataagatccatgagaacaggaaccatgggtgttcttcactagaactgctccagtgtcctgtgtttcagaccgaagacactaaacagtgtatgaataaataagtcaattacatggtaaggccatactgtcacttcccaggtttgtccaatgtaggcatgatgatttctaggttatctttgatgtagaagctggttcctactatagttctatcgaagtgtatgttctggggtttgcaagtttcatacagaatatattctattctcccattgaaatgtggttttgttttcaccctacttacagcttcacttacatgtcagttacttggtttctctgctctgattcctgaattttcacaaaggtattgttttagcatatagtgaataatacactgttcaattagatctatttgtttgaaacagtttatgttctatataacaaagaaatccaaagtagcttaccaaatcatgtcaatctcttaggttatatttactgccttttgctaacattttaaattacatttattatgatactctgccctatgaaaacatataacattcttttcgcatggtatctaattttatacttcttatgagtttgaatttaaattcctctagatttagtcctcaaattgcattccaaacatgttctttatatttttaaaaacattataatgatcagtagaaatgaggaaaatatctcaaatcccatcattacatgcaacttgtatttataaattcctattttctccttcaaattcaagattggaaagaaaatctaagtgcaatctcaagaccaaattattccccaaccttccctcggccccaaatcttcctgtgaacacatcaggtccaaattctttaacttttcataaaaattatcagtaccttaaagacacaacctaggatttttcccatggtgtcattcatatcccattagaaatagccactatagatgatgaacttggtagggtctcaaatcttaaatcatcatataaatatgattcatatttataaacactcctaattttcttcaattgtgattcactatctatcatgacactgtaaactccttgaaaggagggaccctatgttactcatatttgaattccaggccctaaaaccatctagaacatagaaagtcctccatatccaccaactcaattacgatgtatttcttcatcgttcttgctttacacataaagttatacccaactgacttctctctttctacataatcatctttgaggataatggaataaaaaggatatattattggttctattacttcttagccatacattcttgggcagcttatttataatgtcagaaccttatttctgtcctctgggaagcagggaaaataaaatctacttcatggagttcaacacaatagtctatgcaatgcttggacacaagaggagggaggtacaggcctaaactgaatcagatgctgctgatgccacaaatttgccagaactgttttctccatactgcctttaagcctggaacacagtgcttcttaaccttccccaaggtgacaaatcagtcatctttgagagtgggattaacctgtagaagcagctagagcaatttaactccggctaaagtagttgttcatgcatattttagtcaaaagagacacaactataaagtactgagattggttttcttgaatgactgtaactgcctcctaaggcaacttgtaaagagtttaagaaattatttaggcaatggcagaagccgtggaatgggtaaacagtctccccaagtgaattctttgaacgctaccgttcatctggatgttttaagttgcaaagtttatagtttaaagcataatgttccacatcttgtagtcaaactataggtatattttaaaacaagaaggtggcttaaggttagaaagcatttgcaggccgggcgcagtggctcatgcctgtagtcctagcactttgggaggccaaggcgggaggatcacctgagatcgggagtttgagataaaccctaaaatactaaaaatacaaaattagctaagcgtggtggcacatgcctgtaatcccagctactcaggaggctgaggcaagagaatcgcttgtacccaggaggcggaggttgtagtgggccaagattgtgccactgcactgcagcctgggcaacaagagcgaaactccatctcaaaaaaaaaaagaaaaaaaaaaaaaagaaagcatttgcaaaccttgttcctcatagacttggtatgttacatcatctgaaaaaaaaaagagaataaaagcaaaataagtattaactgagtcattctatacaattgttcagttaaaacaaaatactacttaatcgtaaacacagaactctactccttcaaatattaatgtctgctcagtcaataataaatgcctctgcccaaaagcaattaaaaggcaggtaaattattttcattaaaatttctcaaattggcacagaggaatttgatacacaaaaacagcattaaaatttgacatcctgttttgttatggaatggttagttgatgaggtgaaatatgaaagcctgatattcttataacagtctaactttgttataaaacaaaatctcatgcattagatgtcgaaattacttctttgatgcctttaaaagaaaaatcaccatgtaaacacagcatgtgattgaaaaatctaaggtaatattttaaatctaatgaaaatgctcatctaatacctgtatcatggtgcaatctttcatcttctactactggttcactggaatctaaaaaacaaaaacacacctttgccaaacaggaaaaaaccaaacacattgccagacagcattctaggagattcataaattaattatcttcacaactttgccagatagatgttttcattatcatttaataaaatttaagctgaataacgttccacaatttgatgcctaagtcaaaaagataggaaagagtagaaatgggatttgtacccagaatgactttatagtacatcatactgccccttcaattttcaaatattctttccagcaccttacctacaaagaccaaagtctcaacagtggtttgaaaaatacgtctcctttttctctcatccctctatgtagtattaaactatattcagacatttctataaacatctgaccaatcaaaagtgattataaataccatacagggatctctgtgttgaatcacaattgttaaccctggaataaaacggccttggccactgcctcaatcagaaaacacatatcaataattttaacatttacaaacctggattttcctgctcagacatcatctcttccatatcctgattacagtcttgtgaaactataaattatggaataattaggaaattacgtctcaaataaggaatacatgtaatattcgaaaccagaaagacacaatttctagttatgattgaaatgcaaaatcaagtcataatgatattcaaacatgttcactcctgaaacaaataggtattaagtgtgttaaatgccaaatgcaaagatgagtaaggggggcctgtcatcaactggtttacactcaaaccgcaaaacagtaaagtgctgacagatgatgcgcccacctcctgtggccatgccctttaagggcgctggcatgtgacaaaacatgatttagacctttcgttgactctgtaattgaaaggtacaaaacatgcaattcaattgtatcttttgaactagtaatcctactgaaaatttatcctcaggaactaggcatcaaaacacaaaaaagtatattcacaaagaaataccataaatataagacgtaataaaattattaattgcatatcttgcatatattaatttaaatatatcattaataatagatattatgtattttatgatgcccttttaaaggaagactcactctaattaagaacagaattaaattaaaatctcacctgtctcttccacgtggtaactatgctcggtttctggaaaaaaaaaaattagattgatatttactgcttttacaaaatggtatgtatatatcccgtatatgtactctgaatctatgcttatcattaattttatttaaaaaattaaaaaatgggactatcaattaaaagtctgcttaacacttttatatttcactagaagtacactgtgggatgtctcacacattctccttctcagtccactcatccccacaaggctgacaaccaccaccccctggactaaagagagaggacaacttagagtgacacaggccagaccaggaaagccgttcatttctaatccacttcacaacccactagaatgtgctatttcctcgacctgtcctaccattttctagagcgaaagtacagcaactatggatgggaacagagaaaaacagctgaagaggctttatacccttagggagctgaagggtaaatgtgttgaacacttaacccatacaccccagatagcagaagagctatctgtccgtcaccacacttatgaccttgctaattttatttaatgcatatataaagaataaatatttttattttctgaagacttttaacaaccaacttttaagttcaaactgcatctatgtcctaattaaagatgagatcagaaagtaaggtttctgcaatttgtgaacttcttagaagtgtttcttcctactcccaatctgtgactcctaactttaagaatatcaaattcctcatgcttctgtttatttcagcatcttaactgaaatttgttgtataagcagcatgtagatagaaaaattctgagcaactgtcaatcttactgagccatttaggccaaagactggagagaagaagcaacaggaaatgtggaaatcattttatcagtatccctactcagaaactggaaaccttgtcccaaagaaatcatgacataaatgattactaaaggcataaagttctgaaggtagtctataagtgcttattttcaatgtgtaatgcagcaaaaataaatcatatagatgttcaaaaggattgtgtgcttgtatttttcacagaaaattatgcattatatacaattcttttgaaaaccaaaccatcccatatttttatgggaaagtgcatttcctgttctaaacaataggcatggatataagtttttggaaatacatgtactcataaagtaggagctacctgctgctaaagtaattttccaaaatatttagtattgtgcaaagtagataaactacttttcatttttatgcttttaaaaagtgtttgctaactggacacacaatggctcatgcctgcaatcccaacactttggaaagctgaggcaggagaattgcttgaggccaggagtttgagaccagcttgggcaacataaggagaccttgccactataaaaaatttaaaaattggcagggcatggtagcatatgcctgtggttccagctacttgagaggctgaggtgagaggactgcttgagcatgggaggtcaaggctggagtgagctgtgttcaagccgctgcacttaccagccatgttgggtaggattttacaaataagttgtataaaaacacagctacactgacccacttaggaactatcaaaggctgcttttacgctgtgatggcagagttgagtagctgaacagagtctgtacgatccagaaaacctgaaatatttactctctggctatttacaaaaaaaagtttgccaatgcctggtacagaagctaagaattgtgttttgctcactgtaattacagagttcatgtgtgaacatgagcctgtgatagattatcaagtccaatatttcatcagttgtttgaattttatttaacaaatagcaccctaagcagaagaatatagtaaaactagtttcctcaagtatttgactcactatttataagaaatttgtatattctgagtttccctgaaaagtgctttgaaccaaaatcaaggtatctattttaagaaaaaatttgctttaattgaagctttaagcttcaacttttaaaaatctaagcaaaagttaaatatcagttttaaaggggtttaagaaaaacttcagtaattagaagtcattgattatattttatcctaaaacttgaaaaaaaagtgttctaccttcatgagatacttcaggttccagggtctcaaatctatcatctacatcagtcgccataagaaactcatcatcctcttgttgtggttctcctgtgggtccatcttcttgttgcaagtcttctccctcaactatgacaatgaacaaagtgacactggcaacatacaactgagacatgaaagccccttgtgaagggctgccacacacctgctcctgctgctggggcttcccctgcccctcctttcggccgctgaagacaccattgtccactccacagctattttcttcctctggccaagtgctaatctgcctaagtatatgtggtgggggacaggtttcctctcattaggatgttacacatcaggacaggaagcttatatattttatccattatatattcccagtcacctagggccatgtctagctaaaggaagcactcaataaatatttgatgaatgaataaatgaattcataattattactaatatatttgcctcttcaattatcctcaggtcaaagaaaaggctactctatggccttttcctgggaattgacatagaattccaggtaacaactttaaatgactattcaaatattctatagcaaagagtgactagccacctatctaaattatatgctagggccaggcatggcagctcacgcctataatcccagcactttgggaggctgaggcaggcagatcacttgaggtcaggagttcaagaccagcctggccaacatggtaaaaccccatctctactaaaaatacaaaaattagtcatgcatggtggcacgtgcctgtagtcccagctacttgggaggctgaggcaggagaatcgcttgaacctggggggcagaagttgcagttagccaagatggtgccactgcactccagcctgggtgacacagtgagactctgtctcaaaataaataaataaataaattaaattaaattaaaaataaataaaaataaattatatgctaggtcacaggtttacctgaatcatactatgcattcaaatgttcctattaggcttcaagttatgcaaagatgcccactttctcttctgtgattaacttctatgatatattgaactgctctgcttcttttgtgtagaggttggacatgttacatgattccactgcaacatggttaagactgggtattgcatcccaatgtaacttgacctggcttccagcagagtatctcctgtgtataatactctaaagaaagtgaatgggcaggacttggctttgcagtgcagctcagggattgggacgagtatggggtccggatgcatggctgtagattcaggatcttccataccagctgggtgactgtgggcaaattacttaactaccctgtgccacagatttccctcccataaaatgggaataatatctatttgtaacattgttatgaagattaaaacacttagaaaaatgcctggccctaagtatttaggtgtcattatcatcattattacagtaataacaacattgtcatttgtactgctactgaatccccctaccccacaaccccagcccagactgcaagaagccttccttagttactctccctttagcgtggcaaggcaatgctctcaggtgttagagaatcaggcaggcctatttatgttgatgctatttgttttctatcttctcctcatagcttgcaatactgtttttcctcattttagattttctgctattcagcaaatcaccaatttgaatttctgctacaaattttacttctctttttatttttatcatattcctctttccttattcttctttcattctatccagtgaaatctgatgatttttacactagcaggatttagctttcgtatgcggttgttcagtggaagtattcctgttttctgtagcgaaaccagtctaacattgaacactatctttgagtctcatcatgaaaaatttcctaaggggtcatgagactctaggcatggccaagccctctgcagctgttatatcctccctgtgaagcaggtactggtatcctactttgaaagatgaagaacttgaaaaactgtgctaaagccacatggctaatcaatggcagatacaggacctgaatccagttgtgaatgcaccatgatgggggcagggaggttatgctcagtctgaaagatgtgattgggcggggtgggaaacacatctcagcaaaagatataccaggtgcaggggtgccaaagcagtgataggcttggcaattacaaggaaaagagaggtcagctgggctagagaaaagtcactgaaggggaaaaagaggctgggatcagacaaggcacaactggctgggccacattaagcacaggttatagaggagcaagtatggaaacagggagacccagctggatgctactgtgctactgcaacagtcatggcaagaagccacggtcacaccgaggccctagagagccaaaatcagtgctggggcaatgctgacaggatttgctgatggattagatgtgaggggagaagaaaaatcaaagaaaactctcgagttttcaagttaagcaagtaagagggtaggaggaccattaactaaaatataaaagactagcataagcaatctggggagaactggggtgaggaggagctatggggtgtgggaagaatcatgagttctttaagtctgaaacacccataagacatccaaatggagatgccaagtatgcagttaggtaaacctggagtttagatgagcaatgagggctgcagctatatatttaaaagttatcaacatacaaagaatatttataaccatgggccataaatgtgattttctaaatgtgattaaagaaaagaacaagtccaagaaggaggctgtggccagaacacggtgctagacttgactacttccctcttttggctgcctgcccaccccccaccacctaaacatcttagggttctttctatttctctccatcccctcctttggctgaggcaagtttgctaccatcctgaatcactgttacctgcacaacctccatctaatctcccagctgcactcttgcatccccccatgcatttttcatgctacagacagaaggcacaacactcctaaataccttccccaatggcttcagttactcttagaatcaagtaaaaaatatcctttttctcatgactctccacctacatattccacgtgccagccattctgaactactttcaggtcctttcctgtctctgggatatgccttctgcttaaaacactcaccaccagcactggcctggtgaaggtctacaccagcctcttctgaccccccttctgagtaagacctgaagagcttcccgtattttattaccatgacagcacttaccccattatatttaaatcacttatttatttagattggattttccttctgttaagttaaagttggggtgccgtggggaaggaaggcttgaggaaggggaagcctgcacttgctcatataggcccatgagtggctttccgagctgcaaagaagctagaaataaaggcatacaggctcctacacccctagcatccactggcaaaaaacagtttaaactatagggcattgtttgtttttaagaaacgtaattttattttcctttaggccacccttggatcacaccaaagcatcaggagaatcaggattccagaacatcctgcccactccacaatcccttcatgagatacgttttgggatcacgatctctgtttttatcaagggatgcttcaagaagcagccttataaaaccttaaaacgttagttcctgggttattacttagtatcctctacacagagctccccatgaaaaatttttaaatttaagtactgggaaaatgttttgcattctcacgttttttttcctgtctgcttagtgcaacctatgtaattaaaagtgtcatcatttttgttgtggtgaccagccaaccatgaagcaaaatcgaggtggagcacaacacctggatgaacccgaccgtgggcctgtgtcccactttcctcctctccatcctccccttctgttcctgatggatcactgttttcaatctgttcattctcatttattcccaccagttctctcttagatgtatgcagtgagttcctccacggtgaagtagaataaagtaagtttagtgctatttcaaaaacaacacctgctatctaactttgaattcaaaaactttttaaaaaacacaaacacccaattaacctttaaattttaaaacaaatgtccaagtcattttacataactaagcgttattttagtaactcaaaacaaagagcagattttaattcataccatgttctgcgtgtaccatttcatggagaagggactgaatttgttcttttgcttcatcttcgatattctggggttctaaaataattgcaaaacatagctaagtagaaaagctcaaacatcaacatggacccctaacactcaaatatgacattggtgcatacacattaaaatgaatatatttgactaagcaactctgcatgccttctctatcagcttacatttttttgttctgtgttggcaaacatggtagatatgtaaaatttgttttattctgtcaacagacttaagcattaaaatactttcaataagatttttaaagaaaactcaggctcagatttgtatttaaaaaagagccttattaaaagcaaaatgacttgtttctaattaataaaattcgcaataatgataaaataaagtgggaagaacaaagctttcataaagggaaatagttggaaataaagacagaaatgtggaagacaaggtcaatacagattgaagtatctggtcaaccattacctatcttccctgagaggagaaagggcactcctgcaggtgagaggactgaatactcagaggtagccgactgctctcactcaggtttgtcaggaagtgtcagtagaaaaccttacattgtaactgacaatcctttcagctttggagaaccacatctgacactgagatccataaattcaaataaattgaattacaaaagtgaacataaatgatgacattccaaaaacactgtggtgcttatcagattattagacttaactgcaacatcacacaatgaacaagaagctataactacattgatactaagttctctaataaatataatctatgttcagtgaatagaagtagcactacacttggtatcataaatgctgtcatgtgagataatgccagtgacatcggttgttgtcaaagagctaatcttccatgacaaaaaatagaaagttaatttagacttcaggaaggaaaagagtttaaatgtaatatctactatgctaatcacactacaaaatcatttccaaagcataaaaatgcctatttttaataaatgtttatatttcacaagccatttatatatgtagtcttgtgctattatagagtctgccaatcgccatcctctctcacaaagcctaagatagcttcctaactggattcccaggttcataactgctgaaatcaccatccaaagagaatataatctgagttactagaagtggagggtggtgcactctgctcactctttaatggctatctttgcccaaactggtgaaagtctcagttcctaggagcagaatataatacctccacaactgagtcctcacacacttctccagaatcatctgctaccagcactggctttgaacttagtgaggactccatgccatttcaactttccataattttgcaaatactccttctctcctctggaggggattggaagatgcagaagctggagtgtaatgggttaaaaaaaatgaatgaaaaataaggtaaaaaagtaatagtggattcttctttcaaaatcgtggctgttgtagaggggagagggattagatggcagaaaaaagaaatgtgggggtcaagaggggttttattttagtacaaagtaaaatttgaggtgctaaatccaaacacacattaaattataaaactttttaaaagttactatctattctggagctatggtatgatcatagcaattctacaggaatgagagagaatacattgtcctaggattaaaaattcaacaaataacaaaactcagagcaacatattggccttaaaggaaaaaaaatcaaatattattcctcagcacacagtgaaaaaatcagccaaagtaccatttggattcagtacttaagttttcagtaaatatgtagtgtcattccttaaactttcaataggtggcataagaaaaccagagatttagagactgtattagatttactaacttattaaaatatttcacgactttcctacctatagtcataggctttggggtaactacagagatgcttgatttatgaacccatgtggacacaaaacaggctccatagatgcccacagggaggtttgggaagtcttttaaaataaacgagaccctcatgtaaaaaagactgagaaaccactagatctactctattaaatcacgtgacaaatgataacactagtagtgtagaattgtgtgtatttttactttcaaggtaatatagtacagtagtgctggaattggaatcaagaaacaacattcagttcatgacgttcctaaatgtgtggttttggacaaagaacaactgtctgccttagagctgatcttaaaaattaaaattatcctgttccaatttctactagaaaaatactacataatttcagaagagaaaaaaagtagttaattattctgtaaatgatgtgaaacaaattccaggtaaaacgtgattctgtaaatgcggatacctgtcaggctctggcacacctgggcgagactcgaggatgaggacaagcttacctgcctccacaggaacctgctcctcgggctcagtgtgtggctcagcctcttctggcgggactgctggctctgaagtagatctctctttaagtcctgcatttttttattcacaaagttaacttgagtttttgtggggttttctgtcacattaaaccaggaaaaataatattttcaaacatttaattaatagtgctgctaattaatagtttctaaaattgtatgcttaaaaagtgaggtaggaaaacagtttgctcttcaacttcacatgagccttgaatatatctctttgtcttagttagcttttcacttcaaattaaaacaaaatcattgtttaaatgttcatgaatctctaaaacagtcatgtctaaacctgccaaaagttcaatatgagttcaagctccttttgttttcataagcgattaattcctaagtcctgcagtttgaattcagcaatgaggcaactaaaatgcacttgaattttctgttattcaggtacactcgatgttttcacttatataattatttattctacttgaaaaacagttaaaaagaaaaagaaatcatacataactatttattatcatctaaaggaaacccctacaagtaatcatattattctataacagctaaaacatatgaaaatttaaaagttcttctcccttttacaagtcctaataagacagcagggtatgttaacatgaaactgattttaaagtcaaggccagtctaaaatctattatattaacttagttatttgaagttatttgatattttgtatgtggaacattaaaataggtcctcaattaaatccaagtatttagaaaacagctaaattcaagagttcaaagattccgtttgctgatcctggactcctcctgacctcattaagaatctcctaccaagagtagtcactgtgcatggacagcctgcggcaggaaggtcaaggtgatgtgaagggcagtattctaatcttaagcagctctgtgcagctcatgtatgcacactaatgtggtctggaaaattttcatttcgatgtattactcttcttttttattatttttcctatgtctcttcatgtttcttttatcgacaaaaacatactcccacattcctcttcccaaatcttaaaagaaacagagacagatacacaggaccctgccacatcacttacatttcctctagttaccatttgcaacactatttccacacaaaactcaccactagtacacctgacaccaacacatacagttgtgttctatacctaagttacctctaactgtaagacaggctgcaaagggattatacacaggtcctaattgtagttcaagttcagggaggagagggtagagatgaaggcctagtaaaagacatcacatttcaaattcaaatttagggctgccctcccttttaccatttaaataatcatttttacatccctcaactgttaatggaacaggtatggaatgattcattgccaagttctgctgaatgaatgggaaaaagcttaagaatctcaagaatcaagtaatttatctttgcactctcagcacctcagctaacacttggcacatagcaattgctcaatgaacacttgttgaagggctgaatacacccagtggtgtgactactctgctaagtctaaatggctgtggagattccctgcagggccagggcttcttaggtgcactccagtagctgagtagaagagggaaggggactcacattagtacttctctactcctatgtaccagagatccgtatttctgctccagcatccaccatttcagtgtcataagtctagtttgcctgagacactcccagtttatgtctgctgtcctgagattatttcactctcaaaactatctgtctgaatgaaaaattacagggtcatccttcactgaccccactttagcaggctctcaaactgtgttccgtgtgttatacaagcaatgaaatgttttctcaccaaacgataaagatctaaactgcctgaaaaccccattcttaatgagttttgaagtttcatttgaaaagtcataatgctacgtgttcaaatactactagtataccaacattccgacatacaatgcccctgagagtcagctttctctaaccaacttgaacttatttgtctctaaaattgaaattgcaaaacataggaaaaacaggagaaagcaaaagcacagagcaaaaaatattgattattttaccctgtccaaagtggaaggtgtattataaaattgttaatacctggtcatagctatttccagatatgaaatcagtacaaaaaaaaattgtaaacttcaaagaagctgagatcatattactgtatctcctcctctagacctctataaactttttgaaacttaacaaaaacacattctagactataattgctttaacaacccatatggaagaatttgccgtacaagattttatttcagtgtttccaaaaaactttttgccacccaagctcattttagttctaaaatttgagggaaaaagcaagcgaaaatgaatcaagaaaagtaaatgcatataagctcaattcagtcataggaaaggttttcaaaaatggatttattatgaggtacaagtggcaatgaagtagcaatgaaataaatattcaaaattaggttatgacatgagatgtgtcggtttcgatgttcctggggctgcagttaccaaactgccagcttataatggttgggtaggaaggaaatttatcatctaactaaacaagaagtgcggaggcggctgactgcatcgcaggtcaagcttcaccctcaggctggcaatcagagctccccagctgcaagcttctttttcagacaaggcgatgtccagaagcaaaaggagcatctcttgctctgcttctttcttaggcttgaggaaattttttccagaagctaccagcagtctcccttttcagtgttaatcatcaggactgggacccacttccattcctgtgctgccaagaggaacagggtgtccacagccgccttccagtcattatgtatggtgaatagatactgccagtccacagcaatggccacaacatgatttggaaaacacattaattcccttaaaacataccttggttttagttctttaggttaatcagataaatttggaaattataaaacatttgcatttaatcactatataattgcccctccaattttaattaaaattagatgaagctatgaaatgcaaatgaaatcagcactttaaatcaaccactcatagcaaatatgagtgacacaaatacccaagcccaggattagcttactttattcactgctgcccataatgagaaagaatcaatatatttctttccataaatatgcagtagttgtaaacttactaaattgtatgttgtatttaatcgttcaacaaatatttagcacctattaattcaaggcattattctacagtaaatgaaaacaacacacctaccttccgggggagagagaaacttaaaaaataagaaacatgaactatttagagtatattggatggggacagatagtacggggaagacacagaacagggagcacattagggaaaagtgggggtggggactattcataatactttggcaaaaggactcactgataacatgtgaacagaccctgaaggaaatcagggatgtggctatgtaagttacacgtgtgtttcgggtagggaactgcaagttcagtcatgtgttgcttaacaacagcgatacattctgaggaatgtgtggaaatacatgttgaaatgtgccattaggaaattttaccactgtgggaacattgcagtgtgcccaggcaaacttagaaggtatagcctgccacaaacctagactgtatgcaacatcctattgttcccaggctacaaaactgtacagcacgtactgtaccgaatactgtagacaattgtaacacaaagtgtttgtgtatctaaacacagaaaaggtacagtataaatatgacactatgatcttatgggaccactatcatacatgcagtccatccttaaccaaaatgatagcatgaggcatgtgactgtacgaaattcctcaactgggcacatatttggcaccaaggaaaagaaaggtgactgaggcaccaagagaggtgtgcatatcagaaaggccctggatgctggatccaagggctgtgacttgagggaacacaaaggatttacttctcctaagagttataagcaagccactccctcaacaaaacctgggaaacaattataaacttactttgtttcatacaatttcatacacctagcccattaaaaagctaaaaagttttttaaaattagtgttttaatctttggtttactaattcaaaggtgtacagatgaaagaaaacgtgtccttactaatccaggttactccagctatggttatctgtgctcagggtgagtgctcagaagtggtactgtttcaattgcaaggagtctagcagtataaatcaatttatcccaagaataaggctcataggtatatgaaatttgagaaatattctggaaaatcaatacaccagaaaggcatgcatactaggtaaccacgttaatcctcgttgtcgctcctggcttgtgtaatcagtgaatacagatcttcctcagtataccaacagcagtctcggaacttaccaaaattctgagactaccaggtactcaaagctgccccatgatatgcagtaagagccattccagattcaaagcatcttcaagtaacccaagctggacagacagatttcaaacagacataaattacaaaagaattaaacactgccaataaggttcccaagagcctggtttcagcaccaatgaagggactcaacaaagactggtgagagtggactcactttaacatcatgaaaaatacagttcaaggacatgcaactcagcatggtgtgtaagttcaggcacctgggacaagaggatgcctttgaattccatttgaattctatctcagtgttaaccacagctacactttttggtttccacaaatgcaaaaaggggacaaaacaggacccctaagaagggctttaagaattaaatgagataatttaaataagtatttttccaaaaatttaccatttcattaatttcttctaaaaaaaatctttacacccccctccctgccagtcacaggtaacttccaaggtagttaaaacactgcaattactgaacaatcttttgggttcttcaaaaacacacacacacggttttcttcttcctaatattcttcaacagtatatatacacctgaaatatttttagataatttattttgtatagtcaccattcaataaacaaacaatgaatgcctattagtgtcagttactaggataggtgctcgagataaatcgtagtctggcagcaaagtccaagaatgaggcaaggtgatgagtgcgataactggagtgtgtgggatgcagccacttgggagggtcagagatgtctgagtgcagaggtgatgactgggctgggtcccgtgggagagacaaaggcagcccaccacacagagcaggagcacattcaggagcacgttctaggcagagggactagtgggctgtactgacaatcgtttcagtctcattactttctctctcagccccttgcttattttgcagcatttcactggagggattgcagccacctcaatctcttgtatcccccatgccttgcccagtcccggcatgctgtagatactcagaaatattagttgaatcaataaatgggaactatagacacagcatgttggtgttatataattatcaaaaataacccaacagctttaagcatagatcatctccctctaataggacacaagagaagtgatacataaggcaaagaagatggaaatgagaggcagacttctatgatgtatgcatacctgacttaacatggagcaataaatagatacacaaagtgaaatcaaatgaggcactaaatgagaacaaagaaaaaagaaatggatgactttctgctttgtaaggcttacagagctcttgcagaaattgattcctaggtaaaaacgatagccaaggaataaacatccagcttatacaattatattcttaggcaaatggagaagaaaggataagacaccaaagactgttattgaggaatctttcagattagcccaagctaggtttttcatgaaaataaccttatgggtctgctacatatcacccatcctttagtttcctaaacacaaaaactttccttttaaactgaatggggcaaaatggagagagcttaacaacaaaataaactttatcacctgacatctaaatggcaatatttattatcaagtcaacattctcttatattctttcaatggtctaaaactattgttgaccaataattgtttggaatgagatctctctcttctccctagcttttttttttttaatttttaaatataacttcaacttctatttagattcaaggagcacgtgcaagtttgctgcatgggtatattgcgtgatattgaaatttagaatatgaatgattccatcactcaggtaatgagcatagtatccaatagttagtttttcaacccttgtctccctccctctctcccctctctagaagttctagtgtctcctgtttccatctttatgcccatgagtacccaatgtttagctccacagcttcttattttgaaatacctattttggcccatcccattcacctctctgtatttgggcagggggagaagtaggaatgggatgggtagaaaaaggggaaacaaactccatcatctgcctgctttcagtgcaccaattcctcctccttctggtaaaaacacactaacttccttagaggactccaatttttctttacccaacagtttaaaagtgggcactcacatatcccagggtgtcaccaatcacagctttcttatctcccaccccataaggagtagggttgaagatgagcacacgagactctgcccgagaagaaagccaacattcctgagggtccatagacagatggatgttgagaacactgttcaagcacctagatccagcataacaaaagaaaaaagccaaaactactcctgggctttacaattatgtgagccaatccatgatttttgtccatgtaaggtatctgaatggatttaacaccatggatgtaaccaaagaaattctggagaacattcagaagtaaaactaaatatattcctaatatcccaaggcagaatgataaatgcattttccatagaaacatagttacaatgagagttgcagaaatggatattagaattaaatcaatttttgtggaccagagtaaaaaaaaaatctctgaagaccataaaatctcatctatggaaaaatgtgttctgaatacaaaacaaacataagtttttcacaattaggctggttattaggcttctcgattgtaccatatacttaaggctatagtttatttcataactttttttctagccttcatatcttgtgttttcaggttgtcacaatattcttttaaaaattaagcattcttacggcttcactcatgtgcaacatttataattatttgcatttgccccctcaatgatctcaatagaataaatcaggctccactatactcatttcacaaagacacattcattacaaaggataaaggactgaaatatttgttttgcaatctgttgacctaagtaggaataggaagcacagtttcagtgcttccaagtttttaacccctgactgagacgttttggttgagtattactattcttattctaccaatgataaagggaaactgaatgcccaaccatgtgctggctgtttacacatatgcaacattgactggttctcacaaccaccttgaggaataggcattgtcttcaatttacaaatgaggaaaacaaccatttccaaggtgcattttacaatggaatattctgagcaatcgattttgagaattattaccagtgggcattaacaggagaagaaataattgaggacacaggagaaagaaatcaatgtcaggagatagagcctaagtcaccagatccatttcatggacagtaacatgacagttaacttaaaacatttcaaattacaaatgacacttgtttacttcttttctttttcaatggaagtgtctatggggaatctttattatccaagtatcattatgaggacctctgaagttacaaacttgcatagctaagcaggtcataatacaaaatattctcaataaagcaaccacctacagaattaacttaagtagtcctctggattaattcaagtgttcatgctgattgatttatgtcaatttcatcagtctctcattgtgaaattttgagacgatcatctatatacaatgcaaattacctataaaataaaattgaaagacttgtttaaaaaaaaaattcaaaagagtggctaccaatgacgttaggaataactaaaattcattcacatacgaagccattagaaaatgaaacagaaattagatgacacaacaaatgaccaaaaatttgatgatgatgtaagtgcttcaaaaggaagtatctaaatattaaaggatagaagatcatcctggaaaaattgattagcactcaaatattttcacaaaattgactatctcttaacaatgattttgctactaaaatgtgaaatgttatctttttcttacaaagtttaagaaaaatatgccaataatgtcatttaaaagatttgtaatcaagtcacaatataatttaaataaaatgttgttaggggtatggcaaaataaacttacatttttagtacttaattttcccttttcaggtcttcccgaaaacagcttctgactcccaactacctagtattgtgaattttttgtcccgttgtagctggcttatttaaaaaggtaacctttctggttttaattatacttagaaaacaatatgaagcaaacaatacagaaataacaacctactgaataaaaagtgtaaaactgagagtgcaatgcatgattttaaccctctaatcatgactgaaagcttgtttttagttgaagcttaaatattacgcagttggataaagtgtgacttcaacttcaataaaagttagttgaaacatttacaaaaagaaagaaaagagaaggggaaaagaagagagatgggaaaaaataaatcaagttctagtctacaagtgcttttaaaggatctttaaatgttttagttgaggtgtttcaattcttgagctaacagtcaaaggaaaaatcaatgagatagccaaaacatttcaaagtactttactaaatagcaatagacaattcttatgtgcttttgatgattaggttattccaaaatattttcactcatttgtttagaatttagtatttatgtattttctgccannnnnnnnnnnnnnnnnnnntgtttgcccttcttcaagagagaccaaaaaatctttagtgaagacagcacttaaaattttgtacataagttttaaaaaaacattccatttatctcaggagaaaagatctaacacggggatatggtttgagaatcgtgtaactttcatatgcctgggggacatgttctgcttcttcttctgtccagttttcaaagcctcactttcttgtcccagaagccctacatttgatgaagtttgagtgggacccactcaactcccattccaaagctttgtgcacaggtgtgcgcctgggaagaatcaccatcctcaactacaaaaatggtcccagatgttcaccaggcctaaccaggccaactggaattatctctcccagagccatctgcattgggattggtaaactagagactggtctggagcctgctgagggccatcttggttatcaagtggtagcatctccaaatagaataactcaggcagaaaccagcacagttaagacttaggaagtgagctaagaggaaaaagaactctgattccaggtctagacttgggatctagtcatctgaagttagtgccctgtatctgccaaacaaagcagctgtagaattccctttttggtttacaatgttcttgtaatgtgtaaaaatggcaaaatcctgactaatcaaaacataaaactccaagttatcaggttacaatatcttcaggccttaatttttaagcaataaaataacaggattatattggagatattagatattctctaggatttcttctctgttgtataattctattgagttgaagtttctgtcaactaaatgtcgtaaagtatttgactttaaatagtaaaaggcgttaacctaagaaaaaggtgtacaatacatttagaaatatttacacttaaacatactcatttctgagttgaaatatctttaattagatcaaaaatctcgtttttaagatcttcataaaaaagtaaataaatatgttttaaaaaataaaatcttagtggtagcatttttgattctgttgttaataaggttaacattaagagaatcaaaaatgctaccacagaggattttatcattatcaactaactgcatttccacagtagtcacaattagatatttaatatttgaggcacagaatagtacaaaccatttgtagaattaatttctcactaaaacttcacttttatattaaatgttttctaaggtgctaaattctgatctctagtgaagagattacatttgcaattccttagaaatggtaaataataatgacacaatcaaatatgaaaaatgtatgccattcaaccaaaataatggaaaaaaagtgtgatataaaatgaaagtacattctaatctgaaataattaaaacctttctatagttattctaagactataaaggtatcataaataaaagtgttctgaaactgttcttctaaatacaattctcccctttattcatggctatggccacagttctcggagcagtgtatgtggcacatggtaagcactaagtatgtactggatgatgggagaagggtgaggttgttgtagggaggtcaggagtgagaagcatgcaggagtgaggggcagcggtgaggtgaggagtgaaggaaaggagagagtaaaagacttggggagggagactagaaaaggggagataagagggaaaaggggaaggagaacccatgaaaagcctgaggaacggccccctgaaaggctgcgggagggctgggagggctggagaggagggaaggtggtggcacatgagcctggggaggtgtccacgaaagagaaaaacagggaagcaggaaggggaaggagggaagaaaacaacgagcaaatccatctccctgagtatttagcatacttgaaaaagttacaaggcattatgcacagaaataacatttaaaatcttaatattcttatttaacgtcaatgaaagtattcaatatattaatccataaaaattcatgatacatatacatttatctgaatacatgatcaataaatagaagttattacatcatattctatgacatttttaaaatgtttttacatttagaagtatgagacggtatatttaaatttcaggtaatttacttgctaagcaccaatgatacattcaatggctaatttacacaccctcaccaatcagagcaatattacattttccatgcttttttgtaacaaactgcaatctggaacatgaccatgttctgggatgatgatgccagagctttagccgtttcttttctgggtatttccctttgttaagtgtgcatatctggtagaacttctactttcctttctgtcatctttgtctcgggatgccattttactagaaacatccttcatatttgttgattttttcctattttccttggttttagcacttttttctaggtccactttctctttttctctgtcctttttacccttaggagactccttcctggataggtctgcatcagcaattttcttatcctttcggacatcctctttcttccccttttttctctcttcattcttactttccttccttgactcaggtttctctttctccttcttgagctcttctttagtgagttctttaactttcagattttccaattaaaggaaaaaatgtttattgacaggatctcttaatcacagaacaggaagttagtgaaaaggtattctctttttatctctccacacacaggaaatgcacattcagaaagttactttaattcactagtctttatggtggctaaaaataggtgcaaatctctatcaaatatcaactattaaaaaatgctagaagcttgtcatattttccatcttgaaatatagtatgacttgtcttaaaacattaacatgcaatattataaaattgagggcaccacgaaggcagtgctttacacaaagtattaactcacactttgtaactataattaaaggaacactggcaacgtaagaacaaatttttcataatttgtaagaatatatacaaagataatttaaaatgtttagctcaaaaacatatgtccttaaaatacacgtgcttctttgaagacaaatatatgtaaataaaattaaatataatttcattttattagttaactaggaaaaaattgtcatgtgtatgacatttttaaatcattatctgtagtatttaaaaggaaaaattagaattctctttctgcttatattcatcatgaaatcagtattcctttaagtatgtttccctgttaattcatgtagagcaactcaagctaacacacgtcttctagttcattgggttgagagagcaattaaatgaaacacacagctaattccaaatctcatggaaggtattgctttcaacttgctttacatggtaataaagcagttagcaaaagctctgaatttcatctgtttgtactctcataaggaaatcataaggtaaggtgtttgcaatgccacatttaagcagaagcaatgccacatttaagcagaaacaaagaaaatgaaatatttctttaatataataaaatgtgaaagatgtttttgcccatcaaaatcacataaaacttacatagcacaaatggtattcaaaatgagcattagatttgcagtgctcactaaaagcactatgtctttctaggctgtctaataaaatcttgattaacaaacaaaaacaccacatagggtttctccattaactgaatttcctggtgatcaaccaggagattcttcagttcttcctaaaaaaccttattacagtcttttaagaatacagaatagtattcattcaggatcatgctgagtcttcattctacttcaatgcgtttggacagtaacatagatactggcattgcaaaagtgtaaaatggatgtgcaatgctatcatgtcttattctgaaaactgcttttaaaaaattcagtctttaatgtttaatttgcttctctagatcaagaagtaaaatattttattgtccatttgtttcatcattatttatataaaaataagatggtgaaaattgttttcatccccagaaattattcagaagagataggaggttaaaccattaaaagttcctgatcttaaaatataaatcacaaaaccctgtgaatcacatagtaagtctcatctgttcatatttcaccaaaaaaacaaactacaaacaatatgccaagcccgtgaaatgaccacaagaatatcacaggcttataaagaaaaacaggcttatatagaggcatgcacatcccccatgcctctacccacaaagaatatgactactaacatatgaacaagaataaccactggcatataaagtcaggctgtaatactgagctgttagtctacaaatggctgacaggtataataacttatttattattattattattattttgagagtctcactctgttgcccaggctggagtgcaatggcacaatctcagctcactgcaacctctgcctcccgggttcaagcgattcttctgcctcagcctcctgagtaggtgggattacaggtgcctgccaccaagtccagccaatttttgtattttcagttgagacagggtttcaccatattgctcaggctagtctcgaattcctgacctcgtgatccacccgcctcagcttcccaaagggctgggattacaggcgtgagccaccgtgcccggacaataatttttaatgaattaaaatatcaaacacagtaaattctatgtcaatgtaatgtagggttatacatttacatccaagttttcattttactgaaaactacacatttgaatcacactagctttcactgtgctctaagacagagtgtcatgagagcttttggagaaataaaaacaattactgaagacttcatctttttttcccaaaagtaattcaaaaaaatcaaagtaagaaaggttttagggaacaaggtaagatgtgtacatgtaaatttaatatatacatcataacaaatataacatatttgtataatatatacattcttaatttaaagactattacaaagctttgataacatgaaaagataatgacttaaaattataggcttgaagcagaaaatcctttgatgaaatcttgataaaactacttataacctaagttgcacccaagcaagacccaaaagcaatagtgtttagcattagtagcaatattaacattcccagaaaatgtcatgcattttcaaacattaaacttgattcactcaaggctaatttgaaaaaatgaaaatacctttagccttagtttttctcttggctaccccactgggtccttctgttgacatttacaagatgaaaataggttataaacagaaaatttaagggaattcaaaaataagtgtctattaaataggtaaaatcaatgccactataaaatatgttaagttagttaaattcatcattaaaaaatactccaatatctctcttatttgtcactttaaagctttcctttcactatctttaacatataaatgcattataatcagcctatgatttaaccaacttcacaatttggcttagatctttaagaattgttggcattagaaatacttaattgccactggaaattgcattttctactcagtggtagacttccgcttgggtcacagatgatcaattaaaaatactagagtgaaggaccaaggaccttacttcactactcaatcacacttgccatccaaaaaaggatagcatattttgatagagttcatctttactgtttgaacaatcactgctcttccaccagttcgcactgtcttttaaaaaattatacaagcaagtaagaatgacagtattatgtacatacattttacatttttcacccactctaaaaactttgcaatagctttctatttcctctcttggcaaatgaaagttctgataatagatttatttttgagtctctaacaatatacctctaactcttattccaaccaggctgtacttagcatcccaatgaactgatcttcccaattctctctctcagtcacataaaggctggtttatgctatgtattggcaaactttgtaaagttccaatccatttcttaggcacattagggttggaggtgcaatgtagtgttcatctcctcaggaagggtggcctttagcctgtcactaaagaacgaaggtctaaggtgtggtcacaagaaagtccccaaagccatctgacatttttgcagctgtaaattgtaaaacccactttgtacgtttctcaaaacttctactttcagtattagatgtctgttctattatattgttcaaacctcccctttcactattgatagcaatttgtatctatcaattgaggtcatccattcgagaatggtaatttattttggttgaaatatcaatattcttcaaaaatgttattagtatctcttaccactgacaacataaaaatggaaacgtgaccatggttatatttgtccacttatatgaaatacataggtaaccataaccagtacttattcccatgtgtttaaaaattatttttcccagacaaaacttgattctttcctaacctctgccaaaaacagtgtataacccagcaataatgagtgctatttccaatcactctccactaaagtttatttcagaataaaatatcaaaactattctcataatacccacttttaaatatgagtagtatctaaggtgtaaaacacattagcataaaacattaaaatatacttctagtaccgctatgttcccctcctgactcctacatgttctcccacagcagaaccagattttcctattaaaacgtagagtgaggaaacccagactgccctctccctacccccactgttatgatctaggtaaaaagagctatatggatgaaaagactagagttaacttttgtcatgaataaaccaaaatattagattagcatcagattagtgaaacatataaaaataaacagtgctgtgctttattttaaacttttttggtttgggtataaatccttatagtgatagaaatgaacacatgaacaaagtgcaatgcatgatataaaactccaaaggatcatcttatgcttttctgaacttaaaaacatagccaataatttttcaatatttttgacataaaaaggaccaagctaataatttaaacaattattacattcagtttctgaagaaaagtatatagacatgaaaaaagtataccaccaaaaacagttaacaagagtccctaagtaacaatgaaacaaaaagagagtaaagaaaaaaaaatttttttttgtatcccagaacttaaaataaaatgaaattaaattttttaaaaaaggaaatgtgtttgtttgttttttttttaaagtgaaatgatcagttttaggaaggaagacatgaacaaaggtttaggatgagggcactattttattatgttacttactaaatatcctctaaggttcttcagaatacagttttacaagcagtagagaaggcagtcatgccacagtgatgagaaaacataggtggaaggaaaggtgaccaaaaatctagggtgctcacatcagccttcctcatttccttagaagaaaactgatcatacatggaatttccctagattctgaggggaacagaaaaggaaaaagtttgaagaattttatccgggttttgttttgaaggtcgaggaaacgcaggcatgtctgtaagaaaaagaagctaagttcataacaggagagaggtgatgaggtcaggaggatgtacaggctcaagggaaagggctagctttggaaaccagaggatgcagtgtctgaaaaaaaaaggtgagtgaatgagacaagaaacaatagctcaaaaaaatcctgagatagtaatgttgtaaagggaagagagaagaaaataatggaatgaagccacactagattatcttaggaaagcagaaagcaaaatcatctctacagaggaataaaatgaccctggaagaaggaaggttgtggaaaagtttagaatgactgctaacaagggaaactgttggagcagcatgcccccgacagaggctcagtacaggtaactttataacagatttttttttcccagcaacaatgggaaatacagtaatggagaaaggggtcagtggtaatccaagattagtgacagcacgtagaggggaaaaaatattagtttgcgggcattagagaagtggacttaagggaaaaccacaaggcaggtacgaaaggcccacctttctattcttcctaattcttgacagaattaaattcttatcatttgcaactttggttgatgtagattctccctacagtgccaaaatgccacaagcatgcactacttttctccttttctatctttagtaccatagctaatgtctagggaaaaaaaagaaaaaagggaacattccactaatcaataaaattcatgacaacacaaaggctcttcaaaaatagtttccaagtagtaggaagaaaattctatcaattcgagcaaaaatggaaacatcttggtatttcttaatccattcagacaaaagttgtttttaattaatagaatatattccaatttaagaaataatcaaagcagcattaggatgtgcttaaaatacatgctgaaaaacaactgccatgctatttattttcttttcgtccttttatacttattttgatgtaagtatttaaagtgatgatagttaatagctctggcaactatttgggaattcttatacagaaattagaaaaaagatcttacattcttcccttagaacgtaagagagttgcctaaaggaaatttatgctattttggcaactgcctcaggccattattctacattttcaaaatcaaatgttctctatgaaattaaaatgtttgaaccattaagccaatggatagatctgtggttacaccacatgcaatagacatgattttagaagactggctgcattacagatacacaagtagctacttcagactttcagacagctctagaattggtctggatatcacttcatactcaggtcacttcagccactctcaccatttctagtgagacctgtgagtcactgtaagccttctcatcttcctccgtcccatactggaacatcgtaatcatttcaacattgactacaaatagcaaaaagaggccctaaatgtctgagtaaccatcctgttagcgagacagactgttcctctagaatggatgtctactcttagtaaaatgcatgtcaggacactacaccaattgcttttttatttttaaatagatgtaataatatagtacagattaaaaaaagaagaagaaaaagctacaaacccaccaaccctctacagtaagtggggaacggaggatcagaacataagaaaactgaaagactaaataagcagaaagggattacatccagagacagagaaaaaaaggtaaaatgcagattcaaatacaaattggagattggaaaggtcacctgaagacttttgttagcataggtttgttatagaaactcaaaatgtcatttctattgcaaaaaatatgtccaataattttaccacttatttaaaccagttttttttaaaaaaaaaaaactcagtattttattatgcaaggagtaactcctcatccttcaggacccacaccagcatatgacattattcatatgatattaatgaatatcacatgcaaggcttagcattgaaggagaattcaaataaaaccgaagatctggttcctagtttcaaggagtccacaaactacttaatatctaactcctaagtattacagggtcatctcaacaaataacaaaggcagtgaattctgaatactggttccatcatttaacttatgaaaataaagtctgggtcactgagtttctttaagcattccaaatatgcattgtgatcaaagattccacagccaaatcacagaaaatttcttgtatgttttatagacttaaggagctagcccagcggattatttagaaagggtcatggagcatcaattcccaaaaagttaactgtcaagtgaccaaattaagaataactggctgtgctagatctaattttttgataattatccaaagtcacaaacatcaaggtagacaatctgttctatctaactaaataaaaataattcaaacagaaaatagtccctctttcatgtctggatacagctctataagacagggaggtaatttctagaataaagaaagaatcaaggacaagatgaaaatgcaggacagcccactattccatatgtcctcagcaccgaggcgtctgcaggatccccagggcagcaggctgacagccaggcctcaggactgggtaaaattggcacccagaagacacttcccctactgacttatacccaccactcatgtcccaaagcaaggcaggctgaaggaagctaaagggctgaaaagaatccccagagtgctgctgtcttgttttcgtgccaaactccggagaacccagcgtctttgcaatcggacaaatgtcagcacatccgaataagccagaacagtgactctgaggagacaacactatatctcaacacgaagcctgttccacagagtttctcaactctgaaaaggtaaagtaaatacagtataacttaaaattccataactatataaacattcaaattaatgggatatgattttgccttaatttagttcttaagtttaaaagacatgaggtaggaaaagacttatattatgaaacaaagtcagaaaatacacgcttagaaaattaagaattttagcaatacataataaatcaaactaaggtgaagtaattttgatcagctttgagatactttatagtgcagtttatagtgcagagataaaataaaatacctttattttatctctctcacacacacacacacacaagccttaggcacaagttgacggaagtcacagaagtcaggggttcgtcagctacctgggtgtcaccttcatcagaggctttcagaggaactaatgagaggtggtacaaaataagtagcaaatttttatcccacattcttgtttttcacttacaaaaataaagcataattaatttctgtacataaaatatgcattagtagggcaaataaagcctgatgaaaaattagtaatttcaaatatttttaacacaaaatttaatcatttacttcttatcaattaatcgaatatcttctagtgttagtagtaacaacacgttaacaaataagattcctttaaaaagtatatcccggaaattaggctgggtgaatttcattgagtggggctgaagattcctttagaatttaaacctaataaactttgatatttcatagtacccaagtatgaaagcagaagacacaataaatacaaagattgaataaattttcagaaggaacattactgaatgatactcatttgttgcagaacatgctactaagtgacagcttaactgaagtccttgaatatttggaaacagaagctttaacagactatcttctgcattaacagaataaaacatatttgcccattagtgcgggcaagacaaacaagagctttaatagtcactttaatagtcatttaaactttaagagattattgtccagtgtgtatatccacatccaaaagtagctacagaatgtttgctttttaataagattagcaaattggacagtatttgctgacacaggtaaatggtgggcagagggaatggatgtcccatgctgacttgaggctgctactttcaggctgttattatgacagcctacaagagtaattcataacaatttaaatttgtcatagtcccctcagaataaatggatgaatgatacacttattgaaagtaatttgattagatatagaagacaagaaatatttgaaaagtagaaattatagttaaataaaacgtgaggaagtgcaagcattttcaaatttttagctctctgacaaactaacactaagcaaaatcctagagaagctggaagagatttaaaaccacggaacatcactccttcaaaaagtaacatccctttccttatcttccttatccctagaagagctttgcttgaggggaaactgatgaaatctcattttaagaaatgcattttgtatatagctgctacacctgttttggttactactgaagcaaactcatttttaaagcaattgattcaaatatgtttttaaggctttctaatgggaaaagtttactgccctaaatggaattaccacttcaataagtttataattctaaaaatcacattacatctaagccaaaatcaatatccaattaataagttaatgaaggaaaaaatggaaaaagacttatttaggatgaataattttaatatgtacaacattaagatacatattcacatgttccctcttgtgtaatatgcctactttaaaaaaaatacaaattactttctctggatgtatatttggaaataaaatttaaaataaattttgctttcacagacagaaatatgtcatgctactatctgaaaacagtaagttaacttactctaaggcaaaaacatggagttatttttaaattattttaaaagcaccattaacacagaattttacatagaaatttgtatgaacctatctgacaaacctaaacaaattacaataaaaaatatcagcttagtaaagaaccatcattttatacatcagtcatgttaaagaacagagaagcatttaacttaaaaatcatgccagaaatatttttataatgaaatccattagaatcatcataattaatagtgtgttagaaagacaagcatcaagggttaaccacaacacaatttgctgttaagtgtccaaatttagttcagtgaatacatgagttgaaacaaaacgatacagaaaccaattataccaccaagaacatcattttcagtgtactttgtagctgactacaagaatgaggagtaccattttcttcaatagaagttgggggagctgagcgagcaagggactagctagtagctgtactgggcaagatcacatggttgacttgcacggtaagatcacaaccaccccactgcacattaagccctgcataagccaaggaaagaaaagaaaaaggaggctgcttcaggtgttcattagccaatgacttcagtccctgaatcaaggttactggttatgtaaatccaatatgacacaagtctttccctgaaccccttcattctgtgacgtaccatcaacaccatctgcggtttcgctttcttcttcttcttcttctagcatttcaaaaggagtcattatatcatagagaaatgagaggaaaccataaaaccaatctgaactttcctctgctaaaatattaaggacttcctcaagagaatcaatattttcattactgccatctttggtcaggcctacataagaataaaggaagagagagagaaaataaggagagcagttaggtggaaaaaagaagtggaggaagggtgatctcaaaagcgaggtgcatcaaggtcagagaggtttacagaaacggtatttggaaaataaagaagtccattaaaatgcacaccttacaatcaactctcaatcaaatgtcaaaagaaagccacaatttgaccaagcctcaccactcctaccagcccctacccaggtttacctttctctcattagagtgttgagttgaaagacaaaattttatcatcaaaaatcaatggacagtaatggaaaaatcagttgacagtaaaaggaagagtgagtaaaagcagtatcagggaaaaaaagatatatactctgacaacctccagatttgctcatttaccaaccagattttatcgagagttgattatacacacattcgttcatttgttcattcaaactagaaaggtttatttcctcaaacttctcccctccccccaccaccaccccacttaagacctggagctgacttaggaaattctggagttaatataattagcagtattaccatttatagcatccataggtgggcaaaaatacactcaaattatgtaactcagataattttaacacttaaattttaacactattaaatgtggtagctctataaaactctggcaactgactcatggtcctgtaattctggccaatgacaagagtcagctattaataataattcactttgcctaccgatatgaaatgtgatcaaggccttagctggtcacttgcaataggaacattccaaattcctctccccatgggcctgtgaaattagcttctattgctaagaccccttacaactaagtattggaccccaaacaggccttaggatagaaataaatcaaagtatatattgttttcatcatttgtttttttcctgtgaagaactggctctgggtagcaaaggtttcttagctctagtaggtatcagaatctaccaagctgtataccaagcccttaattttgaggaggaataacagggtggggtgttctgactgtaagaaatgtgaacatccatgaccactgagcttttctggttggaaccacgtaattcagtcatttaaggctttggcaacacacaatgtctccatgtagtataactaccagcaatcaagataggcagataaaggataagacgacaactaatttaaaagttttaaagattatagtgaattttctctgctttactcaaaagaactatattatgtcattgttcatgtttttggtaggaaaaacgcaaattgcagttggtatttaaattactttttgacaagcctagaatgttttcactgaatttagcagcagacaaatgctgtgaacaaagatctataatcccaactaagtccctatgggaataacagtttcttcttcctgccttaaaacactatagctgcatatttagtataaacatctttacttttctccatttgccaatatattataagtacttccaagtattacatataaaacttttccatccttcagtatgacagatgaccatatgcaacgaatatgcaaaagcatttgaacaaaactgtttacccagccaagcaaccttcctgtggttctcaagacaaaagtactagtccagagagaaaaatatatactctcggcatgtgattccttctgaacctctaagaacagggctcaaccaaagggaatgcctttggcttggcaagatctggtcttctcctcccatcagctcactcatgcatctatcagtctacaaatgattttccaggatgtagcaagtgctgactggcttcccttttgctttccagccatacctgatacgatgccagctaggtgctagccataggacaaaaggacaaccacatgatccttaggtggtgtcactctaaggatttagtcctcgcatcatttagttcttgggtcattttcctgttgattttatttggaaaataagtttttaaagaatgtattttcaaacaaggtagttttcaataatctgaactacaacaaaagatacctatattttagttaatttggccacaaaaataagaaggtatgtaaatgaagaaaaatgggcttagcacactttcaaagaatcagaagggccttggccagaaataaccaaataataaaattaatgatggttaggggtcttgatttactcacatatatttaattctatttcacaagaaaagccaaactctaaaattgagtgaaatgtaccatgtaaatgtgtacatttccccaaatttataagatttagatatatgcagatttaagaatctagaaaaaaaaactgatgaaataaatgcaaaatcctatgaaagtttaacatatcttaattattactatacctgcgatgacaacagctcctcttatctctgatttcctaccctcctccttccccttggatctcctgggccttaatctaaaacctaaacccttaaagtttaaactttaccattaagctccctctccagtgagaacgtaccttggaagtctggcttcattttgggtatatgctcactgtagtgctccccccataacctctacctgacctcaaagaacccattaaagcctctgtactcccaacaatttcaccaggctgtctttgcagtaaccttccagtaacagaggcaccactaaactacaataatctcacaaaccagaaaagaacttcagtcataaaactcaattcaagttaaggttgcatttcatgcagagaactcaaatgctatgaaataagattagaggtgataagtaagcctaacatttcacctttggtttgtttcatctgtactgaagccacaagccaactgcaaactagtacaggaagagtaaaaaagtatttatgtagctttatctgatctgtctttatgcatttattagtaaagttaccaaaataaaccttgatattcaccaaatttagttccacctccaagtgtataattcttataaatggcacaatttatgagttcctcacactatacctgcaaacagcaatattcaaagttacaattaattagcttcttaatggtaggttaaaaaacttaaaggggatgaccttttgaaatctcaaatacactaaaaatcaagttaaggtaatagtttgctatagaaatcagtgtgttttatcaaagaaataccacattttaatttctaatggcatttcctgacagaccacatagctggttttaagcaaaaacaaacaaacaaataaaaatcaataaaatgcagtagatgagagtaatattatttctaaaaatgagggaacttggcccacattttattttatctttaaaataaaaagctttgctattcagaatgtgtcatttaaagtaatataatgaagtaataaaccatttataggcaagcaaattaacatcattctgataagttctacataattttgtttcttttacatgcctaagattatagtcatctgaggatttaatatatttagagaaactcaaatatagatacacaatgacaggactacattgaaaatttcattaaagttaagacaagaaaagaaatttcataataagtttcaatgcacaaacactaattcccaatgggcaataataataaaaaaaaaaaaaaaaaaaacaccaacacaggtcaacattaggaaggtttattacctttaatcacaactaaaactctattttcatatttggaactttatttcataaggaggtggaattaatctactaaaagcagtttcactagttacagatgtggcatcctaccatgttttcatatctaataaatatacacaaaacaatgttaactaagaagaatttgtttgggtcattattttataagcttagtgtataatatcatgccatatccattatttttctaaagactcttatataaaaagttttaacatatattatgctacatacaaaagcaaaggaagtctcaccaggccagattatataaaatttgcatattgaaattaacaccattctttccagcaagacagcactttaaaacaaataagggaataccacattgttatttattacaagaaacatctctgataaagacaagtaattctgataatgaaagagaagggtccaagacttccaaaataaagacactgggtcaaaagaccaggagttcatattttaatgctaccgttaaaatatgcatgggacattttaagatgtttattatcacttttatttcatcattaatttatgtaagcctgtagaaatttacattttgaaatggaagtgaatgtgtaatgttaatgaaaaatggctataattaccatatctaaaaacagactaggatattatctattcaaattctaagttcagaataagaagtactttaaatctggaaacacacatgaaattattatacttatcaaaagatatatgtgtaagagatatacacttattcattgataaaagtaaattgacatgaaagagtgtggaaaaataagccatttaaaattttaacagtaatgaaatatatgatttaagggagaaaagtctcctgtaagatatatactattgagatagatattattaaagcaaaaataattgtttccagcattttatcaccactaacaaaaaacataaaatgtgtacttgcctaataaaactttggcatcatccacatcaaaatctccatcaccatcagcatcatagattcctagttttcctataatagggcagaaatgatggatatgggaataaaaaagaaaagaaatttaataaggtattataacttagtgaagtcatgcaactcagtcataaatgttaccaattaatacaattctttgctcttttaatcctgcaaagcagtgtcaaatgaatatcttacctaaaaatagcgagcaattcagttaagagagtcaggaaatgttcagctaataaatgctatgaaataaaactgacacagcattatctttaaagattgaacaacatcctgatctaattagttcagaataatttttattatactgctaaaaatattcttggtaaagtttttagcatatatgaaataatattgatgcattcctaagtcacttgaaatttaatgtttctaaagcatgaaatttcatcacactatcaatatctgaaccaaaagaaacaaccaagcctcaaataaagaccaaatgtaaatagattaacatagaatctaagtactaaaaactaaaaaatcattaattttatattttacaatgatgacttataacagaaatatcatgaattaacctttaaaaataaaagatcattctggaaataaagtatataaaactggaggcttcggaaattataaaggaaaacttatgattattctacttaacttaatcagcacaggcaatctatactaagaaaaaaagggcttaaaacagatatgctgagaagacaatactaccaaaacctttcctcctgatgaacagaaaatgtttttaggctttagtgctttatcataaggaacactgttattttgtttagcatttcaaaaagtcaaatatattcaactccctaaaaaagcatcctaaaatctacatgattctaattcattattggacaatgactgtggagaaacataataatgttaatgtacagcaattttttaaacagctttctcaaatacagcattagtactaaaaaaaaattttggcaattgttatcatttctttaacacaaagtacattaaaaaattacagaagaacaggcagaaattttggctcagattagttctgatcaatctttatctccccagagcccttgctctacctaggaaaatggttaacttgctatatagaagtctgacttagcaaacacatacacatttaaaatgattatgatgaaagaagagataaggatgttatttcaactgctaagaaaacaaaaagtactaatcaaggctatgcagagtacagaattcaagaaacagtaaaagatagaaaatactaccctttctgacaaacccataatgggaaattggtcctatcacttatattctgatgtagataataattaaattagtagaaaaaggatgagccattagagagtaacacacgtagacttgaaatgcaactccaatagcctaccttgaagcacctctgataagttataacggaagtcctttgctttggctgcatgcatgtaaaaacatgaaaattgttatttgtgcttaaaggtacaaatacttaaagtgtcctcttttaagatacattccctaacaacatatcactgtaagtcagtcaaagcatagatctactcagaaatttgtctccagactaaaattctccctcagttggtctgtcaatctatccagagacactttctttaaagtaatgaaaatgaaaaacttcaatgaaagacagattacaaataagcatattttgttattcctacagccaaaaatttgtttgccctttctccccaaaaatatgtctataatttgacaagtaaagcagaagcacaggaagtccaatgcaaggggatatcacccatgcaacattgtacatagacacaagtgtgcattttttccagtgacaggtccacatctttcactggattactaaagaggaggaccattattcacaacagccaaaaagtggaaacaacccaaatgtccatcactgataaacagataaccaaaatgtggtgtgcccatatgatggaatattatgcagccataaaatgaagtactgaactttaaaaacattatgctaagtgcaaaaaggcagatacaaaagatcatataatgtatggttccattacatgaaatgcccagaataaacaaaagcacagacacagaaagtagattagtgtttcccaggagagggaaagaggaagagtttgggtatttaggggaagggggtaacaaaaataatctggaactagataatgctgatgggtatataaaatgatgaatatagtaaaaaaaaactgaattgtacacattcaaatatatataatattgaattttatttcagtttaaaaaaagatttttggggaagtgaaggagaatgtgactccaaaaataacaaagaatcattaatgtaaaaaatcatgaaaaacttcagtgattacagaaaaggaaaaaggtggagaaaggacactatcagaaggaccacagcaacttcctcagaacagcacacagatcacacctacacacacacaataatatctacaaacgcctatctcagcacacccatccagtacctatatgtgtgcacacgtactcatcccatcccaacagagacacagaagggtgtactttgaaaaccctctctaaggaagagttttgcatattgtgtggttatgatccattagcaagtccttaaataaatgtaatggctcatgatcaagtatttttaaaatttataatataacaaaattgaatagaaatcaaaaagtactgcatatagtgagaatgagtactgtttgataaaacttctccctgtgtgacagacatacaatataaagccttttttcaaaaacctacaggtcacatttaaagagttcaaaagacaatactccaaggtaaccttcttcatatcccctttcagcctcactctattgagaaccactgaaaggctatagaaattaccagtaccagaaagatgataacaaatattcaagactcctaagagatgtcacttactctcttacaaattcacataaggatatcaaaattcttacctagaacttcctcatagtcaacaagatcaaaccaaacgacagctacagatgtccagacgcccagcaatgcaatcaccataaaccacgtgaagaatgaagttcctgagagtccgcctttcctcccattcttgtgtcctccatgctttgtctctgtttagaaataaatgtaagatatcataagaagaaaacattttactgaacacttattctcacaattatttctccaataatttgggattatgtacaatgatagatcatttcaaaaacagtttccagttaaattctcaaaacacgtcacacaaaatatttctgaaaacagaaaagattgtttagatgcaacactaactttgaagtagtgcaggaaataaactcctgaatttttttaaagatttagtataatatgtatattccatccaagttactcatcaaaatgacctgaatattacctctttccaaaggcagagcacataaacaacttaatgaaatcacataaaaatgtagccaaatccttttctccgtcccatttcatttctgcagaatcttaaaaactctgttaacacacagaagaaaatatctccccctaaaccattccatattcttagccagagagaaaaggacagaaaagtgaaacagcacaatccattcctactcctttacaagatccgttgaggcctaaggaaacaggaaaaggctcattcacaattggtctcactgcaggaaacagctttgtaaactgctgtccacctaaagtgtcatttatcgcatttgatatgcttaatataccttatattcttttgtaaatattcttcttacagccaaaaataaacaaaaatgatttgatattaacagaaaatagtcaacactgcccttaaaaagatatacaatattcaaatttcccataaaaaggaatataatacatatatcaatattaataaataaaaagaataaataatatcccaaaatgccttctgagaagaggaaaagtttatcaaacagatgatggaaggccagggcggtgtctcccatttgtgtggcaggtagagtcgccatcaaagtgctttcatgtgctttgctgccggtgatcctcacggtgtcctgccactatttctacagagggcatttctggatgtttatgcaggacaatgtttcatcctgtgcacctgttcctcacattgcaagatttctggcatccctggtttcccctggactcaaaggcaaggagctgtcaaggcttatgacaaaaaaaacatccccagacatttccacatgttcccttcaggggcagttcctgggtgagaaccaacaggaagaaggacaggaataattatctgttttataagtgaaacatgaaatgattctcccaaagtcaccagtacaagttgggtagaactaagaacatactctcatctctacagctctgagttccttaatctctaatcagtgggccaaattacacgatttcaaaaaaccccactagctctaatctagaacttgccctttgacttctaagtccagttctaattacagaatactattagtaatttccagcggctcaagtcaagaatatattgccaatatattcttctggaagaaaaaatgaaattctttgtgttaaaaggatatatgcattttttaaaaatacaccactagatcagtttttcaaaaggggccataaaaactaaatccatctgagtatatatatgtacactcaaacatatacatatatttatctacatgcctacatgtagataaatttttttttttttttgagacatggtctccctctgtcacccaggctgtagtgcactagcatgatctcggctcggttcaagggattctcctgcttcagcctcctgagtaactgggattacaggcacctgccaccacgcctggctaatttttgtatttttagtagagacagggtttcaccatattggccaggctggtcttgaactcctgacctcaagtgatctgcccacctcagcctctcaaagtgctgggtaattcttaaaacgtcaagtaattcctttttctgacattctttaaatattaatggatccctcagaaccagagttgtaaataatatggtaaattcataaagtatgcttaccaaatgacaaatggccatcaactttgtttctaatgtgatctatataaaagctggctatataaaaacataatttatgtattaaataaaaatacttgctgggcatagatcctattgttgcagattaaatcaacttcaaataggtatcattacctgaaacacagccatagcaggagaagattgggtgagaatgtctgcaatgttggtagagggaaatggtggtttccaaaatttttatgtgttgtaagcatataaaaagaaaaatacaaattaaaccactactaaaatttgaagaaaaaaagatttacgaaagtgagtaagcttctgtgaggtcaggaagcaccacagattcagaaacagttttgtatgtctaattcactacatttttataaacagaaagacttattttctaacactgtatccaaaaaagaacgcttatttctatataacatacagacatatgcgtacaaatccatttgcgtacaacactaagtttaacaaaaatactaccttccaaaatatccacatactctaaatatggaattatagtagctaatgactaagaatttcctgcctttgctacttattgcctctaagaatcaaattgaatttttttttggcaaaaggaatgctaaaacttcagtaaaactgggttcttgtcttatgtcctcttgaacattctgtagctgataccagtctcttgtatttttcctcattaactggaaaacagcaaggctaaacaaatatagttcatcttttcattcatccaacatttttattcagtacatgaatatcagataattttacccaataattaagtttttataatgagtatgtggccaaacagatacccaagatgatattatttaaaataagcctatactgcagtgagctatgattgcaccattatactccagcctgggcaacaaagcaagaccctttcttaaaaaaaaaattaaaaagtctataatgaaatagctaataaaacaaagtaatagtttgaattcaaattttaatcatttctccatttctatctctcttaaagggaaatggaggagaaaaatttctgagattctgaaaaggaaattatcatttatccaagttaactcagtgatactcatttaagttattgactgtaacactaaatataagggaaaagtagacaaaatattttttctaaaaaatgaatgcatgcaccaaaacagcaagggattcagatgggaaggagacagccaaacacagtaaaaaatacacctttacctagaatttgtttacatttttattttagatgtgattctaacaacttcaattaagttttctagctctatgcacaaaactctacatttcagacacaatctaacccaatgagtcaaagcaacagagtggtgacagaggaaaagcctatcgagtgcacagatctctcagcaagagcaggcccaggaagtcagaaaagctgagtggtgggaagtcatttatgatgaaactttcaggcagaatccctgacagtccttcaaataatcttcagtacaagacagtaactggtttcacattgattctgccattaaaacatagaagaaatgtataataaatcttaggaagattttcattcaaagtagtttgtagtaaagagatttatcactttaaaagctaaatgtttcttaactagaatatattatcagcaatattttatatatccctttttaatatcaaataaatgagctgttactctagtattattaaccttattactgttgatatttactagttccacaaaggaacaaaatactaagttatggaagggattcttttttaagacaccttttttaggggcagtttttatcgacagcaaacaatatactcttgatatgtcatttggtaaatatgctgtgcctagtcccaaagggcagatcagtttctgtccaatgaaactgatgaacgcatggtaagacaaacccttaagagggtttacaactccctaagcaaatctgaaaccagtatcttgttccaaaggtatttgggaagaacatctagtagatgtccctattttctaagatcagaataaatctaagtcttcatttcattttctggcttcatgttcaacctgtagttctgggatcagtcaaagcggatttttactggggtttaagaatactgcaagaacgatgcgattcattttttcccatgttattccatcaaaagtacatgacctccaaatcagaaaatgttcccacataccaccaaacacagaaattactatggcaagcaacagtccaaaatgaagactctccaaaacaaaagccgggggaagggcaatgtgtagttttatttatttggttgaggaaagggagacaagaagatgaaccccagcacttgaacagtcaccagctacttcactggcctactactaactgaattatagatcatttataagttttagttagcattatgttgggaatttcatatttacacataaactctacacatttaaagttttttgaaaaacacaaaaactgtcaagcaactcatcaaactgattatttttccatgctataaaatgtcaccctttgggaatcaaaaactgttaaaagtgcatcagatgcaacagctgatttttcctaactacatggattacctaatccacaagaggagagaaatgtcttccaaaagaactaaaagtcagatacatatctcatattcttcttcatggctacatgaagcactttatcagacgagtcaagtgacccattctcaccaattattcaaataatattcacatagtacatgcttatattctctatcctaatcaaagaatcctttcagttgctgattagacagctgagagttagaagcagttttcatacatctattcttttcttttataaatcttcaacataatgagtgaatgcagtctttcaattaatggaaagactatcttaatttacaaagtaaagcaaaagcaaatatatacaaaacattaaattcaatacatagttaaagaatacttcaaagttaaagagtcaatttaaaatcaaaataaaacccttgtgttttttctttgcatttattgtctgcttcacataaaagtaggtcactttccataaatggtaagtccttgcttgaaccaggtaagtctgttcattaatatgagactgaatttatatctcctataattttatataaaatctaaatatagataattctttaaattcattgtaattaacttataagaataagaagagagcttgtacattttttgaaatttgtaaaatgcagcctccagtagtacaacatactaaaaggtcatctaaattaagacactaaaacatattcggattaaagacagattattcaatgaaatattcagctactatgaaaagtcagtatctccaggagttcaaaatagaaaatgtagacagtacagtcaaagcacttagccaaaaatattttaacagagcaccactgaaaataaagtgaaaagctgtcagctagatctaaagccacttttagcctaaataacaaaaatatacctttatcttcagccattttgatttcttcaatccatgaataataaatgctaaagtaaaacaaaacaaaaaaaaaaactcaaaagtactgctggcaggttttaggcacactgcatgcacttgcctaccagagcttgagactggccaatccctgcactgtaagggcctctagaactgaaattggacctgactacaaactctgctcaccagttatttttagaggctaaatgctgctaatcaccacttaggctgaagtgcactccctaacaacaccacagcctttctcccacttacgggattcttttcccagttggtcctagctaactccaacccctaaaaaatcaagcatgctgaaaaaaaatgaaatggaacaaactgtgctgccagttttgttttcttggaagcaggctttaacggctttagcttaagcaccaattcattgaaaactcaaacaagtcttgctataaaatatggccccaagcccagaaacagtttgatttggcccttcagaatctaataaaatggctacaaggaaagaccattagattgcttgaatgaaacaaaaccatacatagtaagaaattaatcaatgctctagaattcttactcacagacaccatcccaggaataattcctccaacagcaaaaataaagcaccaacataaaatgtttcactagaaaaggagggacagaggactggtgggaaggaaagaaatagaaggaaggctgggaggtgaggagagggaaagaaaaatcttcaggagtaagaataatgacctgggaaagatcatcttgaaagggaactaggaaaagattacacaaccacattctgattttttttttcaacttctccccaacctcatctccaaacattctcttctgggaaataaaatcagccatttattcactgatctaacattagcagttcacagaattcattagagttctgattagtatactaaattaatttagcacaaatagtatctagagcaggcagcaacctttctaagttgtttataagactaaatttttcactcaaatttaaagcttcacaagcaaattaaaaatttaaaagctttgaatactactagtaatttccagtggcttacggcaagaatatattgccaatatttcttctggaagaaaaaatgaaattcttgttaaaaggatatgcacatttttaaaaaatacaccactagatcaatttttcaaaaagggccataaaaattaaatccgtctgagagtgtgtgtgtgtgtgtacactgaaacacatatattcaaagctaaatgttaactacaatattaaattattagcaatattttatctatccttttataatatcaaataaatgaggtgttactctagtattattaaccttactactattgatatttactagttccaaaaaggaacaaaacactaaattatagaagggattctttcctcagatgcctgttttaggggcagtttttatcaaaagcaaacaatatactcttgatatgtcactttgtaaatatggtgtgcctagtctcaaagggaagatcagtttctgtccagtgaaactattgaatgcatggtaagataaagccttaagaggttggtaccatagtctgcaacctatggtaccaacatttgatggtccaggtttaggacagagtgaagtaggtagacatcatggccaactaaacaaaatggtctcaggtgccctctggccaagcgtcctttcccccattattttcttcaaagatctgtcccactaaacttagtgcttgctaaattgttaaatgataatgaatcacttgttgacaggggttaaggtgacccaccatttcgtcaccatacaaatttattaagacaaatattctggaagcttcctttcattgtgttgtttttggagggagaatgacagcaacacgatacccccatgggtgagaccactagaaaccaaacccctacactgatccagcaggcagcttggtatgctttcatacttagacacctggatttgcttcacggcttctccattaaatttgatttgggggaagtcatcaaacttctaggcctgaatttccttgctt

SEQ ID NO: 15190 - DNA, 9953 bp, Human
cccggcaactggaccagccagccgggctctggctgagccccaacccagcagatgtggaccctaaaggggcccatggccaacagcctcccacctcccctcaaaaaaacaagccaggcaaccaccgcctgtcctgcctgccccaccccgtgtaggcctctccttgtattgtggccagaagctgctgcagtggccaaaaacccaaaggacgctggagacacatagaatccctgaatgtcggtgcttagggtgatggaaactgagatcttagagatcccaacttttacctgctactaggctcgctgagcagaatcttacaatctgagggtgttggcgctgagtttacactgctgctttagaatatgctgttgccaaacaatagaatggcagcctcttggagtgccagccgcccaggactttgagtcttgagcagggctaggcaggtagtgcatcagaactgtgaggtcccaggcgatcctgggaaagattggctggggacttggggctgggagtgcttgtgtgggtctggatcccacctattcaggggtaatggaggggggcgtgagagtgatggggaagcctgatagcccattgaacacagtggctcccaggggattgctggagagaggggcggagtgcagagagtaggagcctcagccagcccgtgtgggaactgccagagggcagaaggcgcagccccctctgagatcccacagagcctgggacacaggaacaccacaggtcccaagccgcagagggttagctgggaagagctgaggactctgggctcctgcggctcagctggctgagctgtcaccaggcatagggtgggaaagggttttccaacttggtcccgtagctctactcggtcttggaaaggcaggggtcttggggactcttgtcatgggatggcaagggtgtgggagccaggcaggggcaggtgatgttatcatcagaccaccatctgcataagtgagactgggtcaggagacattgtgtctcccctaaatcagggaactcatgaaataatgcagagccaaactacccctccccctgtatatggggccctcccctgatttcccctcagagaagtcctgtcctaatagcctggaactgtgcagtgcctgtctatagtgatcatggcagtattcaagggctcacctgatgtagggtacgggtactggttctccaaacagtccagaatggaatctcagttaggcttctctcttagccacttgaccttgggcaaatcacttctgtgacctcagtattcctcatctgtaaaatgggagtaactgtcccctctaccctggattctagggagggaacagcaggacaacagaaatgaaagcacagcccttggacataaacagcacaaggcttagagcaggtgaggctaaactttggtgactcacatcctctttctgagcttcccaggtctgggatgtggaggcccccggcctccttctaccaacacttgctctttacagaggatttgcataaagtctttttactctgacacatcagagactcagctctgctcttctctggggactggcatcgtaataggaatgaagtaggatggtggaatgggtggagaggttggggaagtgtgctgggaaaagaaagagctgactgaggcttggctgcaggaggattccaggctctcctgagctccgggccttcaagtcctaggaccatagcaccgcagtcttgcttttctcaaacatatcctgctgtctgactctgtggaagcaggaagacaaactttcctgcctctctctaagcagcctcgctgtgccatgctgtgagggcctgcagctctctgactcctcggtggtctccctgccttcagtctggcctttccacattaactaaccagagagtccctaaaacacagatctgatgtcttcctacctgctcacaaccctctatgacttcccattgcctttgcagcattcaaggccctgagacctcatcagccccaacactctccaccgcaggtgccttaccagctgcccaggctgcagcttccaaagcacagcccactctttcccaaggctgtacctctgtcctgctgttcctgctaccctgaatgccattcctctctttgcatacctgacaaattcctattcatccttcaagaaccaacttcttctggaagccttgcttgacccccaagtgagtcagactcctgccctggctgacttctagggcagcactccacatgcctgcaactacctgattggcctgcattcctagaactgcccggttcagcaaagatgacagtaagtgtacaatgacttaatgaattagagaggctaaaactgcgttgtccagcatggcaaccactagccacacatggccctttacattcagaataattcaacttaaaattaatgttgttggccaggtacggtggctcacatctgtaatcccagcactttgggaggctaagtcaggcagatcacgaggtcaggagttcgagaccagcctggccaacatggtgaaacccccactctaataaaaatacaaaaattagctgagtgtggtggcaggcacctgaagctacttgggaggctggggcaggagaactgcttgaaactggaaggcagaggttgcagtgagctgacatcgcaccactgcactccagccgggggaaaagagcaaaactctgtctcaaataaataaataaatcattgtgttaaatgaataaaaatgcaatgagctgcactagttgcactgcaagtgctcaagagccacatatagttagtggctataatattggacaggacagacacaggacatttccatcatcacaaaaagttctattggacagtgctgacctaagagtggtgatagaacaccagcagatctaggttctagcttcagcttagttcctggttcctactttgcctctctgagactttcctcatctgtgcagcccatcccacatgctgtgcaaggccaagcatagacagtacctgacaaggacattccactgattccatcatcccactgctttggatcagacacacgtggacttggggaagcagatgggcaggcggcacctggctgcctagaggtgagggacccaccctcaggctccagcagctcagaataacccagggtccaaagctaacccagtgagtctcctaggaaggcaggctctgcagagagcacggccagtgtgcatctctccataggcttgaacaggccagagtgggcctgatgatcccaaactcatctcttctgaacccagagggagacccaggcagagcctaggggaagaggcagctgcaggggctggtccaaaggggaggggaggagtggagagtcagaaacgcgctatcagcactgcccgtcctccccacttcctctcttcgaacggatcacatcctgttattgtgtggaaagaaaaggccgggagctggggagggaggcagagctcggaccaagcaagtggggagaggtaggaagagaaaggaggagccagaggaacaggacagtgggcagcagggagctccaccagctccgccctgagccaggtggcctgggcaggagtaggggacccaggagggaggatgagcatccatggggcggcctgcatcccccattgagagatgctggggcccaggacagaaaatggcactccctcctggaggctttccccaagcctcttcctcaggctccttcaatttagctaatgttcaccctggtctctactgccagagcaggatctcccgtggctaccaggcctctctcacacagcacttgcctccagggtggaagggctctgtatccattcccttcaccccacttccacccagcctgtgaacccctgcagacagggccagggcagtcccttgctggctcccctgcactgctcagcaggaattcctgttgctgtgaatgattaagtttcccacatcttcctcttctttctgtcttctgccattcccaagcataccccctatccaaatcccatttccacgaataataacggctgttttctataaaacataagcacttcacatccattattttgaaatcccatgacagctctgcaagatgggtgttaatatcttcatttaaccaatgaagaaactgaacctcagagaggtaaagtgatttacccaaagtcacacagctggaacttaaacccagtggtctgactccaaagatcagcctctttctgttggcccagttgcccttcccattcactgccttctgtgccctggcctctctcttcttgaactgataccaaattgactgccctgactgtccactgggcttgtcctcaagtcgggcccactgcttgaggcaagctgtccagcgcccacactgattgctcatagtcctagcagattgctggggcaggctgagctgctgtgtccctgcacagcacaggcctatttgctctaaggacaccaactacctgttgactattttgtcttcctttcctgagaggtagtgagcactggctctggactcagatctgactccaatcctaggtaaccttagtcaagctgcttcccctctaggcctcatttcctcctccccacaatggagaggatgacttgggtgacccagacttactccctaccttactctgactcacagttgcagagcctctgttgctggacaccatgcccaacaccatggcctgtgtccccatgggctggtcagtggtactttactcgttcgcaagggcagtggggccagagggggaacactggcttctagggaacagttagttgttttgcacatagggaaggaggtagcgggcaggcatgaggaggctgggctgccatgagcagaccaaatcaacagcctcccaatcttcctatctccccacctcaccccacccagctccagtatgataaccaggcaactgcggcccagcccaagaaagcccacacttgtcctccctctgcccacagcaacaaaagcagtgcaagggcagagctgtacatctgcccctgactagctcaggaccatggctacagcagaaggcactggagctgcatctctgtaacaatgattctgcctcccacccatctccactctttcattccatgccggcctcaaaactgagattctacacaggggaaccttctcattcggcaaatgctgaaaggaacctgtgccaggtctatcatagggtgctggaggcgaagagatagatcgcacgtgatattgcctcaaggagctcatgttttagtgggaaagcagacaaggaaaggaaggcccgtggggggcaccaaggaggcagttgaccccatagagtagtcaggacagtttgctggatgttgaggacaagttaaccaaatgaaaggagggcagaaagagaggatgggtagattgtcctgggaaaaagaaacaaaaggtgcaaaaactggaaggtcattaaaaaaaataaaataatgtgatctggaatagaaaggatggtacaatcggagcaaagagaataaaaaagtggtgagggttgaggctgaccgggtcagcagggccatttcaggcaaggccccagttgcagctcttttccctggaggacagaagggcccccagtgcctcagggactgagctgtcctgggaggtgggaagtctggtcctcccctgccgatcactatgggatgtgtggccctggaaagactcttttcctctctggccctgtctcctcttctggagacatgtacactagcccacatggccccccagggtcaggccaacctggacattctatcacctcatcgtttctgccttgctggccgcagagttcacgggcccttccagacctcagcgtggaatgccttgccctctcctgggaaaaatccttctggaaatggtgctcctctcttcccattctttagtccaggacagtgaggcttctgcctctatccctcccctggtgtcactgtcatccaagtcatcagtgacctccatattgctaaatccaatcaacacttgcaggcctttcttgcctgaccactcagctgcgctggacttgcctaaccacttccctcacccttttcctctgaaacgccacagtctctaaaacagcacactctctgtttttctccttcctctctgattgctctttctcatttctctccctcaagcccttaaccacaggtcccttcctcatactgctcctctcacctgtgagcacagaccaggccaacaccaccactgctgagatccacagccagctcaccccacggctaaatctcaccatcctatcatcccaggtacctccttgtcctgtgccagggagaggcacacctgggagcttccaaaaaccaaggagcttctctacagggcagagcatggtccccaaggactaccctgcctctgccctcctatctgtggttggaagcaccctgaggacaagagcagccaagtcagagcctagcaagatgaacaaggctcaccccaaaaaagccagagttatctgtgaggtccttgaactcacctcttggcacaacttttttcttaatactaatcactttgtaacttactacagaatcaacatatttattacagttgtgtgtgtctgtgtgtttaccgtctcccctgctagaagttaagctccaccagaacaagaacagggatctttgttttattcagtgtgggatccccggtacgtagaacaataccaggcccatactagatgctcaataaatatttgttaaatgaaacagggtgccagttccacatgctgtagtcctaactactcaagggactgagacaaaaaccttctggtttttgcaccttttgtttctttttcaccttgatggcccttgaactcctgagctcagttcaagatcagcctgggcaaaggctagaagaagcaagatcccatatcttgaaaaaatatataaataaatgaaagaaagaaaggaaggcatgatacttcattagaagtgcctgcatgacctactgaaatccctgaggatcaaatggtccacatgcagtggcttcccccagacccaggtgctgtgccctttgttttatttttggaaaagaataagggttgtatcatctaaaccacatttccattcctgagcctccagggaagtcctcccagatgatatggagcctgccacagagcctccactctcgacttccattaccttcagacttcatctctgagtccccaatccttaagagccaggcataagagctgcagccgccgctgcagccgttgagtcatcagggaacctggggccctcctatggtatggccttaatctgtcctgaacctaggatacatacaactgtcccagccatggaagctcaccccaacacaaagaggggatgtctgctgaggcttcctgagatacaagcatgggtgcatgaagccaaggggacaggccccctctatgaggcctgtggagagaaagaatggaaaccctggggaggaaggctgtctcctccccaccaggcctgccttcagggttgagggtggaatcccacttcctaagactacagctgagtcttggaggctccccatgtcaggagaaacaggttcttgccatgacttttctttcaatatcccgtctcaggcctaggggtgcaatgcaagcacagagtcctaaggcccctttgtaaaacttttatttagaaatcttcccgatacatcctcacatatatatacacatcatcaccacatgggttttttttgctaaagagtcacacacccacagtgttggcctctgggctgtacaaaggtcaaggtacctggagcggttactcctcttctgcagaaaaatgcagagaccaacgcaattcatcacatacagtacaacgttgacggaaagtgctgggcccgcccacagaaacaatgcactatgtacacgggcagggggcaagtcttcagcagagggtcacgtaccatcgaaatcacaagtacggccagacccacccccaaaaggccgaaatagttgtcggctgactacagatgctgtgccctttgttttattttggaaaagaataaaggttgtaccatcttgtcatctgccataacaaataaaagaatatgaatttgtcttaaaagatgtgattcccttcagtggttatggtcatctttgttctcaaaatgttgttttgttttgttttacctttatgttctttcccctttgtacagatgctattcttggaatgttgccagtttttcatgggtaacaaggaaggagaggaaggataaggtcatggggtacagagggtgaaaataaaaattacagatcttctttagttcttacaaagacctaaagacttgccctttcctaccaggcttgttttgggtagttgcattacattttacacagtctgccagtgttcccatatctcttttccattcttattactgtccctggccttggaacaagatagaaattaagacaatctgggctgggtgcaatggctgacacctgtgatcccagtgcttctggaggcaaaggcaggagaattgcctgaagccaggacttcaagaccagcctgggcaatatagcaagactccatctctaccaaaaaaaaaaaaaagtaaaaattagccaggtgtggtggctcacacctgtggtcctccctactcgggaggctgaggtgagaggattgcttgagcccagagttcaaggctgcagacagcaatgatggcaccactgtactccagcctgagtgacagaacaagacaccgtctctcacacacacacacacacacacacaaatagataatctggagaaatgaggacaatctcaataactcaggccaaagcggtttacaatctaaattacccaaatgctgggcagtcaggcacaccggcctactgcctaggtcgtggactcaggctgcgaaaccccactgcaggattgagattgagggaaaagaaaaagttctttacgttctcaaaactgtctactttcatgatcccattcagtccacaccatagccctaggagataggccaagccagagtcacatggcaagtctgaaagaagagggagccagaagtttgagttcttaataaaatatgtgatccatctcataaaacccatccacccatccatactgtggctacttctcattcctaactcaagcgaatccacggtgaagcaaacagccttagatcctacagcaatgactctatctttagacagatggggctcctcacaggatcttccaaacgttggaaaggaaccaaccctaattttcaccaaaacatgatctggggagcctgaaattgaatggagagcctgagtgctacaaaggtgaacaatgttgccccaagctcgagaattggaccttacttaaaaggaaggggaaaggagcagacatattctctgtctgtacatggctgaattagggccccatcatggtgaggacaagccactaggctgaagcccaaactataagggggggctttccagacagccacagtgatgagttcttgcatggcaggacagggccacaggctatctctcctctgacctcgaaggcagagcctagagggagagggctagggtgacttaagggtacaatgacagacatacaggacttctgtgcaatttgtcccatgggcttagatgcaggtcacagacaggcctcaccttaagaaaaccacatcccaccatctggattgacacaggaaatcaatgaaggggcagtggttcattctacaaaaggattcttcactttacaaaaggacttgcagtggttatttctttaaaagatgaaggataaggatgtgatttacaaaaatttcatgtacaactttcagaggggagcacttctattgcattaaaccaacctcccagacgcacccttgatgaccaaaagctgcacaactgaggggtgtttaaggttctgctaagtgaatgtgcatatgtttgggtcttagccagggcctggtctctgattggatttcccataccctagaagtgaggctggatcctggtccta

SEQ ID NO: 15191 - DNA, 27968 bp, Human
  misc_feature (1)...(27968): n = A,T,C or G
ctcctgaaacattagatttgaattggaaatgtcagtataaacttccattattctgataactgaaaagatttagaagcacggacatcccactagcaatgaacaccccacaagcccacacttgggctttttttttttttctctcacacagggtcttgctctgttgcccaggctggaatgcagtggaacactcatggctcactgcagcctcaaactcctgggctcaagcgatcctcccgcctcagcctcctgagtagctgaaacaataggtgtgagccaccatgtctggttcatttttaaagtttggtgcagatggggtcttgctatgcgactcaagctgctctcaaactcctgggctcaagcaatccttctgcttggcctctcaaagtgctcagattataggcatgagccttgccaaattaaaaaaaaaaaaaaactgtttgtagacgctggtctggaactcctggtcttgagcgatcctcacccctcagcttctcaaagtgctgggattacaagtgtgagccaccaggcctagcttacttttcttcagaattaaaaaggtttttaaaaacccctgtcctgccccagtcctatctcatctcactgaatggctcccccttacatctgcttcctaaaaacaaagtcctggctgtcatccttggtgactcgtttcctcccatcccaccttggatccatcagcatttatccactcactaactccaagatttattaagcatctactggggccaggcattaaatcccccatggaccaagcacagcacagatacctgaggggaaagggaacaaaaatacccagggttggccgggtgcggtggctcacgcctgtaatcccagcactttgggaggccaagacgggcggatccctgaggtcaggagttcaagaccagcctggccaacatggtgaaaccccatttctactaaaaacacaaaaattagccgggcgtggtggtatacgcctgtagtcccagctacttgggaggctggggcaggagaatcgcttgaacccaggaggcggaggttgcagtgagccgagatggcaccactgcactccagcctgggtgacaagagcaaaactccgcccctgcccccgccaaaaaatacccaggatcagaacctgctgtggctgatcctatcagttccttcacagttggccctcctcctctcacctctctacctccgcacacacctgagacgcgcctggcagccatgctggcctctgtccttcctggaacattccaggaaacattccaggatgctcccccagggtccagcttggctttaggggctcgcccatttttgcctagaatgctctctcaccagatttttgcatggcacaccctctcttcttcaagccatcaaacatcacctctgcgaggccctccgaccactatatttgaaattatgacacccccacgtccagtgctgccagccctttgccccgctttgctttctcctaaccacttgacttcctgactgtgttgatcgtctttcttctccaactagaatgcaaccctcgtgaggacggggacttggctgtttttctcactgctacaccctgggtcaacagtcttgggatacagtagctggtcaataaatatttgatgactgactccatacaaccccactgtaaggtgagtcctattctccttcattttacagatctctcccaaggttcagagaggataggtgacttgcccaagaccacacagcaaacatggcagtgcaggccgctggcctgtcctcacagaggagcctcccattattcctccaggaagtcacacagatcaaggtttgaatcctggctctgcccttgctggcttcctggccaagttgttaccttcctggataagcctttttgctctctgattctcactctcctcagccctccctaaaaggagggctgaatgaggtagtgccacagggtgtgtgcctcatgagaggggagccccaaaaccctccactgctgtccccctggggtgcaggcccaccttgacctgggcatagaagctgcccaggctgcagcacacgcggcactcgagcatggcgtcatcattgttgtgggcgtagcgcagggccttctcgaagctctccagggccttctggaagacgctgaggcccaggaaggcattgcccatgctcaggctgacctggcctccgagctgggcacctgccctggtaccaggcagcccaaggcaggtcttgcagtaggagatggtcttgtgaaactcgcacagcttctcgttgctgcgtgccaggttcaggtagctctccaggaggaagtcggcatcctccagctcccgggccgtgtcgatctggaccacagcgaactgcacacagcgacggtgggcaggtggtgctcagcctggactctgagccttggaccccagcctgcactgcaggctcagacctggaggccccacacccaccccccagcctcacacccaaagcagcagatcccaaagcttcttttcagacccagagcttctacccgccagcctcagctaccttccctacaccccagcctcacctcccaagctcaggcttgcagccttcaccttctatcccaagcctcagatctggagtctccaccacccacccacccccagccgcaaccctggagcccacaccccgccaggctcagacacagaacaccagacaggaaggctgaaacctacaatgggcttgagacccacaaaccctcgaccctgaggctggagaacctcagtctcagagactcgggcaccacagttcaaggccacaggcctgaatctgatgccaagactcagtatctaagacccagggccttagatataaattcagagcctcgggccctggctgccagcctgtgggacacaggggagcccgaggaggccgagaggggactggggagcctgggagacatccggccccagcctgaccctcgaacgcccccaggccgggtacacccaccttcagcatctccttgtagcggcccatctccgagtgggctgtgaccaggcagcccagcacgcggaagcgccccatgaggtccgagctcttctccagcacctttgtccacacctgcaatgccttctctgtctggttggactggtacagctggagccccttctcgatctgctgcttggtctggtcctgccccatcctccccaagccctgtgtcccacgtggggtgatccctggtggctccgtgcctctaggcactcatggggcaggaatcacagtgccagctgccccccgaaacgtgggaacaaaagcagcgtcgggtgggagccggaatggggcctggatggagagcaggcgccaccctgggaacaaagctggttcagcccgtctgcagctgtcgctgccagttggggccacatggcctctgaggaatgtcagcagcaaggtcacgtgggcctctgctgcacccacccgcgagctgggacgtggcttccctgagcatacaggcaccttgccacctgggcacccccttgggcgtcccttcggcacctctgacactgaccctgaccgccctggcagcacgggccctcccagcagccttgccaaggggccagctccagcaagtgggcaggccttgggctagaggtgctcgggggaaggagagcgaggctggacctgcaggtccggggaagccaggtgagcgcccagccctgcttcttccccatcaagacacccctgaccgcagcatcccctggctctgttcctgaaattcactgagcaccgtgggtcactcatccaggcccaggctgacaccattcaccaactctcaccttagagagtctgggaaagacctccagctggtgagaggcctgagctctagcctggcttccttcgaactctcagtgggaccctagccaagtgacctggcaccgtggactgaagagaggaatggtacctggctcactggactgctatgagaactcaatgacgaaagagttgagaaggacttaggacagtgcccggcacaggaaaccccgcatgtgctgcaagaggctattttgctccatggcaaatccccacccgggccagaacccagcccttgaagtttcaatgtctcacttccaatcccaaccccgggctgaaagggtcctcataatgagatttaacaccagatactgtggagaagggcaaggtcttatgtagtattggggcccccgctagcaggccagctcatccagcccccctttctcctctctctgcatgccagccttcttcctgccccagggcaaaagtttatcctttctggctgggcaattcagtggtttttagtatattcacagagatgcacattaattgccactaattccagaacattttaaccaccccaaaaaggagacgcacacccatcagcagttacaccactccattccccaccttgatatgactgaatcatgtccccccgcaaccaaacgcatatgtttaagtcctaacactcagtatctcataaggtgactgtctttggagacagggtctttaaagggtgattaaggtaaaatgaagtcacattgtacctcatccagttaagactggtatccccccccccttttttttgagacagggtctcactctgtcacctaggctggagtgcagtggcaaatctcagctcactgagacttctacctcccgggttcaagcaattctcctgcctcagcctcccaagtagctgggatgacaggtgtatgccaccacgcctggctaagtttttgtatttagtagagacggggtttcaccatgttggtcaggctggtcttgaacttctgacctcagttgatccacctgcctcagagcctcccgaagtattggggttataggcgtgagccaccatgcctgaccacaatacttttttttttttttgagacactttccctctgtcacccaggctggagtgtggtggtgccatcttggctcactgcaaccttcacctcccaggttcaagtgattctcctgcctcagcctcctgagtagctgggattacagctgcgcaccaccacacctggctaatttttgtatttttagtagagacggggtttcaccatgttggtcaggctggtctggaactcctgacttcgtgatctgcccacctctgcctcccaaagtgttgggattacaggcgtgagcccccgcacctggcccacaataaatgtttaaaaaggacacagtcacacagaagaagagcacgtgaagacacagggagaagatggctatctacaagcccaggagcaaggccttagaatgaaaccaactctgccaattccttgatcttggacttctagcgtccagaactgtgagaaaataaatttctgttatttaagccacctggtgtctatggacctgtctattgtggacccttcacaggaatggaatcatacaatatgtggtcatctgtgactggcttctttaacttggcataatgttttcaagattcaactatgttttcaaccgtatcagaacttcattacttattgtggttggttaatactcattgtctggatatacattttgttgattcagcagttaataggcatttgggttgtttcatttttggctactatgaataatgatgctataaaaattcatgtacaaattgggctgggcacggtggctcacgcctgtaatcccagcacactaggaggctgaagcaggcagatcacttgagcccaggagttggagaccagcttgggaaacatagcgagaccccatatctacaaaaaatacaaaaaaaaaaaaaaattagctgggtgtggtggtgcacagctgtggtcccagctactcgcgaggctgaggcaggagaatcgcttgagcctacaagcttggactgcagtgagccgcaatcatgtcactacactccagcctgggtgacagagcgagaccctgtttcaaaaaaataaaaaattcatgtactaggttttatggggacatgttttcatttctcttaggtatatgcttggagcagaagtgtgagtaatatggcaactgttacattctggtacctgcctacctgtctgccccagggcctttgcacctcctaattccttctctgttcaccacacccacactctgcctcgtaagtcataattaggatgaatcagcatattatcctctcattgaattacactgcattctgatacaggacttatctctataattttattttgagacagggtctcactttgtcgcccaggctggagtgcagtggtacaatctaggctcactgaggcctcgacctcctgggctcaagccaccctcccacctcaaccctcgcaagtagctggcattacaggcaatgccaccatgcccagctaatttttatatttttagtagagacggggtttcaccatgttggccaggctggttttgaactcctgtgctcaagtgatccgctggcctgggcatcccaaagtgctgggattacaggcgtgagccaccacgcccagcctctctataattttatattagtgaggttgtttgctgaatgtctttattcttcactcaaatgaggtcatatggctgggccctaacccagggcaggactttgtctccttcattactgactgtattcccagagcaaggcccggcacactgtggcccctcaataaatgtcaaatatcggtgaatggggaagaagcggaggaaagacggcttcaccgggaaattcagagcaactacacggcctgcttcctgagagcccaacgggtcagaggggacgctctgggggtcagaaggcaaatgccccaggctcaacagaggcagagtgggagcaggctctgggacaggtggctgggcaaggccacctggactccccaaaggagtgctcctaagcctgggaaagggagggagagctggctggggtcttctctcatctcagggaggcctgggttgatgctgagctgcagatgggagggaagctgggcccacagcgaaggtgtgaagggccagcagattctccccactccaaggcccagacactattcacattgagtctctggcaggaaggaatggaggaagggcggcctgcatctacaccccaacagagttggggaccacagccttcctctttcctggggaactcaaatgacctcaaaacttgaaaacttgatgggatcaagctgtcctttccctgagacaggtctttgctcatctgacttcagtgatgggaatatgcccatactcgcttattctaggtagcagagtaccttatgtttccttgaaacatttcatttcttctttattattattattttttttgagatggagtttttcactcttgtcgcccaggctggagtgcccgtggtggtgagaggtgaagccagctggacttcctgggtggagtggtgactaggagaacttttctgtagctaactagaggtttgtaaaatgcaccaatcagtgctctgtaaaaacacaccaatcggtgctccgtagctagctggagatttgtaaaatggaccaatcagcaccctgtaaaatggaccaatcagtgctctgtaaaatgggccaatcagcaggacatgggtggagacaaataaaggaataaaagctgcctccccgaccagcccatccccaccccaacaagccagcagcagaaacccgcttaggttccgttccacgctgtgggagctttgttcttttgctctccacaataaatcttgctgttgctcactctttgggtctgcaccacctttaatagctgtaacactcaccacagaggtttacggcttcattcttgaagtcagcgggaccacgaacccactagaaggaaccaactgcggacacagtgggatctcggctcactgcaacctctgcctcctgggttcaagcaattctcctgcctcagcctcccaagaagctggaattacaggcgagcaccactacacctggctaagttttgcagttttagtagagacggggttccaccatgttggccaggctggtctcgaacttttggccttaagtgatctgcccgcctcagcctcccgtgagccaccatgcccggcctcaaaaatttcatttctgagcacgttttccagaaatcagcgactgtagttaggttaagggcatgctcctctatggcaacgactgtggtttacttgtctttgtactactagtaactaacggcacggcccctggcaaggtaagaggagaccaacagagaatcctatttaacattctaacattttctgagttaagcatttcttccagtttacaaatgaggaaacaggcatggagaggtaaggtgacctgcccaagactacactgccatctgctggtcctagacagctgggaccagaagcagtgtggttgtagagtctcgttctttttttttttttttttgagatggaatctagctctgttgccgaggctggagtgcagtggcgcaatcctggctcactgcaacctccacctcccgggttcaagcgattctcatgcctcagcctcctgagtagctggaattataggtacgtgccaccactcttggcttttttttttttttgtatttttagtagagacgggctttcatcatgttgtccaggctggtctcgaactcctgacctcaggtgatatgcctgcctcggcttcccaaagtgctgggattacaggtgtgagccaacacacctggccaggactcccattcttaaccattatactgtactagaaaggaggcgaggacaagggagatggagaaagtggagaacagaacaatagttttccggaattcattgcgatctttacctgaagcacagcaaagtcactgggaacttatccaaagctgtagcctgggtgggcagaaggcatgtattaaggagagggtaaagagttaagacttgcttaccagtgcccagtagatgaaaagccctggaaggtgttagggaacagccacaaaatgaaatggtcttttcagtgccacttaacctcacaaggtggtgatacagtcgggggattcagggctatcaccagagtgcctgctgggccaggtaccagctgcacacctcacattttagatccctgttttataatcaaaagtagaaaattaagtttgggcctgaagcaagagtcacaatctggcatgtgaggactaaatatttctgagttggttggcaacatgtgttatctaggagattttacataaaaatgtacatttccttgcttctcttgaagagtggaagcttggcctggtgcaggggctcactcctgtagtcccagcactttgggaagctgaggcgggcagatcacctgagctcaagagttcgagaccagcctggccaatatgatgaaactttgtctccatggaaaatacaaaaaattagccaggcatggtggcatgcacctgtagtcccagctactcaggaggcagaggcacgagaattgcttgaacctgggaggtggaggtggcagtgagccgagattgtgccattgcactccagcctgggtgacaagaggaaaactctgtctcaaaaaaaaaaaaaaaaaaaaaaaaagtggaaactcacgcatgctcagaccttgactgcctaccaaccactccagtggtcggggtctggccccaagagaccatgaatgtcttaccaattcattcattggaaccatgcacccctgactccctgttctcgccttgacactgaagccaaatgccacttgtcttatgctggcctcctttcacatgagtacatcacagttgcagcccctgctccagatgcatgacgaaatgtaactgaaggggacagtcccaaggtccctctaccacgactatcgggattcttgggaagtctccccatcttaccaagttagtttccccaattaaaaagatattggccgggcgtggtggctcacgcctgtaatcccagcactttaagaggctgaggcaggcggatcacaaggtcaagagattgagaccatcctgcccaacatggtgacaccctgtctctactaaaaatacaaaaattagctggcgtggtggtgcgtgcctgtagtcccagctacgtgggaggctgaaggaggagaatcgcttgaacccgggaggcggaggttgcagtgagtagagattgcaccactacgctccagcctggcgatagagcgagactctgttccaaaaaaaaaaaaaaaagatatcacctctctggcaagttttctgtgaaaatcaaatgagatgataagataacttgctttgaaaagaagccattgaactaacatccctctattggcttattatttacggtagtgaaaaactagaaagaatctgtgtctgatagaagggtgttcataaccatgaagtgctatgtagactctaaataaggaagcagtagatacctgtgtacccagatggaagggagcccagggcatagtaacttaaaaaagcaagctgcagactgggccgtggtggctcacggctgtaatcccagcattttgggaggccgaggcaggtggatcacctgaggtcaggagttcaagaccaacccgaccaacatggtgaaacctggtctctaataaatacaaaaaactagctgggtatggtggcgggcacctgtaattccagctactcaggaggcagaggttgcagtgagccaagatcacgccactgcacttcagcctggtgacaagagcaaaactccatctcaaaaaaaaaaaaaaaaaaaatcacaggaactaactttgaccaagtgattgacagaaaccagtgaacattttcatagtgatcaaagcaccccaaagctggtccttctagactgataccagttgatctgttgtttcgttttggagatgggcagcctcactgctggcctctcagtggttgcttttaggatacagctgtctgccctccgaactggtggctggagtatcctccagcgaacagaaggctgtggaatttgtatcatgctctgaaaatagacctacccgtagcttatggacataaagactctatgcagaaacctcctcaactttaatttgtagtcagctatggcaatggaacacatttttcatagggaannnnnnnnnnnnnnnnnnnnctctgtcacccaggctgaagtgcagtggggcgatctcagctcactgcaagcttcgcctcccgggttcaagctagtctcccgcctcaggctcctgagtagctgggactacaggtgcctgccaacacacccggctaatattttgtatttttagtagagacagggtttcactgtgttagccaggatggtctggatctcctgacctcgtgatctacccgccttggcctcctaaagtactgggattataggcatgaactaccgcacctggccttttttttctgagatggtttcgctcttgttgcccaggctggagtgcaatggcgcgatctcggctcattgcaacctccgcctcctgggttcaagtgattcttctgcctcggcctccgagtagctgggattacaggcatgcaccatcatgcctggctagttttgtatttttagtagagacggggtttcactgtgttagccaggatggtctcgatctcctgacctcgtgatctgcccgccttggcctcccaaagtgctgggattacaggcgtgagccactgcacccagccatttttttttttttttttttgaaacagggtctcgctctgttacccaggctggagtacagtggtgcgatcatggctcactgcagcctcaacctcttgggctcaagcaatcctcccgcttcagcctcccaagtggcttggactacaggtgtgtgccatcacacctggctaattttttaaattttttgtagagacaggtctgtgttgcccaggctggtctcaaactcctgggctcaagtaatcctcctgcttcagcctcccaaagtgctgggattataggcataatccgagctaccatactcagcatgatctcaacatgatctcatttttattaacaaaaattacttattttttgtgtttataaggaaaaatccggccaggtgcggtggctcacgcctgtaatccctgcactttgggaggccgaggctggcggatcacgaggtcaggagatccagaccatcctggctaacatggtgaaaccccgtctccactaaaaatgcaaaaaattagctgggcgtggtggcgggtgcctgtagtcccagctactcgggaggctgaggcaggagaatggcatgcacccaagaggtggagcttgcagtgagccgagttcgcgccactgcactccagcctgggtgacagagcgagactgcgagactccgtctcaaaaaaaaaaaaaaaaaaaaaagaaagaaaaaagcaaaatcctggaagcatatgaccccatctgttatcaatgggctgtgggatggggcattcgctcacttttaaccatgacttactgttgttactagcgactttaatgagtgcttgccaggggcagtagcttggctatttgtttgtgcatttattcttttttgagacggagtcttgctctgtcgcccaggctggagtgcagtgacggcatctcggttcactgcaagctccgcctcccaggttcacgccattctcctgcctcagcctcctgagaacctgggactacaggcacccgccaccactcccggctaatttttttttttgtatttttagtagagacggggtttcaccttgttagccaggatggtcttgatctcctgacctcgtgatccgcccgcctcggccccccaaagtgctgggattaaaggcgtgagccaccgcgcccggctgtgcatttattctttttgtagagatggagtctcgctatgttgcccaggctggttttgaactcctgggctcaagcaatccccctgccttcgcctccccatgtgctgggattacaggcatgagccaccacacccggcccctttggctagtttttgagacaatctctcatcttcccaactgtacggggcaggtgcttttgtttccatttaacagatgaacaatctggggctgagaatcaagtaatttgtccaaggtcacaggggtgctgatggtagacttggtattaccggattagggaatccttaaaacaaagatttccccaacatactctaagccttttgaagaaccacctaaatgttttgcatttaataaaaaaaaattaaggccaggcgtggtggctcacgaggtcaggagttcgagaccagtctgaccaacatggtgaaaccccatctctactaaaaatacaaaaatttgccaggcgtggtggcacgcgcctgtaatcccagctactcaggaggctgaggcaggagaattggttgaacctgggaggcggaggttgcagtgagctgataccatactgctgtactccagcctgggcaacaagagtgacactccatctcaaaaaaaaaaaaaaaattcaaaccctcacctgattttgtaaacaagtcattgctgtcaggtgtttcgggctccaggcacatcccattctagggaagggcaggttagtggcactctcagggctgaatggccacaggtaggctcccctcacctgggtccttccctgaccgccaagggggaacctctaacagcacagggccctgctactgaaacaggtgctggcaccaacttcaagtggcagggcccctggtgagcggactcagaagttgtattagaattcctgtaaagtcgctctgagggacttggcggtcatttgtgttggatggtgacagaaatgtctactgaatacttacccgccagtgtgtgtggaatggtgaggcctccagtgagaaatgaagtatggctcctgtcttcatgaagctctgtcccagaggtggaatttaaaccagggcaccccagggtccaccttagtgacccctcaaaggaatatgttctacaggactacggggtcaggttggcctgcatgaaaacacaactgtcctacttattagccacatgaacagaagaactgcagcttctctgtgcctcagtctatcttcctatgctaccagttgctgggaggacgaatgcagtggctgtggctgattaataaatggtggctttgttttcttaaaagcagaataggtcgggcgtggtagctcacgcctgtaatcccagcactttgggaggctgaggtgggcggatcacctgaggtcaggagttcgagaccagcctggccaacatggtaaaaccccgtctctactaaaaatagaaaaattagtcaggtgtgatgccaggtgcctgtagtcccagctactcgggaggctgaggcgggagaactgcttgaacccagagggcagaggctgcagtgagccgagatcctgccactgcactccagcctgggcaacagtgagactccatctcaaaaacaaacaagcaaacaaacaaaaacagcaaactgtctagaacagtcctgccactgcctgtgatgatggaaatgttttgtatcggcactgtccaataggatagccaccagtcacttgaaatgtggctagtgaaaccgaggtactacatttttgttattttaagagggagtttcgctcttgttgcccaggctgcgtacctcgcttgacccccaaaccccaatccccccccacacctccccagcctcaacccatttccccgccccgtgcccgagctcgccccccatgggccgccataaagcccaccccctcccacacccacacaccccctacccccccccccccacaccccccgctaccctttctcgacgccgccccccctcacagagcgggccggttctcgtccccccccnnnnnnnnnnnnnnnnnnnnacaaacaaaaacagcaaactgtctagaacagtcctgccactgcctgtgatgatggaaatgttttgtatcggcactgtccaataggatagccaccagtcacttgaaatgtggctagtgaaaccgaggtactacatttttgttattttaagagggagtttcgctcttgttgcccaggctggagtgcaatggcatgatctcagcttaccacaaccttcacttcccgggttcaagcaattctcctgcctcagcctcccgagtggctgagattacaggcatgcaccaccacgcggggctaattttgtatctttagtagagacggggtttctccatgtcggtcaggctggtctcaaactcccaacctcaagtgatccgcctgcctcgtcctcccaaagcgctgggattacaggcatggagaggtaaggtgagccactggctgggcccatatttagttatttaaacaaaaaaagctacagtgcctagtgggtaactgtattggacaactgtgagtctagaagccttccagattcaggctgaggcagataatatcggcaaccagaaagaggagctgggagagctgcagaaacaaggctggattgggagcagacaagctcagaaggatgagggatggcaggagcaggtgccacaaggcagtgggtgctgccactagctttcaagtaggaggaagaaaggagaaaatacctcaggatgttgactaagtgaaggccagacacaaaaggccacatatcccatgactgtattttaatgaaatgtccagaaccagtaaagatacagacagaggtatatttgtggttactaggaaatgggaaagggagtgagggagaggatggggagtgactgctaaatgagtacagggttctgaaaatgttctaaaattaggctgcattcatggttgcacaactctgaaactcagtgaatggtatgctttaagtggatgagttgtgttgtgtgtgaattatatctcaataaacctgtttattatttttttcttgagacagggtctcggtctcactttgttccctgggctgggacagtggcacaatctctgctcactgcaacctccgcctcctgggttcaagcaattcttgtgcctcagcctcctgagtagctgggattacagccatgcgccaccatgcctggtttatttttagtagagaaggggtttcgctatattggccaggctggtcttgaactcctggcctcaagtggtccaccgaccttggtctttcaaggtgctggaattacaggcatgagccaccacgtcatgcaataaagccgtttaaatacaacccaaatctcaagaggactcagattagtaagacccatccccactaatggaaaaaccttgggtagagcaggccaagacctgggcctggaaagtgtcggggactgcgggaaagcccttcctggttgtgtgagttcaatttcccatcccaaggctgccttcaatttatttttgagatgggagtctcactctgtcgcccagactgaaatgcagcggaatgatcttggctcactgcaacctccgcccgccgggttcgagattctcctgccgcagcctcccgagtggctgggattacaggtgcccgccactatgcccagctaatttttgtatttttggtagagacagggtttcaccatgctagcactgctggtcttcaactcctgaactcaactgatctgcctgccttgccctccctaagtgttgggattacaggagtgagccaccgcgcccgacctgccttgaatttttaaaaaacaaaagccttccctatagctggagccttcaaccagtacagagaaagtcaatgcatgcaaaagcaattaaacaccagatggtgggggttggaaaggactcctgagaaggaaggaaaatgcttgaaggcacaaggtgcaaggcaagtccagctccgatctctcctgaagggaaatattatcaaacattagtctgacattccctgaggtgcaggcacaacctggtgtttaatttccagcctggtggctttttcctcatcagggaccgagctgctcaggtgagcatagtatgtgagcattagggaagctgtgtgctgaccgagaaagtcagtgcggaggtgcctctgccagccagatgaacaggaatgtggcaaaaagtaggtgttgagcaagctacagaaggatgaagaggttttcaaagaatacaaaacattggccgggcgaggtggctcatgtctgtaatcccagcactttgggaggccaaggtgggtgatcaacttgaggccaggagtttgagaccagcctggctaacatggtgaaaccctgtctctactaaaaatacaaaaaattagtcgaatgtggtggcacatgcctgaagctgaggcaagggagttgcttgagcctgggaggtggaggctgcagtgagcagactgtgccactgcattccagactgggtgacagagcaagactctgtctcaaaacaaaaacaaaaacaaaacaaaatccaacaaaacacttaattaagatacagctttattggccaggcacggtggctcatgcctgtaatcccagcactttgggaggccaaggcaggtcaatcacctgaggttgggagttcgagaccagactgatcaacatggtgaaaccccatctctactaaaaatacaaaaattagctgggcatggtggtgcgtgcctgtggtcccagctactagggaggctgaggcaggacaatcgcttgaacctgagaggcagaggttgcagtgagctgaaatcgcaccattgcactccagagtggacaacaagagataaactgcgtctcaaaaaaagatacagctttattataataaatatgcaaaagcctaaacttttttaaaaggctgaaatagtacttgacatatttccttttttgggtcaattttatttattatttattttgagatggagtcttgctctgtcgcccaggctggagtgcagtggcgcgatctcggctcactgccagctcaggctcacgccattctcctgcctcagcctctggagtagctgggactacaggcgcccgccaccatgcccagagaattttttgtatttttaatggaaacggggtttcaccgtgttagccaggatggtcttgatctcctgacctcgtgatctgcctgcctcggcctcccaaagtgctgggattacaggcgtgagccaccgtgcccggccttgggtcaattttaaagagaagcaacagcctttaagcattatttcaattaaaagatgctcaagttatacttaatattctatttttagataaaaggcccaggaagagagtctgagggggaagcctctgattctctacccttgccctccactacaccaatttccccaagtgtgaaatgcagaactcactaagaaggcactccatggacactttatattagtagttatatgtgtgtgtgtgtgtatttttggagacagggtctcactctgccacctatgctggagtgcagtggcatgatcacagctcactgcagcctggacctcctgggctcaagcaatctttccacctttgcttctggagtagctgggaccacaggtgtgtgccaccatgcctgattttattttttgttgagatggggtctcactctgttgcccagcctggtctcaattgatcctcccactttggcctcccaaagtgttgggattacaggcggagccaccgagccctgctaatgtgtattttataatgtaatgattacagcatcaaacttgtaatttcacaaatatcagtgggtcagaatgaaaaaagtacatttcaagttgatttacaaaattaggtggtaatggggctgtgcatggtggctcatgcctgtaatcccagcactttgggaggccaaggcaggcagactgcttgagtccagaagttcaagactagcctgggcaacatggcgacacctgtctctacaaaaaatacaaaaattagctaggcatgatggcatgtgcctgtaagtcccagctattcgaaggctgaggtgggaggatcacatgagcctggggaggctgaggctgttgtgagcaatgactgcaccactgtatgccagcgtcgttgacagtgagaccctgtctcaaaaacaaaaaatcaggtgatgatgattgcacaagcattgtgaatgtgtttaatggtagtaaattataaaattatagggagtatatattcagggcaacttgaatctatactccaaagtaaaacaaaattcttaaaaattatacttaaaagtgtttaaaatggcaaatttgattttgtcacaataaaaacaaacgacactgggtaaacaatggttgagctggtctcagatctagtgacgtgagagtatggagaggagtgctctttagaagttgcccgtcccccacaggcagcagcgccctgcaggagcccgctgaccaaccagttacaagtgaacctctcaaacaccaaaatggctgctttaaggagggcgcagctgcaatgagtcacctcccaggggagccacaaaagccataggtcctctaagctcctctcactggggcctagaggacagagagcaatcaatctgtgatgagacacaggttaattaaagcacatttattggcttttgaattctttctattcagtagtggttaggagaaagggctcaggagttgggcaatgtggtttgattcccagtgcacaccactttctagcaggcaacccaatttcttttaacctgtttgctcatctgtaaaacgaggatgggaaaactagctacctcctagggatgctatgaagcctggaacatgtagtgggtatcatgtgtatcctgcagcgcctgatggtggtaaacaatcaacattagctaggataattatttgcatataagttctgatttttaaacatttttaatgaataaaaatggggacgtgaacaaaggaacacccaaatgcagaacttggtagacaaaatctaaaacccccaagctgccacttgtttttgagaacaagtggacagcaaaagggatccccagtctgggagacgcttggctaaatcaagtctgaggcttctttactgcctaatttcagagagaacattctttattgcagggacaacattcacaaacttatttgtgttaagaatccttatttcatagaacatatcatggtctagtactcaatgcaaccctcactgagaaatgctacccaagacccactccacatagagggacatgtaggagaaggctgaggcctggtccatccagcactattgagtagtccacagagccttagaagcatgccattcaggggccttgtactgaggtcagagtgagggaagtagaagcttaagaactttgggccagagctttaaaggtctggagggaggaagactgccggggctctgggatttggtgctggccagcagagtcctagggagcagggactctgcgcactagggaagagatgtgcactggcaggtctggaccagctctgttttgtggcagccaaggagaacaggagatgctcaaaaattagggtgggcaaaaaagttttaaggtgtttccgcataagtagaaatcctggagaatacaaaaagatggggaaggcagttttctggggagaaattatgttttccttcaggagcttttggggggttcagctgcacatcttcaggtacataaaaatgaagccttatagggcacccacaccccctcttcaggaacatggcaaccccacctgctccaaggacacatcaccctccccaacaatcagtaactctgaagacatcagttcttctcaaacagtttaatagcaaataaacaaaggaaggtaccacacttggcagatacaaaatgactttttgtccatgtgtctgtgcaattaaaacagatttaggttccccattgggacaaaaggaaaaacacacaaaaaaaggaaggagattcctttgaaacacatactcccttgctccaaacttataacaatttttttttctttttaaattcactacacaaactctgtgattaggtaagaaaagcgacgagggctctccttgcctttttttaaaccattaaagtaaaatccataattttctacagagtacaacacaagttcacacaaaaaagacattttcttttgcaaatcaaaacaggaaagaaaggaaaagctcaaacaagataaaggaaaagcatttctacggctgaatcacgactgagttgattgaatcccgttgttgctgcagaacagactgtgcgtttggtcatagtggcaatttttttttctcttcacattgtgaaatcactttacattgttttctagtagaaaaggcaaaaaactgtacaaaacccctagtgttaaatacaacgtttgtaccaataaaaaactcacacaggtttgtctccaaaatgtaaagtttctttttttttttctttttaaattattcacaaaaagcagctggaaatcagaaaggcagctgccgctccagggtctcaaatccattaaaaccaccacagaacaattaaaacaatcagagagagaaaaggaaaaggaaacaacgtccaacatttggcatttggttttatccacaggttttcccagagctcctcttggaattgaaagcaaaatatattggcaaacactgcttctcaatacacaggaaggggagcctcagtgcctcctgccaacagaggcggctctgtgcagtcagactgtggggtgcacagcagtctctcaggctggggtttctggcctctttccatccaatcaccccttccaggaaattcagcagcctaccagacactgggcctctgcctggctgccctttcccccaggcagagcggccttgggcataataccaggcaacctgccagccccagagcagaaaccctgctgggatcccttccttcatcaaccttggtgtggaggatgctcaatagcgcttccacctccccctccccagcccctagctacatctctccacccttccctggacagtcctacttcccagctcacccacccaccagcagcttaagtctgggtgggatctatcatcagctcctccccctgtaacctcttccctccacagatccaccctgtgctcctctcctcacctctccccctccactcacattcttactcaagtctccaagaccctgaggctggatggtgccacaagagaggagggtcagtttccctcagggaaccaaaaaactggcttgcttggcacccagggacagtagctgtttggctctccacccaattaaaaaaacaaatccctgccctttcccccaccccactagctaagcaagagcagagctgtgatgaagagccagtgccgggtggctggtgcccagggctgtaaacagtgtgaagactgtagtattgtgcttgtcacctaggaaaagcgccagcaggtgaattgccgcttggtgtgcagatggcctcctacgggtgattgggagcgccctccttcctccaggtgctcactgcccctaatgtgctaaataagcctcttacccacctgctgccaccttctaggctctacctctgcttctcgtgtctctccaggcccccttcccaccctctctgagcaaagcagccagcctcccggaagccccggtaagacctggaggccacacgaagtgacagtctaagtgcacaggcaaacgctctaagggcaatagaggagaaagttgccacttcaaaattaaacaatacaatcttgaaaaaaataatcaaccctacaacaatttaaaacagcttctttgaaacccttttaaatcgatcagtttttgcacaaactatagaaaacagagaggtgaaggtgatatatacgaaggtgtgaagaaacagcaggaaacatgcaaaacttttttctgggcataatcttagtaggaaaggaaaaaattcaaaacaaaaacacaaaaacaatacaaaaacaaaaacaacaacaaaaaaatcaaagcatcacattttgctgtggagactgttggaacaagcatggggctgaggggaaggggcaggcgggatatccaggactccccagagtcgctccagggaagaaccacaaaagaaaaagaaaaagaaaaagggctggctggggcccaaagtgcagcctgcggtcaaaaaggaaagggggttcaggtgctctccgcagttgagaactcagaagaaaaacaaaagaaagaacaatacatgcggtctcctcaagccccacagactgtatcagcaaaatgtgctcaggagcctcagaggttttagtgacatcttttatttcattgtttacttcaaagttgtctttaaaactaagcacacagagaaacaaagcctagaaacggactggctgtgtgttcacagaaatacaaacaccacgcggtatgtgctagtagggctgctctgaagacaattacaaagaattggaatcacaaaatcaagtggttatcttatgaagttctagaaaaatagattttttttatattcaaatgcaagtttaaatatttccccttcagcagtcgttctagcaaaaccaatttggcagcacaaaaggaaaaaaaaaggaaagaaaaaaagaaaaaaaaacgaagaaagaaacaaacataataaaaatacacatcagcatcaaaggtcaacacaaggtcaaaggtgagagttcaagcatcagagaagctgaagagacagggatttggacgatgtacttgacgccacatcgacatgctttaggcacaacgatgaacaaacggcaggaatctagaaaaaaaaacaaaccagaaagagggagacccactgagttacacagagcaatacatccaaacaaagagagagagaacaggaacactcactgtgtgtacagccctgaaatgaggtgggcgggcaggggttgggtaatgacagggaacttttgcacatgctaacaatggacacagggaaaagtcaaaaaggacatggaggacaccaagaacacatctaattgccagagacagaagggaacctaaggcttggattttccatgaagcacccaactcctaagagaaggtctccaggggagcagagcctcagcctctctccccactccctggtcacaacccaaggggaagcagaagatgctggctggggtggggaaaatttttcagggaagaggaccagaatttctgctcaatcttatggggatggccctttgttcccagaaatccaagctcttagcttccatccaggccctggccactcaaggggaacccaggagacagtggtctggctgcattcaaggcaaatcaatttcatgatgtaacccaagtaagaaacaaaactacagcagaaaacacattgtaagtgaaaccttcacacaacagaaaaggattgcttaagacttgacagcgagtctccactctgagctgagccctttcacacgtgagacttgtaggggagcagcttcttcacaaaaccatctttggcctggggaaagaactgtgctcaagggcagtgctactgctgtgctaactcactgggcagggggaggagagaacagagaagtgcatggtctcaccagctggctgctcaagcagcccaggaccctgctggggcgagcattccttttagaaaagaaaacccatcagcaggtatgaagccctcagggtctggtatcaaaggtgggtggattgcaccttggcctcttatgtcattaggaaaggggtttcataaggtcccagagcccaggacaaatccatggacaaataatggtgagatgggggaaggcggagagaagaaggggatgtgggaagggagtggcgttctggctaaggaggaagacagaacagaaggctagggagcacagcaccggcagcaccctatggagcacagctctctcctctgccaattcacagcattaacaccttccccttgggcaggttagctgggctgcaaacgggccacagaaagtcagtagtttcaatcatacacagcaccctgtgtgtataacaatcacattctggattctacaaaatcctggccttttccagagatataatttaggtaataaatattctccaccccggagctgtataaaacttctataaaaatagaaacgacattcttggttccagccggttgggattcagaacagcgcctccccaacctagcatttttttcttttttttttttgttttcttttttcttttttatttttattttttgcatttatttaaaaaatcccatcatgaccctggaagcctttagaacagttttatcctttgaaacacaggacacatttctcccagtgcgcagaatttcaagtttacgtggttcagcttaagaagtgtatgtttcacgttccttagaggacaacagacccaagttatcactatgagaaaggaacagctgtcccagcttcaatgggataatccaacaccaccagctacctgtacaacagtaagatggtcaatccctgtctgttacccacagggacagcatgacaaggagagagcccccatctgacttaatagcaaaccaacccctttattcttatctctgctgctaggggtcaagactggtatttgttgaggtttcagattccagagacccagggatcccatccctggctgtggctacagtcacatcttaacagggccacctctgcccaggtgtacattcccaacagcatgtccttcctggttctctacccccacagcacttcttagagcagaggcagagcccagaagctgtgtgggtcacaggcaagagctgaagtaagacctgcaagaggcggcagggagctaactgtagcacgaggacaaaaatgaacacggtaatactgaggtaaatgaacactcaattcatgtggaggctgtaaacgtcctgatgtcacctctgcctcaagagcagaaaatgtgactggagtggttacaggaggggcctgccagacccctgtgggaatactacatctgggacacctcaatcaaggaggcaagggagaatttctggccactggcaaatgaagcatactggcttgcagggaccttctgattcaagtacaccaagaaataagctcctcctcccccaactagatggtattgatcactctgcccacaaatggtacccccttcagcaagaactgcaagcccttcttggatttgccttcatgagaaaatggtggcttgggatggaggtgacattccttgctgtggtgaactgcaaagaaggaaaccaggcaatgtattccatagaggcctttaaagagacccgttggaaatgggccatggtctaatttggtgttgaaataaactaacctctttggctgtttctcccaaactgccaccagccaggcaaggccaatccaatactgactgctggctgggggagctcgtaatgggtgatgccgccctgctttttgcatatgtcaggctaacaggtgctttatttccagagaattgttaatgcccttttttgaaaagagcagcagaaattccggacaagaatctgaaaaataggtgtcaaaaactatttcccagaaggtagctgtacaggagtttgagtctccagctgccagggcattaggtgtctagtcactccactcttccccaaagccgctctgctccccacagctcccaggtgtcagttctcattctacccaccctcacactaagagaggttctgggggtcacttttttgttccactcagtcctctctcttggggtggtttggggcaaatcctgatcatcgtctgtgttaaatgtttccctgtcccccttccccagggtggtttggtgttggtccttctcaacacacactggttacaaacacagcaaactttaaataaaggagaaacaaaaacaaaaacaaaaaaaacctcaggatatggcacctaaactccaaagtaaaacactggaaaccaaagcacaaacttgtcctctgtacgaagcgaaactcccacagaaggcagtagccgagtcttcagggcaagctgtgcctgcgagagtggcagggatcagggtccagggctgtcaacacacagcctcagggcttcgaatcattaagggtgctcctcccccacttaccagaagaccctctcactccagtctcagaggggagcacgctcagtagggcttgctgtcattcttcgaacgtttgagctgcactttaagccgcttcatgccaatctgaaagccgttcatggactggatggcagcttgggccgaaacaggattgtcgtaacttacaaaacctgtgtgtccaagcagaaacctaggtgagggacataatgaggcaaggagattctcagtcctccttatgcaagataccttatgtgcttcatctcaaatcccaattttattcagcagggacaagaaatctggacattatgtcatacgaaataaattaggttcttaatagtaccacttaacagctacatggtaatttaaaggtttttttctttttcttgagacagggtcttgctctgtcacccagggtggagtacagtggtgtgaccatggttcactgcaaccttggcctcctgggctcaggtgatcctctcacctcagcctcaagtagctgggaacacaggtacacgccaccacgtctgactaattttttgtagccatgaggtctcactctgttgctcaggctggtctcgaactcctaggctcaagcgatcctcctgccttggcctccccaagtactgggacttacaggcacaaacctggactgtttaaaggtttttttgcaaaccattttccatatattatttttctctctggagcaacagtgtgggtagaaatccttacctccactacagcaatgagaaactggggctcaaaaagaggtcataatgacctgcccatggccaagttaaaacaacaccacaaactcatattcagatctttctgcagtgagctccttctttctcagtggtaaaatactaatcccatcctgacaccagagagaagccaacataccaaaacacttgctcaggtttgtctgcttgtctatgaaaaccttggcagacacgacattcccaaagggcataaacatctgcagcaggtcctgatcaccaaactcctggggcaggtggtagatgaacaggttggctccctctggaccttcaaaatacccaggaattggaaaagtatcagtgtcaaacatgctcgtcgccctgcaccagtgatctttcatttccacctatgttaaaactgtcacaatccctaaaaacagagattcatctggggaactaaacagattctctaaatacaaagcaaggaaccaaaggca

SEQ ID NO: 15192 - DNA, 27968 bp, Human; identical to SEQ ID NO: 15191
  misc_feature (1)...(27968): n = A,T,C or G

SEQ ID NO: 15193 - DNA, 31390 bp, Human
  misc_feature (1)...(31390): n = A,T,C or G
ccacttatagtcccagctacttgggaggctgaggaggcagaattccttgagcccaggagttcgaggccacagtgagctatgatcacaccactatactcccgctaatgttagtacagactggagcacacagaccaaggaatctttgtttcagcaatcttctttaattggtgttactggacatagaatcttgatgtaaccatcaacttcagttaacctagtcaagttatccacctatattattatgttattattagcatctgaagaaaggtccttgaaattagaattgtatagaaacaagaagtaaaagtaatcaaactgctgattttgtctttcctttgttcagctaacatttgataaccacgtggtgtgtgtgtgtatgcttgtgcacgtggatgtgtgtacccatttaatgcttgttattgagaatatagagtgaatcctgccttcacggagcttacagtggcggatacatttgtaaataaacaagcataggtgttgtgatggaagcacattctagatgtcatggagacatgaggggatgccatgatggcggtgctgccactggtagcatcatctgttgactgtccactgtttgccaggccctgtgctgagggctttgagggcttgacatgctgttcttattttaattagcacttttttttttgagttagagtctttctttatctcccaggccagagtgcagcagcgtgatcttggctcaccgcaacctccacctcccgagttcaagccattctcctgcctcagcctcccgagtagctgggattacaggcacctgccaccacagctggctaatttttgtatttttagtagaggcggggtttcatcatgttggccagtctggtctcgaactcctgacctcaagtgatccgcccgcctcggcctcccaaagtgctgggattgcaggcatgagccaccgtgcccggccacagttagcacagctttttaagtggaagccttgataggttaagtacctcaaatgaggtatgacaataagtagtagagtctgggtttggattcagatccaaggtcctaaagcttttgccataaatgacaggatgtatcagtagcttcctaggtttacttttcctcctctaaccatccctatctctgcacataaagaaggaataggaagcctggagagccatttgatataaaagatatatgtgggggccaggtgcagtggtgcatgcctgtaatcccagcatgttgggaggctgaggcaggaggatcacttgagctcaggagtttgagaccagcctgggcaacttagtaagaccccatctctacaaaaaatttaaaaattagtcatgcatggtggcacacacctgtagtcctagatacttgggtggctgaagtgggaggatcacataagcccatgatgtcgaggctgtagtgagctatgattgcaccactgcactccagcctgggccacagagcaagaccttgtttctaaaataatttttttattttttaaaaaaggatgtaggtgaggagttagccctagccccactctctcctataaaggatgtaccatggggatctagtctagacggttcctcagtgtctgtaattatgcattttctctgagtattctttatattcaatgttttgccaactctgtttctaaagaggctttcttttccctctgctgagcgttgcggaaactggccatcagcctgactgagccccagagccctctgcctcctttctcagtgctgtgcatcgcaaccagcagcctctggtttctgccttgatcccctcaatggtgcttggtgaggcaagcagctctatttcaggcctgcagaaggggagagtcacttcctctttaggatctgttctttaaatgaacccctcgtggaggggaagcctgcctgctaggacacatctgtgtgcatgaatacaggctctcggaaatctcatcctcacttcagcagcctgctggttacactgctcttatctcccctttcctgccttttaaggattgcaaggctctgtggttctgataagacccagttatgacctgaagaatactggctggacagattggaggaaacctatcactcttgaagggaaggagaggctcaaaggggacacgagatcctgcccttttccaaaaggaacccttgaggacacaagagcggtcctctgcaggatgaatcaccctgaggctctaggagaaactttgataagcatgctctgccttagggctgtgcctgtcctgtttcctgctcttgatagcaggcaagtagaaagacggacctctgaccctgaactgtgtgccataatgaggaaattccaccctgaaaatttagaaatttagaggtgagcatgcatgctttttttttttttttttttttttttgagaccgggtctcactctgtagcccaggctggagtgcagtgacatgatcttggctcaccgcaacctctgcctcctgcagagaaccttcaagtgattctcatgcctcagcctcctgagtagctgggattacaggcatgtgccaccacacccagctaatttttgtatttttggtagagacggggtttcaccatgttgaccaggctggtctcgaactcctgacttcaagcgatccacccacctcagcctcccaaagtgccgggattacaggcgtgagccaccttgcccagctgctcatcagtttttaagtccaaaaataaggctaagaacttcctggaaaaattgatagaacatgaactcaaatgaagagacagcttacttcaaccagtgttagatgatgtccatccacttcctaaaaatgaattcggtattagactttgaaataggatttatatattttttttcattctgaccccagaattatccaattattttttaaaaaatagtcaccatcatatatcctgacactgagtttccaggaaaaagaaaaatcatattatatgcttgagaagaaaattacatggttggaagatgttttggttgattatttgtataaacccaacatctgtgtgtatgtgtgtgtgtgtgtgtgtgtgtgtgttttaaatcctcataaaaaaagaatgaaaagctttcattgcatggctcttttttttttctatacacttgcttctcacagtgttggaagaagtcacaagttagttatagcaggcagtgaaagcagtttatgtttttccatgaacaaattggttccatgtcttgtatttaggcttcttgaaaaaaaaaaaaagagagaaaacaaaaaactcagaagaaactgcaagcttattgtggaaaactcactttcattttgagcacagatactggttctaggttcaaatagtagcatcctttatctgtttgcagaacttggtagttctacaatttataaacccgttcatacttcccttgccccatacccaagtctctctaaacacaatgtcttctccattattttccatttcagctagaagttggttttgaaaagttaagtgctgtgtttgcataatcttcacccaaccctttttctcctccaaactttttatcttgtttggttgccaaattcacacgcattgcttgtagttacccaacaatggcttttgtttcattttttcatatgttctcaatggttttcccacaatttttgattctagggacaactagggagagttcatgagttgcagaaacaaggaaagttgcctccattaattgtaggcttactgaattagttaccatcaccaagtataggtaaataggagaatgactatttaaaagatgaaaagaatagatttcatagtaagagagaagtttcctctctcaagatattccttcttcttcctcattttcctcctcctattatataataataattattattattccctgaagcattgttcatagtctggtgggacaaacagttgttgctaagagtaatgccttcttaacagtgaataccgaaagtttcagttcaagtactagaaagtgacttgtcatgaataatcacagtttaaatttaagtgatgcttaattatacatttattttttatgtttttgagacaggatctcactccgtaacccaggctagagtgcaatagcacgatcccagctcactgcaacctctgcctcctgggctcaagtaatcctttcatcttagcctcccagtaactgagatacatttttaattttttgttttttaactttttggccagtggctggctaattttttgaagagacaaggtctcactatattgctcaggctggtctcaaattcctgggctcagccgatccttctgcctcagcctttcaaagtgttgagattataggcatgagccaccacgcctacatttataaatatttatggaggacttttatgtacagggcagtctgccgggattttcacttatctaatgtcatttaatcacaagtaccacgtgaagtaggtagtattactcccatttcacagatgagcaacatcaaggcttgagaggaaaaatgattggccagagtcatgtatctaggagtgacaggattgagatttaaatcaagatcttctgattccagggtcacattcacttcccagccaataagtaaacggcagtgatgtcaccatggaggtcctatgtgtgtgtaacagtggattctggaactcagcttgaaagctcatgcagtagaattttaagaacaaaactgtccaattagggttggagtttttagtgcccctacattggatttagaggctagaattcaagcatctgcctgctttttgctaaaaatgtttattgtacaaataaatctgtacccaactcctgaaaacaccaggtttttatttttaaatgtgcacaacttccaaaggccggtttggtgctgaattggaaaggattctagttcgcaaaacctggaaaatgaccattactcttgttttctttctttcgttctttttctttaaacagttgtattgaggtataatattgccatgttttcttaacctagctttttggaagaaagtttgggtcaatgttaagccaaaatttcttaacttctagggctttttgatatggtcttgcataagtttctcaaactctcacttttttattactcccagataaatcttttcagtagaaatttgggaaatttttgcattttaaaaactcgtacttgctgatgcagttttttttctttcttttctttctttctttttttttttttttttaagacagagtctcactctgtcacccaggctggagtgcagtcactgcaacctccacctcctgggttcaaacgattctctggcctcagcctccccagtagctggaattacagatgcgcaccaccacgtctggctaatttttgtatttttagcagagacagggttctgctatgttggccaagctggtctcgaactcctgaccaaaggtcatccgcctgcctcggcctcccaaagtgctgagattataagcgtgagccaccagcacccggcctgatttatttttaaggttagctttcctgaaaatgccttcttctctaactcctggttagcctgcaagccagacaaaatagcactagttacgatgataccagtaagatgtcaaaataaaactttgccacaagtcaacatggatatggactgcttattagtataaagcagggatccccagcagtattgaaatatgtggctttgtaaatttgtctgtttccttgtgcagttctgtcagtttttgcttcatgtatttggatgcatagctattattaaggtgaataaacccttaggatccttatgtccccttgaagaactggtgactttatcattatgaaatgaccttctttagaccagctgatattctttgctgtaaattctacttgttatttataaagccacttcagcttttttttttttggattggtgttagcatagtataactttttccatccttttaacccttttgtggctttatttaaagtgctttttttttgtaggcagtatacagttgtatcttttttccccaatatgaaaattagtcttttaattggtatatttagattacttacgtttaatgtaactatcaatatagtaattttaaatctgtcatcttactgtatgtgttctatgtatcttgtctattctttattcccttttccctggtttctctgccttcttttggattgaggtgtttttttgtttgtttgtttgtttgtttttgtaatgattccatttgtctcctttgttggctaattagctatatgtctttgttttgttattttgtggttgctttaagatttacagtataatctgggcataggggctcacacttgtaatcttagcactttgggaggctgaggcgggtggattgcttgaggccaggagtttgagaccaacctggccaacatggcaaaaaccccatctcttctaaaaatacaaaaattagtgggttgtggtggcacatgcctgtagtcccagctactcaggaggccgaggcatgagaatcacctgaatccaggaggcagaggttgcagtgagacgagatcacaccactacactccagcctgggcacagagcaagactgtgtctcaaaaaacaaaccaacaaactatttagagtatacatctttaagttatcatagtctacctttaagtgatattatatcacttcacatatcatataagaacattacaataggatacttccatcttggcctttgtattgttgtacagtttacttttacatatgtgattaactccatataagttattattgtttgagaagtcacttctcttttaaaagcttaaataataaggagaaagctcttatgtatttacccaggtagtaactatttccactgttctttattcctttgtgtatatccatatttctacctgattattttttctacttaaaataatttactttagcattttttgttatgtaggacttctggtgatgaattcattccatttttatatgtctgataaatccttattttgcctttatttttataagtaccatgtgctaactagttgtataattggagctacagttttatttttggaagctatttttgctgggtatagaattatagattgacaattttttcttcttagtttatgaaagattttgcttcactattttacacttgccttgcttttgacataaaatctgctatcattcttaccttcttttgtttatgtgatatgtcctttttttctaattgcatttagtatttttattttttaaaaagtgaagtctcactgtgtcatccagggcagagtgcagtggtgcagtcatagcccactgtagcctcaaactcttgggctcagtcttcctgcctcagcctcccgagcaactgggactacaggcacatgccaccacgcccagctgcttttaagatgttttgtttgttcctggttttaagcaatttgcaatgtgctttgatatacgttagtttatatttcttgtgcttggaattaaatgagctccttggatctttgggtttatatttttattaggtttggcatattttttcagccattatttctttaaatatcattttctatccctctgtgccccccatgtggaatccaattacatgtgtttaggctgcttaaagttgtctccacagctcactcatgctttgttcattttttttaaactttcttttctgtttttcattttggatatttctattgctatgtcttcaagttcaatagtcttttcttctgaaatgtctacctgctattaatcctatccagtctactgttcatctcgcacattgtagatattatttctagaaatttgatttgtgtttttatatattcatatctctgcctaaaatcttgaatatttgtccttgtctgctaattctaatacctttcttaactcttggtcagtttcagttgattgacattgctcctcgttgtgggttgtattttcctgcctttttgcatgcctggtaatttttgacaggatgccagacattgcaatgttatcttctggggggatggaaatattgttgagctttgttttgggatgtagataaattacttggagacagttgattcttttgtcttactttcaagatttattaggtaggagcagtgctaattagacagggataattatttcttaacccgtttataccgagtgttccataattggaacactaagcttgtgggagttatttatatcctattgcttaaggtcatcaccaaggtctgatttctcacacacaaaaaatttgcaacctccagcataaatgggttaagcaacatctttctgagtacccagtgcttgtgaattatgagtttttccattctttttgtttgtttgttttgagacagagtcacactctgtcatccaggctggagtgcagtggcacgatctcagctcaccgcaacctccacctcctgggtttaagcaattctcctgccagcctcccaagtagctgggatgacaggcactttctaccatgcctggctaatttttgtatttttagtagagacagggtttcaccatgttggccaggctggtcttaaactctcgacctcaggtaaactgcccacctcggcctcccaaagtgctgggattacaagcatgagccaccatggctggctgagtttttccattctatcaggtggaaacagacactgttttgcatcagtaccagacactgttatctccaatcttttctagtgttcccccaccccctcaggcacatgtagtttgctcagaaacatgcactgactactcaaagataaatctctggacttctctgtgtagttctctcctatttggtacttggtcctgcaaattctaatggcctgggtctaccccagattctcggctctgggagtctgctgggtgataacctagggcggtcatattgcctagaatctgaaaattcagattctgttcagtaggtttttgctagggtctgagactctacatttctaagaaacttttagatgctgtcaatgctctggaaagactacttcgagtagccagggtccctagatattcaacagatatgtaatgtaaaccacatatgtaattttacatttcctagtaatcgcattaagaaaattaaaaagaaacaggcgaattttttttttttttgagacggagtcttgctctgttgcccaggctggagtgcagtggcgcgatctcggctcactgcaacctccacctcctgggttcaagcgattctcctgcctcagcctcccgagcagctggatctacagcgatgtgccaccacgcctggctaatttttgtatttttagtagaaacgggatttcaccatgttagccaggatggtctccatctcctgacctcatgatccacccgcctcggcctcccaaagtgctgggattacaggtgtgagccactgcgcctggccacgaaacaggtgaaattaatttaattatatattttctttaactcagtctacccaaaatgttatttcaacatgtaatcaatgtaaaaatattaatgagacattttttcttaaattttatagtaagtcttaaaatttgatatgtatgttatagctatcagatactacatttttatctgaaatacttggtctatatttagcttttataaaatttatagttgaaaaagtatatttgttaaccaaaccccaaatatacaagttctccagcaactgaactcagcatcaaaaaatcattctccacgatattcgcattcaacttgacaaaactggttcatcttttttagaataattaatttgactttttgaaacaaaaaatatcagtttcaaagctacatctgttcaacttaggcaaattcactaactcttatgccagctcagaattgttgacattaaattcaaaggaatattgcaaaaatggaaaaactaactctaaatttatcaatatcaacaaagtattccccaacattttcttatggattttgaaggcaatttatataatgcttttgatttcagtgaagtcatccacatattgattcaagttacaaaaatgtatgaaaccattattttttacttctcttatgaaaaatgtcaattttgacataaattctcctgcctctctagctaggtcataagtaagtttttcctttccttgaaactttaaatttagctctttcatatatagtgtgtgatatctgtgaaaaaaaacataaatcacactgcctattttttttttttttttttttttttttttttttttgagagagagtcttgctctgtcgcccaggcttgagtgcagtggcgtgatctcggctcactgcaagctccgcctcccgggttcacgccattctcctgcctcagcctcccgagtagctgggaccacaggggccccccaccacgcccggctaatttttgttttttgcatttttagtagacggagtttcaccatgttagccaggatggtctcgatctctgaccttgtgatccacccgccttggcctcccaaagtgctgggattacaggcgtgagccacggctcccagcccacagtgcctatttttgtcttcatttcttgcttcagcaagcattctttttttgtaaagaaaatcctgcattgtagttaactgtacagtgaatgtttgtaaaaattcttctatgattcaaccagagatcattggcaaagaacacatgatcaatcatttctggttttctatttctttcagcagttccataaactgcttcaagaatccaagatgttttataactggccagagttatgagctgagatgtaaaaaatcattaaaacaatttttttggccattcttattttgagtgactaatttcattgatctgtttttgactgtcgaggggagatggcatcaaattcattatgtttttgctgaaattgtctgttaatattttctgctttattatctttgactttttatgtaacacacagctttctccttttgctctgccacagcaagttataattgccattgattatgttgctttttgcttaccttcctctcctgtctctttttttcttgactgttctgattgtattattaatttctgtgtctccactggattttgtatcagtcctaaggctttggaaagtgtctctgtgttaggactgctacaaaattttcaaagtgataaattagaaaaattggccatatttattttataaactagagaaacaatgtaattatatcttaattaaaacaagtattttgatataattaccaattatgatttacatagttatcaccataacttgtgctgtctgtgtaaaatattcatatgaacacattacagtgttacatcagtgtttagaaaaaaacatttaaatggaaacactttattgacaccaagtagatcagtgatgctttcctttgtagactcatctgctacaatgcaccaaataatattttaagcaatatagtatttaaagtaaaatgtagttctaccaaagcaatgcattaatgtttaatggaacatgttttacattgcttcagtttttacatttaaataaaatcatgtgaaattaattaaaagttgacattcagttcctcagttgcactcaccaacttaagtagccatgtgtgcccattggttcttgtattggacagcacaggccaggggctacttgcatttgaacctaggaaccttgtatcaataactagatggttgctcacttttcttgcccagcaactacatcttccttgccttgtcccatggcactcaggaattttaggagtttggcaaataaagtcttgtacaattaagtggtctctgaaggtctcttgatgaccatgactcttggacaacttcccactgtgctaggccattaggacaagtctggggacaacttctgactccagggacagtctgtgggatgtaatagggattagcttgggacaaggccaaggcagagtttataggtcaactgcagctactcttcctcttcccatgggttactaaccaatgactcaagagcaatctggcttgatcttagttggatgggaatgttgtcggcagaggtagcattctcattgttctggaaggagcaggtttcattttcacaccaatcacgagagtgttaggggaaagctgtcccttagctaagttggctaggaaggttttcaaaaatccatctcaattaatcatcataggctatgaaatgacacctgaaaaatatgaagaaaatggaatgggtggtttgtgtgttgaatacaaaataatgatataaagcattctagaattcagaaaccaacttatgaaccaagatgttattttcagagtggatatactcaccttgcctggaccctgattaaactcctcctctttttttgtttaaagttcaatttatattctgaccgttttctttgtttagagttatattgctttggttcatatttttgtactgccttcacaaaatattaggggtgtttacttagatcttaggtttctcaagtctttttcttccttccttccttctcttttttcttttctttttcttctttttttttttttttttttaatttcagacaaggtctttctttgttacccaggcaggagtgcagtggtgcagtctcaacctcctaggctcaagtgaccctcccacctcagcctcctgagtagctgggaccacagctgtgtgccaccatgcccagctaatttttaattattttgtagagatgggctctcaccatgttcccaaggctggtcttgaactcctgagctcaagcgatcctcccacctcagcatcccaaagagctgggattacaggcatgagtcaccacgcccggccaagcctttttcttttgtctctgatcctcctaaactttcttttatctccaaaactcttgctctgtgctttgtacactgctgcatgttcagatagagcttaatctgtacttactcatcactgatgattcataaaatacaaagtgtgctttagtaacactgaatagtatagtctagaatcctaaaaaagttgagaaaaagactttgttctccttattttctatttttttctattgctccaccttgtattagaaattaggaaagactcgtggtgaatgtgtccaatcagttcacctcacctcatgttgtttctaaataaaataataaaatctgaacccatagtcttcgccttttttgaggtttaagtattggttcatctatgtcgttatgtaatttcaaagtgccttccggaaaatccctcgggatggagatgactcaggatagctttgcactggtttgttatggggccatctaaatgaaggaatggccctctgaaatggcagcaacaaccctaagctgcctgggttccagtcccagttctgacaccgtctaggtgagtagcctcagccaagtaacttcccactctctaaacctcatttttctgtctatacaaggtaggaattagatgatgacattgcttcccaagccttcccacccaacactagtggcccttgagatatcattgattgggtgcttctccagtatatccatggaaattggagaaatgctgtgtgctgaattctattccatatttggcttccaaaagctcataagcacattagagactgcaagaagccttgaagtaaagaaatctgcttaacatttttaaacctagcattttctaaactctttgaactggaaactctccctcttttggaggaaaagcttcaagtatattggagtatcctgtagtacatagtttgggaaatgctggaatagatcagtggtcggcaaatagcagcctgcaggccaaatccctcttgccacctgttgtgtaaataaagttttattggaacacagctacactcattcatttatgaattgtctatttgccccagaatagccaagttgcagagttgtgacagagacctgtatggcccatactgccaaaaatatatttaccatctggttatttacagaaaaaaaaaatttgctgactcctacacacaggattattttcaaagtgattcatgaacatggctgaaaaaatcagatcgtggaggaatgctgtaaatgaaaagcaatagctttgttccagaagcaacacatttttaatggttcctgttaaaattattttagtggttattactaatagttgtataactcctcactcagccgtttctgatgtatgtgctttgggttgcctctgtttgatagaccacgttcacatgcacacacacacacacacacacacacacacagaggcatgtacaacttcttagttttatcagtacatgaattcctctcttgattaccactgcagtttttttttttcttttttcttttttgagatggactgtcactctgtcgcttaggctggagtgcagtggtgccaccttggctcactgcaactgcctcccagattcaagcaattctcctacctcagcttcctgagtagctgggattataggtgcccgccaccacacccagctaattcttttgtatttttagtagagacggggtttcaccatgttggccaggctggtctcgaactcctgatctcaagtgatccacctgcctcagcctcccaaagtgctgggattacaggcctgagccaccgtgcccagccctaccattgcagttttaatgttcataaacctctatatcttgttgcatttatttcctacctattaggtgccaaattttataagatgaggggactagtaccactaaccttccgcattcctctcttttcctgttgtccatctttcagcttttctcagctatgtctttatttttacagtgttgagtctgataacatttgccttctctatctggaaatattttccttgcattgcccattgattgagtctaaaggttgcaagctgtcttagtccctttagtgttgctataaaggaatacctgaggttgggtaatttataaagaagagttttatttggctcacgattctgctgctggaagattgggcatctggggaaagcctcaggctgcttccacatatactgaaaggcagagaggagctggcatgtgcagagatcagatagcgagagagaaggcaagagagagaggaagaaggtcccaggctctttctaacaaccagctaaggtcgcaggctctttctaacaaccagctctcctgggaactaatagagcaaaaattcactcactgcctccccgccccccagaaagagcattaatctattcatgaggaatccacgcccatgacctaaacacctgccattaggcaccgcctccaacatagaggatcagatttcaacaatgttccaaagggtcgaatatccaaaccgcagcacaagccaatgagcagtgttaatgtaaatactgtctgtagaagagccaagcagtgcttgctgtgattatacttccctctctataattctaatatcacaactgcagcatcactcaaaatagatagttcttaatatctttttctttaaaattttttaaatttttatatttttattaaaatatataaaaaatattgaacacgtcatgaatttgcatgtcatccttgcgcaggggccatgctgatcttccaattttagtatatcattccaattttagtacctgtactgtaatccacccgccttgacctcccaaagtgctggaattacaggcatgtgccaccgtgcccagctgctctaatatcttttccaattgagttcattctgctcatttttaccagttgctctaaatcatggcactttttttttttttccttgagacagagtctcactttgtgtcacccaggctggagtgtaatggcgtgatctcggctcactgcaacctctacctcccgagttcaagtgatttttgtgcctcagcctcctgagtagttgggattacagggtgcaccaccacacttggctaatttttgcatttttagtataaacggagtttcaccatgttggccaggctggtctggaacccctgacctcaggtgatctgcccgccttggcctcccaaagtgctgggattacaggcgtgagtagtgtcgcctgtccagtcatggtgcatttgaaccatgtctctcctgctttttgttggtggcatttgttttcccttgaggtttatttatttattgagacgtagtcttgctctgtcacccaggctggagtgcagtggcacgatctcaccacagtacaatttccacctcccaggttcaagtggttctcctgcctcagtctccacagtagctgggaccacaggcgtgcgtcaccatgcccagctaatttttgtatttttagtagagacagggtttcatcatgttgtccaggcttgtctcgaactcctgacttcaggtgatctgccctcctcagcctcccaaagtgctgggattacaggcatgagtcgccattctggcccccttgaatttttttattggtttgtttttttggtgtgtgtgccttgttgagggaagaattgtgcctccttgactatttccctcaaatcctctagtttttaacgcatttgtctattgcctgaaataaatgcattctttttgaagacattctttgcggattccactcactgatgtcctcatggcttcctagacttgcagttgttaattttccttaaattcaaggctttgttctaccatgtgttggatgccacatctctttgcctgtgttttacattgattttttttgaaatatatttaatagtcttaagtgatttattctgattgaggctcactttctgagtcttacgtgtttgaaaatgtctttactatgattggtatgggtttctaggcttgaaataaatttttctttaaccttcaaaaatcttgctatattgttgcagatttgaaaaggcacatgctggtctgtgtttgttattaactgactcttttttcctttttgaaagctactagagtttctttctctttattcctcaatattctgcaataattattaatacaattatatagtaatttgacagtgagatgtctaaatgtgagtctttgctcatttattgagtttggtagtcagtgggtgtatcagtcaggttctcttcacacaaaaatcacacagatttgaacagggaaactttaaacaatcattgatttgtagcaggggattaactactaaaaggaaaagagagctgtaaagaatacaggaatggttggctgggcgtggtggctcatgcctataatcccgacactttgggaggaggccaaggtgggcagatcagttgagcccaggtgtttgagactagcctgggcaatatagtgaaaccctgtctctacgaaaaattaaaaagttagccgggcatggtggcacgcacctgtagtcccacgtactcaggaagctgaggtgggaggattgcttgagctcaggagtttgaggctgcagtgtgccatgatcacactccagcctaggcaacagagtgagaccctgcctcaaaaaaaaaaaaaaattaagaaagaatgtgagtgacacatacattgagcagcccctccctctagggctgaggcaagatcgagttcagaagtggctgcctctcgcgcacccccaaatctgaaattcagatctcagggcatggctccgtggcccattgaggcagcacagtctggggaggagctgcatgctagcccatgtgggataccgcctgctctggtgtttaaaaaactgctagaaaccacccacccactgggtgcctgcaagccttgctgggagccggctgggtgctgggggtactcactggatacctgctcacaggtttgctctactgaaccttgtgaggatgctgcctgctggggtgtctgccagacttaccgggaaccacctgcagggtgctgccgaaactcactggggtgacgcccctgggtattccacaggctgctagctactgcaggcacaagctggtgagagcataccccataggagaaaagtcgcttcctcctgcacgacttctccagcaccctcaaccagcaaagcttaacctgatgtcagctggcaaaggagagacattgaccacgtccagctcccgtaattcaaaggaaggcaaagaagggtatctgcagctgagaggtaacacatggataaacagcaaacatcttgaagtctaagcttgtcaccttagctctggggagttttcttgtacaggttaagcatccctaattcaaacatttgaaatgctctgaaatccgaaactttttgagtgccaacatgacacgacactcaaaggttatgctcattggagcacttagggtgtcagagttttggattagagatgctcagctggtaagtacaatgtaagtattccagaatccaaaaacgtctgaaatctgaaacacttctggtctcaagcattttggataaggggtactcaagctgtattatttctttgataatttcttccttttccccctgccccatatttttctgtggtttttagaactctgattggtcaaatgttaggcttcttcggttccttctctggctttttaatcttttcttcaattttttgtgtttttattcttttgctttgtgttctgggagacttccctaacattatctttgtactgttctattgaacttttcattgtgtaatcatcttttaaaattctttcggcaggttttttgtttgatttttttgttgttgttgagtttgtttttgttctattggctgttttgttttctttgctttttcttgtgtttttcgcagtagagcaaacctgtgaacagatctccagtgagctccagtgagctccacccacacccagcaggcttcccagcaaggcatgcacactgtatactttttatagcattctgcattgtttttcttttatatttgcatgttttatggttatattcatcttccagaaatgtcaaaatcttttgttttctttttcttttcttaaattttttgagacggagttgcccaggctggagtgtagtggcgcaatctcggctcactgcaacctctgcctcccaggttcaagcaattttcctgccttagccacccaagtagctgggattacaggcgcccgccaccacgcctggctaatttttgtatttttagtaaagacagggtttcaccatgttggccaggctggtcttgaactcctgacctcaggtgatccgcccacctcggcctcccaaagtgctgggattacaggcgtgagctaacgcacgtggccaaaatcttttgttttctgatgactgattattttctcttcgctgatgtaaatttgtacattttttttttttttttttttttgagatggagtctcactctgtctcccaggctggagtgcagtggcacaatatcggctcactgcaagctccgcctcccaggttcacgccattctcctgcctcagcctcccgagtagctgggactacaggcgccctccaccatgcctggctaattttttctattttttagtggagacggggtttcaccgtgttagccaggatggtctccatctcctgacctcgtgatccacctgcctcggcctcccaaagtgctgggattacaggcgtgagccaccgcgcatggcctgtacattttttttaaagttatttttaccatcattttagcaggccagactacatgagtttaaatcacaaccctgatacttactagccatgtgactgttctaagccttcattttctcatttatgaaatggggatgataatagtgacctaggttataaatcataagagtataaatgaaataatacacgaaaagtccttagcacagtgcctggcatatactcactgttttaaagatagcttcagctattattatttgtaaacataccacattattttaaactgattataatccatttaatcattattttaaaagcacttctagtctgtaaaatataatttctttggtcttattaattaccactgctactgctgtcactattaccactgctaccacagatatcttcaagcaagcagatgtaggaattaatagaaatttggtttaagggcaaattaatggcatacaatttggagacatttacttaggatacaaaatcaatatgcaaaaatcacaagcattcgaataaaccaacaatagacaagcagagagccaaatcatgaatgaactcccaatcacaattgctacaaagacaataaaatacctaggaatacagctaacaaggaatgtgaaggacctcttcaaggagaactacaaaccactgctcaaggaaataagagagtacacaaacaaatggaaaaactttccatcctcatggataagaagaatcaatatcgtgaaaatggccatactgcccaaagtaatttgtagattcaatgctattcccatcaaactaccactgacattcttcacagaattagatagaaactactttaatttttacatggaaccaaaaaagagcccgtataggcaagataatcctaagcaaaaagaacaaagctggagtcatcacctacctgacttcaagctatattacaatgcaacagtaaccaaaacagcatggtactggcaccaaagcagacatataaaccaatggaacagaacagagacctcagaaataataccacacatctacaaccatctgatcttcgacaaaccaaacaacaaaaaagcagtggggaaggattccctatttgttaaacagtgctgggaaaactggctagccatatgcagaaaacagaagctagaccccttccttacaccttatacaaagattaattcatgatggattgaagacttaaatataaaacccaaaactataaaaaccccagaagaaaacctaggaaataccattcaggacatagacatgggcaaagaacttcatgacaaaaacaccaaaagcaattgcaacagaaaccaatctaattaaactaaagagcttctgcacagcaaaagaaactatcatcagagtgaacaggcaacccacagaatgggagaaactttttgcaatctacccatctgacagaggtctaatatccaaaatctgcaaggaacttaaacaaatttacaaggaaaaaaaaatacccatcaaaatgtgggcaaaggatatgaacagacacttctcaaaagaagacatgtatgcagccaacaaacatatgaaaaaaagcttgacattactgatctgacatgcaaattaaaaccacaatgagataccatctcacaccagtcagcatggtgattattaaaaagtcaagaaacaacagatgctggagaggatgtggagaaataggaatgcttttacactgttggtgggaatgtaaattacttcaaccactgtggaagacagtatggtgattcctcaaggatctagaaccagaaataccatttgacccagcaatcccattactgagtatataccccaaggaatataaatcattctactataaagacacatgcacacacatgtttattgcagcactatttacaatagcaaagacatggaaccaacccaaatgcccgtcaatctacaggcatgagctgctatgcccagccaagtcgatttattaaaagtagctcagtatatacccaaaggaatataaatcaattattctattataaagaaacatgcacacatatgttcattgcagcactatttacaatagcaaagtcatggaatcagcctaaatgcccatcagtgatagcctggacaaagaaaatgtggcacatatacaccatggaatactatgcaggcataaaaaggaatgagatcatgtcctttgcagggacatggatgaagccagaagccatcgtcctcagcaaacttatgcaggaacagaaaaccaaacaccacatgttctcactcataagtaggagttgaacaaggagaacacatggacatagggaggggaacatgacacactggggcctttcgggggttgcgggtcaaggggagggaaagcattaggacaaatagctaatgcatacagggcttaaaacctagatgatgggttgataggcacagcaaaccaccatggcacacgtttacctatctaataaacctgcacattctgcacttgtatcccgaacttaaaaaaaaaaaagatttgaagtgggaagaacagtctatattctccctccgcctcctttctgtatggaccctgatggttacatggggccctccagaatatctaggatcatttcctcatctcaagatccttcaatttatcacatctacagaatctttgccgtgtcaggtaatattcacagtttccaggaattagaatgtggatatcttttggggatccattattcagccaaccacacacacctttatccttttgtccgtgaataaagttaatatttacattaactttggccatacccaaaatctctttgggaaagttgcaaattggaggagaaaatgaccccttgcatttttcctttaatttccaatatccagggataaagaacttccaatgctacttcaaggtttatattactatatttttaaaaattgtgaggctctcattcctagtctcattacatttcaaaggcattaataccctgctttaaaaatcagcaccaaatgtacatggtttagacagatccattgcgtacatctcaatctgttacataagcgagaagtaattttttaaattgcttctttaaatgtagtaggagttaaaggagttccctgttcccttccccaaccccctgaaaatccccaggactcctgagaggtgtctgcatgtcttttggtttgggagattaggtagggcttgagtcactctgagttgtccgctaggatggagggggcagtgacgttgaacaggtacctgaatggccaaggaggggtcaagtgtagaattcagtttcaccaataaatgatgatcgtggttgtgaatgaagggaacaatttgcggggggaaatgatcaaatgatcaataaactgagaaattaaattttaagcagaatttggtgaagaaattattgagacctactctacatgagaacccatgttagatgctttggaggattaaaaaagaagaggccagcactttgggaggctgaagtgggagaatcacttgaggccaggagttccagaccagcctgggcaatgtagtgagagcctatctctacagaaaaaaagagagagagagagaaagcgtgagaaagtcatttctgctagtgagagagacatggtataaacatttcaaaattatttgtaagacaacatattttgtggcacagtttggtgcatgctcagttcctcggtgaacacacatacacacacacacgacactgcaagtttagggagtggcgtgagctctacaacttggaaaacttatgagaaagcacagacgtggctgagggaggagtggttacgattttgagcatggtaggctgaggcgcccagcccactggagcaggaagtaccagtgaactaggatattaatgaacagttcaagaacccacctgaggctaggcacagtggctcatgcctgtaatcctagcactttgagaggccgaggcgggagaattatttgatgcccggaattcgagatcagcctggccaacatagggagagaccccatctctacaaaaaattaaaaaattagctggggtggtgtcatgtggctgtggtcctagctactcaggaggctggggttggaggatcacttgagcccaggagtttgaggctgaagtgagctgtgatcacaccagtgcaccccagcctgggcgactgatctagaccctgggctccttcccccaaaaaaacaagagcccacctgacagggactttggaggagagacttggcctttactattaactttccccaactgtttgtcagggccactgaggaatcccatttgggatgagaaacaccccacattgcagggcacggctacctgaaggcaatcctgagaatccccctggacgttggtgtctggatccttctgatgcctgcctgctggttccacgagtctgctggccccaggccaggccctttgtcggagcccccgccacaggggctgctggcgtgcatctggagaaccagctgacagaaggcctgtgttctattcccctccccttctctgcttcacttgccatgaatgagcagaacatgagtggaaaagagtgatgcatttggggtggaagatgcgattgtcaagagcagggtttctggcaccaggtggtggagaaggagaaaggcctgacatctctggagcagtggggggctggtctggggaaggggaagcgcagaaatgctcagcatctggcgtttcaccctcacggtgatccaggttaccctcaaatccagtgttaagagggaacgttaaataatgaacccagagaaactttaaaaacagcagagaaaaattatgaaaatggaggaataatcctgcatctgtttcaaggttagaattttgtttttgcttttacagaaactaagctctctcttttttctctattaaaaataaatgcctagatcctttcacattgcaccctcgcttacatggggccccttcacatttttgaactgtcttggacgagagcctaagatccaagatgcgttctttttttttacagcaaagtgaaaggaaataagactcattcatttaacgaatatttgtgaggcagcctgtgaagttgccttagaatctgggccaggtagtgagatcagtacgattctaccctttttctcctaaagtctgaagtcaaaggaggcaacttcaaaataaatgaaggtatctatgatgggctgagtgttgagagtttgcaccagggacagctcagagaacagctgcgtggggacaggaactatctgggtgagcagattgtccacagataattcaaagtcatcaaaggtcaaaggtctgtgagctgtgcttgtttagggattcattttcagtgtctctgtaataagttttgaactgatggctgttagggtttccaaaggacagaaccttgccttctttatgaaatggaataattttattgataatttctacatctgataaacctcgtgaacgtgtgatctgagctaacttcctgatactggctgcagctttgctcagtatccagggagtagctgagtgagctcagaaacacagagcccgtggctgctctgtgggtccatgcagttgttaatctcacgcagaacccagcggggaggtcagtgtggatggtttttgtcttagatccagtgagacatataaatgctgtaagaagactctggttgcactgttgaatgtggatttttttttctttgaatatttttttcttattttgatggaacatttattcaaaatgtagcacctcctctgtcctttatgaagttatagtatgggacagttcattgtgacacacttttaaagctctttacttttttttttttttttttttttttggagatggagtctcgctctattacccaggctggagtgcagtggtgtgacctcagctcactgcaatctccacctcccgggttcaagtgattctcctgcctcagcctcccgagtacctgggattacaggcacccgccaccacgcccggctaatttttgtttattttagtagaaatggggtttcaccgttttggccaggctggtctcgaactcctgacctcaggtgatccatctgcctcggcctcccaaagtgctgggattacaggcgtgagccaccgcgcccagcctatagctctttactttttaacatgccaccatatcttgtctgacatgagattattcatttagaaacattttatttggtcttccaaatacattagaatgtcagccacaaaagatagcttggggccttataattgaaccatttacttataagatttcaagtgtcaagttgcaataattttctgcaaaacataagtaactattttatgaatatgtatttgtgatgaatgatttcctacacaaatgaagaatctattttaatagaaaatggtaactggatatattactagatacaattttttttatttccctattttcagtttcaatagggaaaattaaaattttccctgttacttccttattttatttccctatttcaatgaatgaaatcataggcaactctaagtctcttgaggaaacttgggcgttatacatctctctcttctcccaaactcaaactagcttaagcaaaacatggaatttgttgacatgaataataggaaaatccaatgatgaagctggctgcagatggaactcaagagttttttgggtattggccttattctctcttggagtacaggggcctgagaggtggcccctggaagcttttccagcttcaacccaaaaagaaaaaagagagaccatctttcttctagtgctactaaatcaggtcttgtggaaggaatctctttggctgtggacagaggagtgggtctgtgcatggtctatttttgcagtgaggggtgggtggggtatggttataaggagagaggaagaatttccagatgaatagaggggtataatgcaggcaaaagccatacatgtccactgtaacacgcaaatatgatccatacctgtgtgcacacttcagccctgcatcagctcaaacacaggcggcagggctggagcgtggagaggaaggtggccctaccagctgggtctacagcttgtctccttccttctgagaacagtcaggtgagccttgaagcgatgggctaaggtgcagtgcttctcaagcttgtttttgttaatactcaaataaccaagaggactgaaatcgtgattgcaggtgggggtaggggtgccacaggtaactcctggctcacataaagaatggaaatagtggccaggcgcagtgactcacgcctgtaatcccagcactttgggaggccgaggcaggcggatcatgaggtcaggagattgagaccatcctggctaacacagtggtgaaaccccgtctctactaaaaatacaaaaaactagtcgggtgtggtggcgggcgcctgtagtcccagctactcaggaggctgaggcaggagaatggtgtgaacccgggaggcggagcttgcagtgagctgagatcgcactactgcactccaggctgggcgacagagcacatctccatctccaaaaaaaaaaaaaaaaaaaggaaatagtaagaatttcttctctgtgttataagctatgggaggggagtcaccgagcagtgtgcccaaaatttttcctgtgtgacattttcaggctgtagtgggtggaaagattttgtaaatgtatcttcttggtgagagggtgtcctctgaatctgctggtaggttggagtgtttgcagggaaatgttcatcaaagggcttgctctgtgaagaacgtgacttaggatgatctttattttacgtgcattccatcatatgtaaacaaagttagggtctcaacattcccactagcaccttcagccaactcccaagcttctgtctcagcaaagcgtttgctgtagaagcctacactttgaacccatccttattttaggtgaaatcatttatttcgtctatgtttttactctctagtgtgtcatatcttactttttcacttcttgaagaaaaaaaccaattctgtcctgagtttggaaacctttccttggtaagccagggcccatttgtgtagagtaagcttttcaaatcactttacagttccttccacatttgttgaaagggagagtttagaatacaaatcactgttcagtagccaactgtgttaccagcccatcaatgccctgaggacactgcatagcagacattctcccgctggtgccttcaggtgcccggaggcctgggcctgaactggccttccacactcttggctggagatgtggctccatctggcttcaccttcagtgcctcctaactcgtcagtaacactcagtaaagaattgagcagaacttactgaaaaagcaaaacgtctttgtgagtttttatggcttcagtgtgtcctgagctatctttaaaaatagagcaacttgggctgggcatggcggctcacacctgtaatcccagcacttttggaggccaaggagggtggatcatctgaggtcaggagttgaagaccagcctggccaacatggcgaaaccccatctctactaaaaaatacaaaaattagcctggtgtggtggtgcacgcctgtaatcccagctactcaggaggctgaggtgagagaattgcttgaacccagggaggcagaggttgcagtgagccaagatcgcaccactgcatttcagcctgggtgacagagcgagactccatctcaaaaaaacaaaacacaagcaaacaaaaagaggtggtcatggtgatgcatgccagtagttccagctacttgagaggctgaggcaagaggattgcttgaacccaggagttggaggcttcagtgagctatgatcacacactgcactctagcctgggcaacagagcaagaccctgtctctaaaaaaaataaaaaataacatacagcaaccaaacagcagttcagttattaaaatctgttcatgtattcagctattagacaaagacaaggaccgagttagatccagcctgtggaccagttgttccaatttgtctctgagcacactgaaatacagttttatagtgtcattcgatgagggtgctttatgcagcccgccggctcctttttgctggaaacaggtgtagtcacagccggagggagattcactgcagagtcaccagttgtgtagtttttccattcatcttgattctgaaaagagcttaaagacaactttaagcaattgttactttgtttgtatgcatctgcttcctaaggtctatacctagcgcctagacttctttttagatacaaaatgtgtgatttattttccttcaaaatttgcttctttttttttttttcctggagtaatatgactcatgcagcagggttttattttattttatttttatttttattttttttagattataaaaacttcctctttaatcaaggcttttaacatgaacagatttcttgaataaaatggaaagtttccagtacactgaaacataaatccacaagtcaccatacatacaacacccggcaggaaaaaacaaaaacagcaagtttacatgatccctgtaacagccatggtctcaaactcagatgcttcctccatctgccaagtgtgttctggatacagagcacatcgtggcttctggggtcacactcagcttaggctgtgggtccacagagcactcatctggctgggctatggtggaggtggctctactcaagaagcaaagcagttaccagcacattcaaacagtgtattgaacatcttttaaatatcaaagtgagaaacaagaaggcaacataataatgttatcagaaagatgttaggaagtaaggacagctgtgtaaagcttgaggctgaaaagtagcttgccagcttcatttctttggtttcttgggtagtgggcgccggaacagcaagatgtgaggttctggttcatggatcatataatggacccatccctgactctgctgaacgccaagattcctccattcagattcagacatcagatgggttttagggaccagcttggctatgtccttgggcagcatgacatgtcgatactcaaactccttgtcatcgtatttgtccgaatagtaaatttgtttgtgcgacataaatgatttaacttttattctgaaaagcctcctgaatatttatatccctagaacgatacataagaattgatcatctttccttatgggaggacttttttttgttgttgttgttgttttctttttaattttattttttttttaattgatcattcttgggtgtttctcacagagggggatttggcagggtcataggacactagtggagggaaggtcagcagacaaacaagtgaacaaaggtctctggttttcctaggcagagtgtttgtgtccctgggtacttgagattagggagtggtgatgactcttaaggagcctgctgccttcaagcatctgtttaacaaagcacatcttgcaccgcccttaatccatttaaccctgagtggacacagcacatgtttcagagagcacggggttgggggtaaggttatagattaacagcatcccaaggcagaagaattttcttagtacagaacaaaatggagtctcccatgtctacttctttccacacagacacagtaacaatctgatctctcttttccccacatttcccccttttctattcgacaaaaccggcatcgtcatcatggcccgttctcaatgagctgttgggtacacctaccagacggggtggcagccgggcagaggggctcctcacttcccagacggggcggccgggcagaggcgcccctcacctcccagatggggcagctggccgggcgggggctgccccccacctccctcccagacggggcggctgccgggcggagacgctcctcacttcccagactgggcggctgcagggcagaggggctcctcacttcccagacggggcagctgccgggcggaggggctcctcacttctcagacggggtggccgggcagagacgctcctcacctcccagacggggtggcggtcgggcagagacactcctcagttcccagacggggtcgcggccagacagaggtgctcctcatatcccagacggggcggcggggcggcggggcagcggcgctccccacatctcagacgatgggcggcagggcagagacgctcctcacttcctagatgggatggcggccgggaagaggtgctcctcacttccccgactgggctgccaggcagaggggctcctcacatctcagacgatggacggccaggcagagacgctcctcacttcccagacggggtggcggctgggcagaggctgcaatctcagcactttgggaggccaaggcaggcagctgggaggtggaggttgtagcgagccgagatcacgccactgcactccagccccggcaagactgagcactgagtgagcgagactccgtctgcactcccggcacctctggaggccgaagcgggcagatcactcgcggtcgggagctggagaccagctcggccaacacggcgaaacccgtctctgccaaaaaatacgaaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15194 - DNA, 8942 bp, Human
ctttagcatttcttttaagatgggcctcatggtggtgaattctctcagcttttgtttatctgggaaagactttatcttgctttgatggttgaaggatagctttgctggatacagtattcttgtgtggcagacatttttttctttcaacactgaaaatttcatcccatttgctcctggcctgtatggtttctgttgagaagtctgttgccagatgaattggaatttatgttatttgcttcttttctcttgctgcttttaggaccctttctttgtccttgccctttgagagttcgactatgcctacgggtagtcttatctgggtcgaatctgtttagtgttctctgacctgcatacctggatatttatatctttcttaagttttgggaaaaaaattttattatttctttgaataagctttctaccccttgctgttgctcaactttttcttgaacactagttattcttcgatttggtcttttgagataattttctatatcttgtaagtgatcttcattctttttcattcttttttcttttctccccctcactgtgtaatttcaaatggcctgtctttgagctcactgactttttcttctccttgatccattctgtggttcatctaatttttttttagttcagcaaatatatttctcagtaatgagaattttgcttttttaaaattattttaatctgttaaatttctctgataaacttatagattgcttgtctgtgttatcttgggggttactgagtttccttaaaactgctattttgaattcttggtcagagagctcacatatcaccattttcttagattcagacacttgttccttgctttattcatttggggaggtcatggttccctattgctgttgtttttcttgtggatgtacgtccatatctttgcattgaaggattatttattccagtcttctctgtcttgattgttttgttttctgtcggggatgtttgcttagagattctttgtgacttatctgttaaatttcttattttcccactaggtcactgtctcccttttggaacttgatggcaccttaagcccaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcggtaatgtttttccctcaaggtactcatgatacttcccatggggtgagtcagggacaggtctctttccagggaatccaggatggtagggaggttggttgtctaccttgatctcactttttccattgtagaaactgtgagttggggaaagttttccacacacttggtgctggacagattgtggcaaggggcaccacagatataaaaatctgattcttttaccatgctcagagttttttcacttctgtgtccccaggaattgactcatcctcatatctgagttctgggatattgttggtgataatctcagtgctgtatatttgtttttggttttctggtgtggaagtgaagccagcttgcgtctacactgccatttttgaactagaagtccacctgatgccatgtgggtctgctctaacaaagatgcctgtagctgtctctgtaggtacaattggagctactacctcataaagtttgtggtagcccactatctggtttttggaggggctagactggtaaattaaatggagatacaatttgaaccatcatccccgaatcttttaggtcttttaggatggcattaatttctgccattccctgaaatattattttttgatttactgtattggtatggagaagaggtcaatttttaaagcttccacctggccacttggcctttatcactatgttagctcttaccacacacaccgagaaacctggtgccactaatcaagtgtatttatcacaattatacactcaaggactaggtgggtctgtggatatattgtgagccagacttgggccaggacaccctaggacttggcctccataacccttactctaatcaagggcatatagtgagagttctgtgatatcattgttaactcagaccctgtttccaacagatatcaaaatgttgagtattcccctttcaccactgtatgatttcctgagtaatggtgataggtccctttggagaaggactagaggaatcattattgtgcacacttgtggtattacacaatccttcctcctggggacccagattcttctttagttaatgggcctggatccaaaaacggactcaggtctggaaatcggacaaggggtcatgattattttttatttttatttatttatttatttatttatttttgagacagagtctccctctttagcccaggctggagtgcagtggcacaatctctactcatggcaacctccatctcctgggttcaagcaattcttttgcctcagcctcccgagtaactggattacaggcgcgcaccaccttgcccggctaatgtttgtatttttagtagagacagggtttcaccatgttggccaggctggtcttgaactactggcctcagggaatccaccctcctcggccttccaaagtactaaatttatagtcatgagccactgcaccccgccagtttaacttttttttaattggcttagttgccaagagaggaagttggggaggatcctgaggagtgtatgttttgtccttggagagagagctcattgtcttcaagcaaaagagggagcacactagcccttattagagaagagaggggcacttctgtagccttagaaggttctggaaacctgaggattgaagatttttcaggtgcatcaacccagatggtttcatcccatgtgtcagggttccattttttcccaatcagggtcctgacaacagcacagtagacctgcctagcttgggtcctaacttctttggagttttattctcatgactaagtcctgggcctggtcctcagcttcctctcctcattggcttgagaacctgagagtctcatattctacgagggaggctttctggccctcacactgagtttttgtttgtttttgagacaagatcttgctttgtcactaaggctgagtgtgtagttgcacccaggctgggagtgcagtggcacagtaagctactgtaaccttgaactcctggacccaaattatcctctggcctcagcctcttgagtaacagaacaacaaatgcatgccactatgccctgctgattttaaatttttgtggagatgggccttgctatgttgcccaggctggtcttgaattcctggcctcaagctatcctcccttttcagtcttctgaggcactggaattacaggcatgagccacggctcttggtcccacactcagcttctaattaccaactaatcactctcattcttttattttgagacagggtctcattctgtagctcaagctggagtacagtagtgcaaatatagctcactgcagcctcaaactcctggggtcaggtgatcttcttgcctcagcttcccaaatagctaggactacagccacaagctactgggcatggataattttttaaatatttgtagagacagggtctcgctatgttgcccaggctggtctcaaactcctggctcagcctcccaaagtgctgggattacaagtgtgagccactatgcctggcccattctcattcttctgttatctttttccaaggtatcggtctagctcagtaataactcttcagttccactgtctacactgtttcccacctgatcttcgtgcctgccggtgcatttctttgtgttgacatgccatctcagttcaccactagtcaaagttttaataactgcactgtcagggtgtgctagcagttaacttctccctgccccagtgaggagactctcatcctataagtgagaaggcaagagaaatggctccaaaagcacactggagcacctactttcctgcaacccttctgataccaagtatcacagatgctgagatgaagattagtgggtaggagatttggattgccacctgtggaaagaaaggaaactccactgggtggaggaagaatatggactatgatgcaatctcaaaggtggccttagctgacactaaggggaactctgaagctaggatggtctttcagattgttctaatatggggcaatgggactagtctttgcatgcagcctggcccaagaaggaagtgtgacttcagatgaggtggctcttttcacttaagagggcaattctactgacagctgagggccgttgggtgcacactgccagagcgagaaaacaaaatcctctgtagggaaggggactgtgtggcatatcacagcacaccccgagaacaagggagcggctcttcatcaaataacacaatatgggcccacatattcccagaggctgctatagtgctgggcacattagtgctcaataacttattgaattagtattatcatattgtgctattgccatcctcatcttttaaagtcacttatcacttaatggatgttcttgttagaactgacactatgaagatgactatgacacaattacctgttgagcctatttgagaaattaacctatatttaacaagtttgactaattagattggttaagagccttagcagagggctaaacaaaatggtgttaaagaatacacctgatggtccaagaaaatccctaactccctagaaggtctggatagtctgagaagtgacattcgaacagtgtaatgcactttcctccagagccagaagcagggaaagcagaggcagcagcaattttatcttctgggcaccttatcctcagacctcattttatcaatacatacggactgtctacaaccacgtaatatccttttcatcagccttatgaaattttcccccaatttatccaagtcaggatttcagtatgcagaagtctaatgtcatcttggagagttcattgtgcctcccccatatccaagaccatttactaaaaccttagttcagtctttaaagagtcacaagatcctattatgcctagttttttttccagtcttttaagtctattccttaccttgccaaaaaagtacctgtttctatggtttaacaaatggagcttagaatatggaactatggtaagtgctctttagaatttaaaataagttacatgtactggttttcctttattttgtagttttgttctcaaagaattccagatatgatttttttccagacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggtaaggttaaaatctgttcattagacttatttcctaaccttttaatcactcatcactttggaacattcttgcaactgaactgaataagctgggaaggttttttgggtaattctactaacgctttttttttttttttttttttttttttttgagacagggtctcactctgtcacccaggctggagtgcagtgctgtgatcctagctcactgcagctttgatcttctgggcccaagcaatcctcccacctcagcctcctgagtagctgggactcaaagtgtgccaccacacctgattttctttttggtagagatggggactcactatgttgcccaggctggtctcaaacttttggcctcaagggatcctcccaccttggcctccgaaagagttgggattataggcatgagccaacatgcatggtcaaatgctttttaaactagtaattcacctgtgtatggttatgtcaaagaaaaatacaaggttgcatacgcttagagaaagtaaggaagtaacccattacatgtatgtttgtaaattttacttaggccatcattttttattttcacctttgaatttcaaagtaaattagagatatgtaaataacagaattatcaacattaaaatcttattcacaatggctaacaagaacaggatgacagtcaagtcagtagctttttaataaaatgagcagaatcccatcgtaacagttctttgttacatgaattcaaatacacagcagaccaatcatgttccctgaaatttaacaatcaatcatacttaataaaggcctgttagtgctgtccctcaagactctaattctaaagggcttcctttgaattccctttataaagctttgtgcaaagaagagcttaagcaccagtaagaaagactgtcgctagcatttttatttcatcatcaacaacaaacatgcagtttctttctctgatgtgcatggcactgtaaaatgggtgctacactctctcttgtggtacaaagtttataaatacagtatactgatacaaagttgaagccattaaaaagagcttaataacaactatgaggagataattaaatctggagtgttgatggaatctatgaagagatttagaaacaagacataaacactacggtaaaagttttacttgggaaggggccagaggggaactttttatgtgctactgaaagattttttaagttgctccagatttactttctttctgctattatctttaaatactgcaaagcattgtgagctgcatcactttgtgcattgccacaggagataccggagccatgacagactgtgatggggctggtggacagttcagcaagacattgatattgtccattggcgctcagttcatctgtaatgacacattcaaggatgacgattaatgtccaatatgtataaagtggatccctttgtaaaaacaatacaattcttattattgtctttctttttaagcctccatggtatactacaccactcgcaatctttgttttgcttgtacaaacaaaaaaccacaactgctcagctgtagcagttttcaaacacattacacttcataatgatctgacagtgttaaagacatacagatatctaggctgcactctagctcactcaatcagaaatatacagttgggggtggctgattcctacacttaaaaaaataacagctcccaaggcaattctaatatagttagttgaacactatttggaaattactgaaccacacagtaactttctcaaaagggaaagaaccatttgctagaggactggagagattgtattttccactaggaagtcattttcaggaggcatttgaaccaggaataacttcggtcaaggcaaaacctcccttgtgtcttctattaaaaaaaaatgtttaattgatacataataattgtatgtatttatgctgttgtccattcatgttcctaggttttaagtctgtgcagagtctagttctttatttatactgtaaatgggtcatggtattttaaaaacaatacctgacccaggaaacaaacgttcttcccatcaactgatgagccactcttactaaagatggctgaaatgagggcaaagaggaagaaatagaaacgtgtgcggtatgatttatttgaagtaggcataataaaaatgttatttttgatactctatttagtggaaaatatccagatacaatgggattatttaatgagtaaagaggctttctagttctagtatctaggttcttttctcctgaccctccagcttctgcttgaggctcatccatgttgtagaatgtatcagaacttcgtttctttttacagctgaataatatttcattggaaggacagtccacaatttgtttatccacttattcactgatggatgttttgggctgtttctaccttttggcttttgtgaatggtgctgctatgaatatacagatacctgtgtgtataggcatttgtttaaataccagttttttatttatactcctaggagtggagttgctgggtcatatggcaattcatttgaggaactgagaagcttattccatggaggctgaactgttttatattcccaccagcaacgtgtaaggttccagtttatctacatcatcaccaacacttgctattttccatttcattaatgatagccatcctagtggatttgaagtggtaccttattatcgtggttttgattgcattctctattgactaatgatatcgagcatcttttcatgtattttttggtcatttggtcatttttcttttttaattttaaaattttgagacaggctctcactatgttgcccaggtggtctcaaactcctgggttccagcgatgctcatgcctcagtctcccaaaggggtgggattacaggtgtgagccactttgcccagcccatttgtatatctcctttggagaatatctaggttcttttgaaggtagctgcatataaactagccaaattaacagactgtggtttttagatggctttccatatctacaagaactatttagttctcaaaactgggaagaaatgtttcagaggcatcattaattcataatctaaaaatttatcttgggtttccttttttcccccagattctgtatcctccatagtcctattcatgacatgggtcgttcatctctgtattctaaaccctcaatgaactgtagacagtaataaatatttattggatgaatggtctctcatcagccaccttttctttttttttttttgagacagagtctcactctgtcactcaggctggagtgcagtggcgcgatctcggttcactgcaacctctgcctcccgggttcaagtgattctcccacctgagcctcccgagtagctgggattacaggtgcacgccaccttgtctggctaatttttgta

SEQ ID NO: 15195 - DNA, 4843 bp, Human
agctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccaggtgggctctaggggagggtggcagcgctgcacagtggctggagtcagggccttggtacctggagtcccgggttcaagtcttgtctcttgcacctgcttgcccctacgaccttgggcaagtcaccccctctgagttcgttttctgcttaacgaattgggacgtgccttcccacctaccccgcaggactgtggtgagattcagaaatgggactttgcccaggttggcccagtgcttactctcaccctccttttcttccctgcagcaggccaaggagctgatcaataagtgagtaggcatagcgggaagggaaaggagggggctgcactgctccactggctggggtggggcttgagagtgctggggcattgccagctgagtccgtgtggccactgcagggtcggggccatgtcgaaggtggagctggcagggcggccggagccaggctatgagagcatggagcaattcaccgtaagggtggagcacgtggccgaaatgctgcggaccatcgacttccagccaggtgaaggaggtggccgagggccgctgagacgggttcggaccctctgtgtggggggtgcggcgggcacgatggccgtaaaggcagggactccacctcaccaggccttccttgggctcaggcgcttccggggaggaagaggaggtggccccagacggagaggagggcagcgcggggccggaggaagagcggccggatgggccttaaggtgagagccgcccgatgggccttaaggtgagagcggcctgaggggcttggggtggggcctggctggtgtgctcgcgtcccctcccccagtgattgccctccctgcgggtagcgtggagcccccactcctcggtgcaacccaaccccggagccacaaaggcgcgccccctagggcggaaaagtacactttcctcctcacccgctgttcctctggggtgctgggagggcaggcaaggcaggctgagtagaggagaaacccacgtggcgggggacggagtgagcggggctcgagctgcctcgtgccttcgcagcacccgcccaccgagccttctttcccgggcacaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagacagtgccctggtggctctgccccgcatcccaactctggggtgggggaaaggggtcaacgttttcgcagccccaaaccgggccatcacttgcccaccgagtcgaatatgatgcggttctgctcggcgcgctcccgctggctctgcgtccgcgccagctccagcagggtccgcagcaggtgaaaggtgaggtcaatggacagagaagggttgtcccgccgcggccgctcgcctgccgtcccgagtcccaatcggccgggccccgcgcggcgcgggaagcgctccgccagcagcaagaggagcgcgcgggccccgccaccctggttccgtgccccggggctccagcgcagactcgggtcctggaccccggccgcctcggggctcctctggctgctcccagggcacagctgtaccaggagcagcagcgcggccagcagcgctgcgcgtcccgcctgcctcatggtgccgccggccctggacacacaggggcagcgcagggtgaggtgcgcctgggacagctgcaggccgccgctcccctccccgcgctcgcccggcgacccctccggccgccgcccaatgcccgcagcctgccctccagccccagccactgcgccagtgctgttccatcccttccacccagcctccctccccggaggagcgtggtggctgagctgagcggagtcctggtgcagggggaggctgggcggacgctctgagccactcacaggttgtcggcgagcgtctgtacggtccaagattgagctccagtctctgtccctcggggcaggctgaagacgccttggggaacacagggtctgtcccggggctgtcgccagccttatatagtgccaggacagctccgactgacgtcagcgaagaacatgcactgattgtagaagcaatgacagccacagcttcgagtctgacggctggcgggcccccggaggggcgcacctccctacaccagccttcgtgcccctggggctagcgctggaagcagcactggacgcaggaaagcgagaagccggctggggcgtaaagactgctctgggacccacgggagtccctcgccccgcttagaacagccagcaatgactagggccgtccccagaccagactagtccgggtcgcgtgttctgacacacgaaagggaggcgggaccgtgaggctgtccatggtgctgaccccgtcctctgcctctagaagtggccagaaatgtgagaacgctgtgccgctggaacccactgcctccctgcagctatcagttctgcaaatgcaggcatcaggagtccaccgctggcactcagccaacacagtgggacccactgagaggcagtctgccacaaccaaagtctcccagcattcttatctttttccagccccaggatccaaattgtagggctgtctgacaggcaccatgtaacagagggtctctagcatccgagtgctttcagaccacaaatggctggcccatctgcttttgagtttgccaaagtagtttagcaaagttcagtttctctcctgggaatcatagcagcagtgtaactctgcccatgagcagcaaagaaatatgggttcaagtttctgctaactcctggtgtggacaggtcacctccctcctaccaacctcagggtcctcatttgtaagactgggcttggccaggcgcggtggctcacgcctgtaatcccaacactttgggaggccgaggcaggcggatcacgaggtcagtagtttgaaaccagcctggccaatatggcgaaaccccatctctactaaaaatacaaaaattagccgggcgtggcggtatgcgcctgtggtcccagctactcaggaggctgaggcaggagaactgcttgaacccaggaggcggaagctgcagtgaggcaagatcgcgccactgcactccagcctgggagacagagcaagaccctgtctcaaaaaaaaaaaaaaaaaaaaaaaaaaaaattgggcttggtggtctcttggcttctttccagctctagaaatgactccccaatagttttctgcttaaaaacttactcattaccactgcagattccggattacatatttaataacatatttactgaggcaccatataaagggttccgggagtctctaaagagctggagctacaagaagcctaggcagggttagagtaacaaatgtgtctatgaagagtggggatgagtggcatttgctgggatatgggtgtaaagttgataaggtcatgaaggttcaacagatatttatggagtgcctagtatgtggtgggaataagactattatcaagggctctaaagcagtcagtgtacattttagagtgaagaggggcattgcagggtgctagtcctcttaagctctgaccggcaacccaaccccgtggaaactggtatgcccactttgaggaggttgtctgaccgttccagggtcaagctgcatcactgcaaggtggaaacgatggagtgaggcaggcttagagccgatgtgccttccaggacaggtaggagttccagataacagcaacacattggacaacggccaacctaaggaacaggaataacacaatgaagaggaggaaggctaagcagtgagcaagggctggagatgggagcatgaaatggcaaaggagggatcatgacaaaggattggcaggtttaggtctctttccttcagcaccttttttttgagatggagtctcctctgttgcccaggctggagtgcagtagcacaatcttggctcactgcctcccgggttcaatcaattctcgtgcctcagcctcccaagtagctgggactacaggtgtgctccaccacacctggctaatttttgtatttttaggagagacagggtttcaccatgttggccaggctggtctcgaactcctgacctcaagtgagccacccacctcggcctcccaaagtgctgggattacaggtgtgagccacgacacccagccctttcagcaccctatgaagggcctgtgtggcttgcactaaaggacaactggctcaaattctagtgccatcccagagctctgtttcctggctgagagcctcaaaggctaaa

SEQ ID NO: 15196 - DNA, 16225 bp, Human; identical to SEQ ID NO: 15152

SEQ ID NO: 15197 - DNA, 40617 bp, Human
acctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagcccagcccctcccccagagcccaggctcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcagacccccgtcactcttcaaactgttacttgtgggggtggaggaacacagccatagggaaatatctgcttgttagtgacactgggttttaagccttgattctatcccttcataagtgaatcgtcttgaggagctgagtttgctgtgagagccctcctcacgcacctcgattcctcccccaaaggctgctacaggagagataatgtcacagcagcagggccaagtcctaagaaaatcagcacctgctgcaggagctggtgtttacaatagtcccatctactgtgaaacctgggctaacaaggaagaggatggtgctaacatggtcagccctgggggcctcactctctgttatgagaactgcatttgagtatgggccctggagacagacctcagttcaagtcccagctccaccatgtactagctgcaaggccctgggcagctcttagtcgtcacctacggaaaaataaaacatgggacagggaaggaagaacagggcctctgtgaaaggatctggttccagcacacagtgacctgctccaaaataactcggttttttgggtctggcgccgtggcttacgcctgtaatcccagcactttgggaggccgaggcaggcggatccgaggtcaggagatcgagaccatcctggctaacacggtgaaaccccgtctctaccaaaaaatacaaaaaattagccaggcgtggtggcgggcgcctgtagtcccggctactccggaagctgaggcaggagaatggcacgaacccgggaggcggagcttgcagtgagccgagatggcaccactgcaccccagcctgggcaacagagcgagactccgtctcaaaaaaaaaagaaaaagaaaaaacaaacaacttggtttttctcattcgggcaacactaataaaactatttcctcaataaagttgtgcacgtcacgctgaagagccatgtggggtgtgtggaagattgcaagggtggaaagaatgctcctggtgatgggctgggaacaacgggcaacagcccaggggacccccagagggttaacgggtccaggtgctgacagctgtcaccatcaagtgccacggggattgggaaaatacttcttttctaggtgcctcagtaagaatttgactctgtcaaaacctaaatttgtagtgccttacactagaaatcacattaaatccgcataactcttttaataaataaagcatattcatggcttagattttaaatcacatttacagatgagggaaaacttctaggcctaaacaggtaacagtaaagcgactactgctggaaggagtggtgtgccacatgcgccttaagcctcaagagtggggactgcagggccaaacaccaaatacatcacctttaggccagacggagagtggagacccaggaagcccatgcaaccaccatctgccccctcccctagtgctgcagaaccggctggacactgtcacactttcagaagaactggaggtgggtcctgatcatattacatgaagctttccaccattgtgaacaattaggcaaggcatgagtgacagaggggcatcgctgataaatacagagcaatactggggcagtgaagaggaagctacagagacattcgtgtttcttcaaatatcagaagcttccacatcacagcaggagagctgacgacgagctccacctcctgaaggcttagtccaaaaacttcctgttggcatttgcaccaaacaaggctccccggacttctggcatcatctgtggagagaaagtgtaataaatacgcaatgtcagctgaagaagttgtagagcgctgcacatcttttttttttttttttttttgagacggagtctcgctctgtcgcccaggctggagtgcagtggcgcatctccgctcattgcaagctcacgccattctcctgcctcagcctcccaagtagatgggactacaggtgcttgccaccatgcctggctaatttttttgtatttttagtagagacggggtttcaccatgttagccgggatggtctcgatctcctgacctcgtgatccacccgcctcggcctcccacagtgctgggattacaggcgtgagccaccaagcctggccagagtgctgcacatcttaaccacaggtggaaagccatgaacctctatgtggctgggaaggactcacaaagccacgcacatcaaagccaccctctccttccctgaagcaagtaacacattccttggtgagaaacttaactcatcccaaatctggggttcagactgcttacaaaagggacacattaaaaaaaaacaaaacaaaaaaaaacctaaagtcactactatctcagacttaactcatcataatcatctcaccacaatatgctgggtcacctacactctttcttcaacaaacatttactgagtgcctactatggccacagcagctgcaaagaacacttccaatgccagcttaggctggaagcacttgctacagccactgatgaatccttaggagaacttaaccctggacttccaaggctcggctgtccaacagggcagtcctagctacagatggttattgtgtgctgagaaactgaatttttcggtttaattaaatatccgtaagtgagtagtggctatgatactggatgggacagtggctactaggaaacaatgttctgaggtttaagttaccagaatatgaaaaaatcaaggtgaaagtgctttagttataagacaagtatctgcataaacagtaaactgcatatctaggtcagggaataactaggttggcagccacagcaatagactcccactagaagtctagaagatgcccagcattttagaacaaatggaattttcctggcttgtttcctagagttcctgtgtacaaatctggaaacatctgaaaagccagcagctttatgataattcctttaaataagtatttgtgtctgagcacggtggctcacacctgtaatcccagcactttgggaggccaaggcgggtggatcacctgaggtcaggaatttgataacagcctggccaacatggtgaaaccccgtctctactaaaaatacaaaattagccgggtgtggtggcaggtgcctgtaatcccagctactcgggaggctgaagcaggagaatcgcttgaacctgggaggtggaagttgcagtgagccaagactgcactccagcctgcgcaaaaaagagtgaaactccatctcaaaaaagcaaaacaaaacaaaaaaacacaagtatttgctttagttcccatcactcctgttagagaaagaacttgtcagcaccttacatgtagtaaaatgtacatattcgaatcctaggtcaacaaaacacttgttctgaccccaaattcaccctcatgtaaatgttaccacctcagcaaatgctactacatgcccaattctcattctttttgagaaaatgtccaaaactggaaagacagcaacaaatcccaaataccagtgaatggacacgtgttctctgtcccacttcaaagtaacagcagaccaactaccaagaagtacccccacactcacctgctgggctatgagatccagccggctttccagggtgttggaaacctttattttacgatctccattatagatctcaactccaccagctctgcaaaaaaaaaagcacaggaaataatcattttcaaagacttgagaaagatacatggtaccctttactcccgcagaggaatgcccttgtcttggtgtgtagactgcgcaacctaagcaacaggcttgaaaggaactgaaaaagcttctgaagatgtaacgcacagttggtttcaggaaaccccagtccccgcctagatgtccattatatgaaacagcgtagtatttgcatacaaccatcacacatcctcccctatattgcaaatcatgtctacagcacttaaaatagctaatacgatgtaaatggttgttataccgtagtgtttagggagtgaaaagaaaaagttggttgaattcacaggtgtggaccccaaagatacagagaactgactgtattcatctcaataactgtcatttaccaagtgacactatgtgtcaatttgttttgttttttttgagactcgctctgttgcccaggcaggagtgcaatggtgcgatcttggctcactgcaacctctgcctcccgagttcaagcaattctcctgcgtcagcctccccagtagctgggattacaggcacctgccatcacgcctggctaatttttgtattgttgtagagacggggtttcaccatgttggccaggctggtcttgaactcctgacctcaggtgatccgcccacctctgcctccacaagtgttgggattacaggagtgagtcaccgcgcccagcctgtgtcaatttgattttatgttacaaaacctgttttaattatcacagccagccctccccaacaaaatgaaaaagagaggatttcatctcagtttgcaaatcactcaatcctcatctgaatgttttcttaagcccaatcctgctcattactgatgaggccctatcacgactgcatgtgtgtctgataaaagatgccactgctggccgggcgtggtagctcacccctgtaatcccagcactttgggaggccgaggtgctcccaaactcaagtttgaggccagcctggccaacatggcgaaagcctgtctccactaaaaatacaaaaattagctgggcatggtggggcgtgcctgtagtcccagctacttgagagactgaggcaggagaattgcttgaacccaggaggcagaggttgcagcaagccgagatcacaccactgcactccagcttgggtgacagaaagagacccttactcaaaatacaacaacaacaacaaaaaaagaggctgggtgcggtggctcacgcctgtaatcccagctctttgagaggccgaggtgggcagatcacgacatcaggagattgagacaatcctggctaacatggtgaaaccccgtctctactaaaaatacaaaaaaaattagcgaggcatggtggcgggtgcctgtagtcccagctaatcgggaggctaaggcaggagaatggtgtgaacctgggaggtggagcttgcagtgagccgaggtcgtgccactgcactccagcctgggtgagagtgagactctgtctcaaaaaataaataaataaataaataagataaaaaatgctatgaggttagtgctaatacgtcaatttacagataagggaatcagggctcactactatggtttgagtctgttccctcagaaactaatggtgaaatttgattctcaatgtggcagtgttgggaggtggagcatagtaggaggtgttcagggctcaagggcagatcccgaggcaatgaactgtggcgagggcctggattctagctccggcaggactcgactgtgagcagagggtgggctggtatgatagggagtctggttccctaggctctctggcctcctctctcgccatgtggtctctatgcacacacccactccccttccaccttctgccatgagtggaagcagcctgaggccctcaccagatgcagctgtccaatcttgaactttccagccatgagaatcatgaaccaaataaacctcttttctccatgaattacccagcctcgggtattctgttatagcaacactaaatggacgacaccactcaatgaaactgaataaacgagtccaagattacccaggtagtaagtggcagaatcaggaatctaacccaactctgacagcatatcttatgagtttatatactttttccatttacagagcattttcacatgtactatctcatctttttttcttcactgcatgaaacaaaaaagcaaaaagcaatgatcctattttacatatgatgaattcagtctccaggtcccatagtagcaaaaggccaagataggactcaaatctaggtcttacattcctaagtgtgataatcagctaacttcaaaatgtgtccaaggcaccaggcatggtggctcacgcctgtaatcccagcactttgggaggccgagcgggcagatcacgaggtcaggagatcgagaccatcctggctaacacagtgaaaccccatctctactaaaaatacaaaaaaattagctgggcgtggtggcaggcgcctgtagtcccagctactcaggaggctaaggcaggaaaatcgcttgaacctgggaggcagaggttgcagtgagccaagatcatgccactgtactccagcctgggtgacagagtgagactgcctgtcttaaaaaaaaaaaaaaagtgtccaaggtactttcttcaatgttagtcagtagtgtggctaggtggcctcagacaggccagtgaaatcgagaaaatgacactggctctccccttgtcaggagtttctactgcctaccccagctacacaaagcttgttaggaacactgatcccagaaatgttctgtcatttcctcacagtcataaaaataccactcatacttgcaattctatctctaaggaacctaactaccaggcatacacaattcttgttttgataactattacttagaagaagggagtatctacctcagcatccaatacagagatctggtcctagctttcattctgggggccacctccccgcagaaggaaagcagtgaccataaaccagacttttttttttctgagatgcagtcttgctctgtcgccatactggagtccagtgagtggcgtgttcttggctcgctacaacctccacctcctggattcaagcaattctcctgcctcagcctcctgggtagctgggactacaggcgtgcgccaccacgctcagctaatttttgtatttttagtagagacaggactggactatgagcagagggtggactggtatgatagggagtctagctccctaggccatgttggtaaggatggtctcgatctcttgaccttgtgatccacctgcctcagcctcccaaagtgttgggattacaggcgtgagccaccgcacctggccaaactagacttttagagtatatttagccagccaacaagggagagcaagagagcactgcgagaacaacaggaacggctgcaagtagaatacaccacagctctagccttgtgtctaagagtgcgtttaaatggtgaaaataccatttaaaaaaggcctggtataaaggccactctcccagggagagaaggtagctgttagcagcaggaatactccttacatgtcttcaggcaggtaggactcctggtcaatttggacatcaacatcgtttttggtggcaattttgtacataggaattgccttctgcactgcagcctggaagtatagaacacaatgagaggtgtcactaggaactatgaagcaagtatccaaaaactcaacagactatacaagcaaggatacctccatttatcccaggtaaaagaacagaggcaccgctggtgggaatgtaaaacggcacggccactgaggagaaatgacagtctgcacacaggagggaagagatgcgaatggtttctgtcaagatttaacagggcttggcaggtgattaaacacaccagaggcagttattacatttgaaacatggatcagcaggaggaagatacattattcccccagctgagagtgttagaagctgggggtaggtaaggagagaagggagggaagagaagtttggctgctggcatgagcttcaactggcagttgcagatgagggggagacagcaggcaccagaaacagcagtgccatgccatacccataaggatggttcttatcaaagtaacagtataataggtcctcaaaaaatgaagtacacaattaccacatgatccagcaattctacttctgggtatacagacaaacggatagaaagcaggacagatatccgtatacccatgtttgcagcagcattattcacaacagccaaaaggtgggagtaacccaagtgtccagtgacagatgaacggataaacacaacgtggggcatccataccgtggaatattattcagccttacaaaggaaggccattctgacccaccctacagggaccttgaaggcattatgctaagtgaaatgaaacagtcacaaaaagacaaatactgaatgtttccacttatatgaggtgaatgggggagaagagaagagaagagaaataatggagagttagtgtttaatgagcacaaagtttcagtacgggaaaatggaaaagttctgaagatggatggtggtgatggctgcacaatattgtaaatgtacttaatggcacaatgtatggttaaaatggtatgtgtattttaccaccattaaaaaaaaaaaagaaaggcagggcacggtggctcacacctgtaatcccaacactttgggaggctgagacaggcaggtcacaaggtcaggagtttgagaccagcctggccaacacggtgaaaccctgtctctactaaagatacaaaaaattagccaggcatggtggtgcatgcctgtaatcccagctacttgggaggctgaggcaggagaattgcttgaacccgggggggcagaggttgcagtgagccgagatcgcaccattgcactccagcctgggaaatgagagcgaaactccatctcaaaaaaaaaaaaaaaaaggaaactagatccctggaataaaagatagaagtgggtttttacggccaggcgcggtggctcatgcctgtaatcccagcactttgggaggacgaggcgggtggatcacctgaggtcaggagttcgagaccagcctggccaacatggtgaaaccctccctctactaaaaatacaaaaattagtcaggcatggtggcacacgcttgtaattccagctagtctactcgggaggctgaggcaggagaatcgcttgaacccggcaggcagaggttacaggtgagtggagatcccgccattgcactccatcctggacaacagagtgagactccaccaaaaaaaaaagaaaaggaaggaaggaaggaaaagaaagagagaggggaaggaagaaagggaggggggagggagggagggaaaaaattatcctaagttctttacctttaccagagggaaatcttgtttcctgcaacgaacaatcattcggggctccagcaactggtacaaaccctggaagaaatagtagatacagtcagtagaaaatgcaaactataaaataaagaaacaggtcgggcacagtggctcaggtctgtaatcctaacactttggaaggccaaggcgggcggattgcctgagctcagaagttcgagaccagcctaggcaacaaggcaaaaccccatctctactaaaaatacaaaaaattagcctggaatgatggtatgtgcctataatcccagattactcaggaggctgaggcaagagaatggcttgaacccaggagacggaggttgaagtaaacagagatgatgtcaatgcactcctgcctggctgacagagtgagactctgtctccaaaaataaaaataaaataaaataaagcaacagtaaaataagatgcttctacagttctttcatttaggttggaaaaatttcccctggtaagttccactaacagatggcatatatcacataagaccatggaaagatctatctatcccaaaccagataaatgaacccaaacctttggtgatagaaacaaaattcatgcagacatcttatattacatcaaccaagctgaggacaaatattattgtaattaacataagtaaaataaggattcacagctcagcagtaaacaattaaaacatatacagtgtttggtctgaatcctaaatctaaagcaagtattttagtggcaaaatcaaattaagggaatttaaagctagccattgcaagcaaatttgacccttaagtcatgtaagactacataattgagtagtaggcctggaagtcttatccaagcagacagatttactattttcctatgcagcacacattttagatatggtcaagagtgaaagtaaaaaagctaaaagaaaaaaaaagggtgaaaggaaaaaaactagagaaatgagaaagcaggaaaaaatagagctggtctctaataggcattctaaattttctcagaactgtggctatcaacagtagatctggtctatgagggtacctggagaaccagtccatccagcagcacttggtacctggttgtatcttttaccaccttgctgagtctctgttttgcttcatttagtaggtcctacaaagattagaaaagataaaagttatctacacatctgggcagtcggctcagaacccactgtgaggctgatcctggctcatgcccagctgcctcacattttattgctggattttcattcaacacacattccctgagatctgagataaagcaggggctgtgctgggtacaaggaagcatgtaacaccgtctctgctcccagggagtccacggcctagcagagaatagctcaggtaaccatcagttcagaaaccgacacaagtgactgacatggaaagatgcgcgcgatgtaactttgaaaagcaagctattaaacggttatacaagattaccccattttttttaaggaaaaaaaacagatgtctggctatggatcgaaatacgaacagtctacctttggaaggccagattacgaataatttcaattttgtttgtttgtttttgagatggagtttcactcttctaacccaggctggagtgcaatggtgcaatctcggctcactgcaacctccacccatgggttcaagcaattctcctgcctcagcctcctgagtagatgagactacaggcgcccaccaccacgcccagctaattcttgtatttttagtagagacaaggtttcaccatgttggccaggctcgtctctaactcctgacctcaggtgatccgcctgccttggcctcccaaagtgctgggattacaggcatgagccaccgccctcagccctctttgtttgtttttgagacagggtcttgctctgttgcccaggctgcagtgcagtgatacaatcatggctctctacagccttgaccatccaggctcaagtgatcttcccgcttcaacctcctcaatatctgggaccacaggcgtgtaccactatacccagctcatattattttattttttatagagatggagtcttgctatattacccaggctgctcttgaactcctggcctcaagcaatcttcccacctcgatctcccaaagtgctgggattacaggagtgtgccaacatatccagcctcaattttcttggttagtttgtattttctaatctgtctccaataaacactggcttctataataaaaataactaaaataggaatactatcaggaaacaaatctcatatggctgagaacacactggatatcatttgttaagtaataaggcttaagggctaaaagaaaactcaaggcttttttttttctttgagacagtctcgctctgttgcccaggctggagtgcagtggcacgatctcagctcactgtaacctctgcctcccgggttcaagcaattcttctgcctcagcctcccaagtggctgggactacaggcgcacgccaccacacccagttaatttttttgtatttttagtagagatggggttgcaccgtgttagccaggatggtctcaatctcctaacctcgtgatccgcctgcctcagcctcccaaagtgctgggattacaggcgtgagccaccacgcctggccatttgactttcttaagctccaaatgcaaagattccaaataccaagtgataaatatagtttctgtctttagaaacttttaacacttaaacattatttatttattctaagattttggtttataatacatactctgtccctaaaacaaacaagatttaatgccattcattggtcaatgaatcatactttcactcatttataattgtaaataaagttaaacagagcacaccacttgttaaatggagaaaaagtaatcatactgtatgatagttattttaaagaaacattattattattattttgaagacggagtctcgctctgttgcccaggctggagtgcagtggcctgatcttaactcactgcaacctccacctcccgggttcaagcgattctcccacctcagcctcctgagtgttacaggcgtgcgccacctcacccagctaatttttgtatttttagtagagacggagtttcaccatgttggccgggctggtcttgaactcctgacctcaagtgatctgcctgcctcggcctcccaaagtgctgggattacaggtgtgagccaccatgcccagacttaaagaaactttaaaatgcagtctttaatgggaggcataggtggcaggactgcttgagcccagcagtttgagaccagccggggcaacagagtgagacctcgtctctgtaaaattaaaaaaaaaaatcaggtggtgagcacctgtagtcccaggtactagggaggctgaggtgcaagaatcccttgagtccaggagtttgaggctgtcgtgaatgataatcataccactgcactccaacctgggaaactgtgtttttaaggctcaagagaaagcacagcctcagccatgtgcagtggctcacacctctgatcccagcactttgagagaccaaggcgggctgattacttaaacccagagtttgaggccagcctgggcaacagagtgaaactccatctctactaaaaatgaatttcgtatttaggcttgggtcccatctccaaaatatcttattatgtgtaggcaaatattccaaaatccaaaaaatctgaaatccaaaaaacttctggtcccaaacatttcagataagggatacacaccctgtctataagacatctggctgaaagaactcttagctcctccccaccaaaagagccctctaacatttttcctctctgtgctggaatcaccctatccacactggtcacacagacagggatagacagcctgagtatggagacgaggctactccagtaaattaagtaatgtcaacttgtggagcgtgctactagccatttgcataaggaatctactatggaaaacagggaaacggtaattaaggagttttaaaaggccaattcgttgagtctaaataaactaaactctagctaagcaggctagaacctaattgacataaactgtgttatcccttgtctgaagcatgcctgtccactatgtcaccacgggagagaaaggtaaattatgatcaataattaccatccgtgtgataagctcctaacatcccagtgacaccctctggtgtgactctaacttcaattaactttctggttataatctggctcctcatgtagcttttccacagcaacatgtgtctctcactgtaaactactgcagttcacatgtgggcttatttgtattttatgagtttggaagggaaaatctgcccaactgaacctaactgccctgaggattctgaaaatatttcctgctcctcaaaagcaggaaaccaaaacctgattatgatgtcaacatcaaaaccatatctccctggccctgcctagtctgaagagtcagtgggcatttatttctttgttttctctttttttttttgagacggagtctcgctttgtcgcccaggctggagtgcagtggtacgatctcggctcactgcaacctccgccccctgggttcaagcgattctcctgcctcagcctcctgagtagctgagattacaggtgcacaccaccatgcctgctaatttttttatttttagtagagacagggcttcaccatgttgatcaggctggtctcgaaccccggacctcatgatccgccctcctcggcctcccaaagtgttgggattacaagcatgagccaccaaacccggccaaagacatttatttctatttcatctctaaccacagcaatagaaatctccacttcagtaccaatgtctcagaatttaaatgttaatgcttatttattctcgtttaaaaaagaaaacttggctgggtgcggttgctcacgcctgtaatctcagcactttgggaggctgaagcaggtgcatcacctgaggtcaggagtttgagaccggcttggccaacatggtgaaaccctgtctctacctaaaatacaaaaaattagtagggcatggtgaatcccagctactggggaggctgaggcaggagaatcgcttgaacccgggtggcggaggctgcagtgagttgagatcacgccattgcactccagcctgggggacaagagtgagacttcatctcaaaaaaaaaaaaaaaaaaaaaagaaaagaaaagaaaacttatggctaggcatggtggctcatgcctgtaatcccagcactttggcaggccgaggcaggcagatcacctgaggtcgggagtttgagaccggcctggccaacatggaaaaaccccatctcttctaaaaatacaaaattagcctggcatggtggcacatgcctgtaatcccagctactcgggaggctgaggcaggagaatcacttgaacccaggaggcggggggtgcagtgagccgagattgcaccattgcactccaggctgggcaacaagagcgaaactccgtctcaaaaagaaaaagaaaaaagaaaacttgtaagttttgcggtttggggaaatgataataaagaactatcattcactcaacactcattttgttttaggcattatactagtcactctacctaggtgatctaatttttttctaaataagctttaggtagatgtttctctttttttttttttttttttttttgagacagggcattgctctgtcatccaggctgaagtacagtggcacaatcatagctcaatcctcctgcctctgcctccagagtagctgggacaccaccacgcctggctacatttttttaatttttagtagagacaaggtcttactgtgttgcctgggctggtcttgaatgcctgggctcaagctatcctcctgcctcagcctcccaaagtgtggggattataggcatgggggatggtgcctggccttctcctactttttataagaaatgaagggttcaaaggagtaaagtggggtttaaaaatctgcctactgagcagctgggaatggtaaaaacggaacttaaacctcaaaggaattccaaagcctgcactcttaatcctggaaaacacctgggcaggcaaggaaaaaggatcaacacagacaaatatctataaaggattatgcaacttagaccaaagcaccacacaacttgcctattttcttttaatttttaccccagttctgtatttttccccttccttccatcttttgtcaatatccttttctaactgcatgacaacttcctttcctttcacagcttcttattctatggataaaactagaagtaaaaagtttagaaatagcaaaatccactcaaagcatgtatgtgtgcttttatgcagattgaatcctgtttgatcggtatcatttcacagtctgtttcctcaactctccacatctcttatttacagggttcaatgacggcaagaagttaagactgtaagcggttaaaaaagaaacaagtatctttagaataactgaaattacataaatgtttatcttctcaaaattctcattataagtcagagaaataatataaaagctcaagctatatactgaattcaagttgcatgcaacagtatacttggatttgttccaaaagagattaaaacacacagcccagcttgtgaacaggccacgcacgctgccttcagctcctcacctcacacgcacttctcccttctcatgccataacaatctggctttctgccttcatcagtccaatgaaactgctctggcaaatgtgaaaaacgacatcttgactgccaaatccaaagaccaccatgctcttcccactgtcattctctcaaacattgaacactgtattagagaccattttgagtttgccgttcccttggcttctctgtattctccaacataactgctttcccccacatttccttagcaatttattttctattaaatctgatgcttctcagtttttttggcccgcttctcttctaattctccatccaaaaccacagctccagcagggacttctgtgttgtctccacataagctcctcttctctcctaacagactcatagagctttacctggaatcctaaggcaattcaaacacaatgatttttttcaccattctttacctgttcttcctatatttctttttttttttatttttgacatgaagtctcactctgtcgccaggctggagtgcagtggcgtgatcctggctcactgcaacgtctgactccctggttcaagcaattctcctgcctcagcctcccaagtagctgggattacaggcaccccccaccaggcccagctaatttttgtatttttattagagatggggtttcaccatgtttgccaggatgatctcgatctcctgacctcacgatctgcctgcctcggcctcccaaagtgctgggattatcttcccatatttctaatcttcattccatctaccagttgcctagactacaaactcttatgtcattcttgactcctttgcattcactcatcacaactgtaagtcaccaagtcctacagattcctacctttttaggatctctggaataggcctgtcttctctttctgctgccaccattctacttctcgacctggaaggtaagccataccctccttgtttctactccacatggtcaccagtggggttcctctaacacaaatgtaaccattaaacactatttctcaaagtgtggttctcagactacctgcaccaagattaccctgagctgctggtttaaatgctgactcctgactagaatataaaagtctctggaaatgggaatgaacatctgcattttaacaaggtcccccaggtgatttttatgcccattaaagttagagaattagccaaaaggatgaagtccatattcttcagcagacactcaaggcccttctaattagaccctaatatgtggcctgttctctgcccactccccactctgccagactacctctgtttcccgcacatgtcaaattcaggtctcggtttttcactcacactgctctctccattctgtatcctatcccatgactaatacttcaagtcatgctcaaacagctgtagtggagatgtattatcttgtccaggtcctattagactgcagactcctagaggggccagcacgatacaggacacatgggataaatgtactgttaaattcaaacagcttagtgcctcaagggaacccaactgagttatgacatgaaaacagaagagtgacaactgagggataacatgagtaccaaaaccagaattttgtttgcaacaattttaaagtcagcagacaaactcagagtgactaaatccgggaaagacatgtggtatgaactgaatgactgctttgtctttcaaggtcataaaaagaattatttttctctagcccatttctttttgtttctattatttattatttttagagacagggtctccctgtgtcatttatgctggaatgcagtggcataatcacagctcactggagcctcaaactcttgggctcaagtgattctcccatctcagcctccagagtagctgggaccacaggcatgcgctaccacaccttgctaatttttaaaaattttttgtacagacagggtctccctatatttatcagactggtctcaaactcttggcctcaagccacactcccaccttggcctcataaagtgctgtgaccacaggcatgagccatggcacctggctagcccatctctgaaagaatatgatggattactgtattttggaaaactatcctaagttgaaattaaaacacattcattggccgggagcagtggctcacgcctgtaatcccagcactttgggaggccgaggcgggcagatcacgaggtcaggaaatcgagaccatcctggctaacacggtgaaaccctgtctgtactaaaaatacaaaaaattagccgggcgcagtggcgggcgtctgtagtcccagctactcaaggaggctgaggcaggagactggcgtgaacccgggaggcagagtctgcagtgagctgatatcgcgccactgccactgcactccagcctgggcgatagagcgagactccgtctcaaaaaacaaaacaaaacaaaacaaacaaacaaacaaacaaacaaaaattcattccatacaactgcacttccttttttttccttttttgagcggagtctcactctgtcgcccaggctggagtgcaatgacgggatctcagctcattgcaacctccgcctcccgggttcaagcaattctcctgcctcagcctctcgagtagctgggactataggcgcccgccaccacacccagctaatttttttgtatttttagtagagacagggcaccacattggccgggctggtctcaaactcctgacctcaagtgatccatccgcctcatcctcccaaagtgctgggattacaggcgtgagccaccatgcccatcctgctcttttttttttttttttttttttgagacggagtctggctctgtcacccaggctggagtgcagtggtgcgatctcagctcactgcaagctcggcctcctgggttcacgcctttctcctgcctcagcctcccgagtagctgggactacaggcgcccaccaccacgcccggctaattttttgtatttttagtggagacgtggtttcaccgttgttagccaggatggtctcaatctcctgacctcgtgatccgcccgcctcggcctcccaaagtgctgggattacaggtctgagccaccacgcccagccccacactttcttttaatatcctccacctcaaaatttgaaaaccactgtgtgtcatgagagatgttactaaaatgtaaaataactgtatgaatattccagagagaagggaaaaaagttgagaagcaccgatattgaagtatttgataaatgaatgaatgatctgaattttaggtgtcaagttttcttatctatgccacttcaaattttccctctgaggccaggcatggtggctcttgcctgttatcccagctacataggaggctgaggtgggaaggactgcttgagcccaggagtttgtgagctatgactgcaccattgcattccagcctgggcaacatagccagaccatgcctcttaaaaaaaaattccttctaaaagccaactagtaattatttatatattctaatagatttaaggcagcttacagaagtatatctaatgaaaacgttaattacgttttttaaaaagcaaattagaaaaaataactaataaaatataaacaagtggattaaaaaattaaagcaaagagaaaataagggcaataaataacaagttaaaattacaagtcaagtcaaatccactagacctatgggttgtttacatccagttatgaaaggtcggtataccatctaaggcaggacagcatcagagaatgtatcatcaaaaccatttctataatatgttagatgatctttctcagaatcttttccactcttaatattattaaccttcaaaaaggtggcataaaaaacaaaccaaataaaaaacctaattataaagcctattaactagctaagactataatcttttgctataaccttgtgtgttatagcccttgctacttatatttaggaatgctgccaagacattaacattacatgcctctaaacttttttgaattgtacaaataataatatctatgcagtagatgtcacagttgtcattttttactttgggcataaataatgaaaagactatagtcaagaggctttctgggcattagcacccaataagctaagaatattttatctacacaggcctattattagaaggaagggttatcactggtggagacggagatggggttggagaaagggaactaacattttttaaacacgatatgacaaatgttacatgccagaggacttaaatgtgttctctcattcgattctcataagcactctgaaccaaacatcataatgaatatacataacatagataatgaatacaagagaaaaccgagggtcagaaacagtaatttagacaaacgaatatggcagagttgacatttaaactcatagctgactgactcttaagccccaagcccttctacaacaaactaccttccctaagacattattattgtaaaagcctgttataaattaattcagtcaatccaagttgctaaaggaatttgaatcccctggaaggaaatcaactcctgattattgacactttagtgaagacgcaaaataacagttgtcctgagctagtaacattttgcaggcaacatttccccaggaaactcttgactctttcttttgtattttaaaggggatgaactaatcccatgtggcaagataaactggcaacagattttgtattttcccacattcctggagtttcaaagcagataaagcacttaaatttggggcaacttttattatttgaagtaatataggagttatattagtaaatcatctctatggtgtcctaaatatcagtcctttacacttaacatcctcactgacacttacatctggaggtttcttggtccctcaaacatgtccaaaagtccagcccacccagggatgccaaaacaaacaaacagaaaaaagaactagttatttttcttaacgaaacatttcagcatcttgacttcccatttttgttaatggatccaccattctcctagtctatccacacctgatactcagaatttagtgatggacttggaagaaaaggcagagtcaatgaatgtctggaaagtcttcctgtaaaatccatcaacactaacactgctactcagttctcactgccaccatcaattaataagaactgacaacttggaatactggtttgtgtttctttctcatctaagaaaacagtatgtcttccattttttcaagttctatatttttagttttatagctgttttcatataggacttactcctagtaatttaataattttagtagctattatagagagatctactttttattttacttgcaaactggttattgttggcatacaggaaaactattcatttcctattgtgtttgtagccagtcacattgctggattagttataggatcttatgttttttgaaccttatattttctgcttgaataaccgtatctgcaaagatggtaatttcgtttcttctatcccaatatttatgtaactctcatttctccaactcataaggaatctagggcctccacagtcacaatgagtaacagtggaaacagcaggcatccctgtttggcttatgaatataatccaaatagctctacactttctcaatgaagtggtatgcttctgaaggtttctgccctcttccttagaggactataatactttccatatggttttcttttttccagcctcttccctgttaaatttagcctgcacgcttatatcatgagccttatttatgatattctccacaaaataatacaaaagtttccacagctttctgttgaaaacaggtgaagctcttcagcctcacactcatggcctctgtattaaccatcctatggttctggtctcactggtccctgtaccctcatgtactactgtgcggtccacccatagtgtgtgctataatccaggagagtcttacatgctctttagatcagaaggtccttcaatacaggccttggctcttattcacttttgtatttattataataattggaatgttttctctctaaagattattcaatcaactccttaattaatgttaactagtaatttacaacagggaaatgaataaacatgtaataattttataactaataggggctaattactcactgtgataaggtcatctcttgctctgaggactttgagtctcgcttgattcatcaaattggacatctgactgcaaaacggtattgaaaaatagcattagtaacaacttaaaactgtagagaaagaattcgaactcctgggctcaagcaatcctcctcccttggcctccccaaagcaccaggattacaagcgtgagccaccttgcccagcctgcagtttaatctttgaataatcctgtcaggctttaattttcacaaatgaagaaagagaagttaaacaatttgtcagattagtagtaggtggtcgagttaagacctgaatttatatatgcctgactccaaagcgcctgctcatgacttcagaaaacttcttagcttaatactgcaaccaggatctacttacattttcttctgctgctcaatctgtttctctttcttctcataatattccataatctttagtctttgggtttgcacaagccgacctttctctatgttgaactcttcttctgcctagagggaaattagtcaatattaattcattacatcaagttttgattaacagttttaaacagctggtgacctgcgttacttgcttatgaacactaatttcatatataaaacagaaaatttattgtgattcattttcaaggattctaatttattcaaaaggaaagatcagcaattttcattataaatgacgtactaggaaactaaaaatttcgtcaagggtaacagtaaccgacaagttactaaaggatataattgggtagaatattctgctcatgaaaaaaattaccacacgttcgaaacttaatccattagcttactggtgggccaataaatatgacacagaacttgaaagtttagaagatcctggccgggtgcggtggctcacgcctataatcccaatactttgggaggccgaggcgggtggatcacgaggtcaggagatcgagatcatcctggctaacacggtgaaaccctgtctctactaaaaatacaaaaaattagccaggcgcggtggcaggcgcctgtagtcccagctactcaggaggctgaggcaggacaatggcgtgaacccgggaggcagagcttgcagcgagtggagatcgtgccactgcactctagcctgggcgacagagcagaactctgtctcaaaaaaaaacaaagatccagattactgcccataaaatgtggtcgagtaacctcaggcttagtgtcctctcttgtaaaatgaacttaaaaaaattaaaaagttggctgggcgcagtggctcacgcctgtaatcccagcactttgggaggccaaggcagacagatcacctaaggtcaggagtttgagatcggcctgatcaacatagagaaacctcgtctctactaaaaatataaaactggccaggcgtggcggcgcatgcctgtaatcccagctagtcggaaggctgagggaggagaatcgcttgaacctgggaggcggaggttgcagtgagccgagatcgtgccactgcactctagcttagggaagaagagggaaactccatctaaaaaaataaaaataaaaaataaaggctaggcatggtggcctaacgcctgccatcccagcactttggggggctgaggcgggcagatcacctgaggtcgggagttcgagaccagcctgaccaacatggagaaatcccatctctactaaaaatacacacacacacacacaaaaattagccgcgcatggtgggcacatgcctgtaatcccagatactcaagagggagaggtaggagaaatgcttgaacccaggaggtggaggttgcagtgagctgagatcacgccattgcactccagcctgggcaacaaaagcgaactcttaaaaaaaaaaaaaaaagttgcctgggcacggtggctcacacctgtaatcccagcactttgggaggcagaggcaggcggatcatgaggtcaggagatcgagaccatcctggctaacatggtgaaaccccgtctctactaaaaaatacaaaaaattaggcgggcgtggtggcagtcgcctgtagtcccagctactcgggaggctgaggcaggagaatggcatgaacccgggaggcggaacttgcagtgaaccgagatcgcgcctgggcagcagagcgagacaccgtttcaaaaaaaaaaaaaattttttttccctcatgggtaagtgtcgcatatatttaaaaatataaattatgggctgggcgccatggctcacgcctataatctcagcagtttcggaggctgaggcaggcggatcacaaggtcgggagttcaagaccagcctggccaacatagtgaaaccccatctctactaaaaatacaaaaattagccaggcgtggtggcgggcgcctgtagttcaagatacttgggaggctgaggcaggagaattgcttgaagccaggaggcagagattacagtgagccgagatcatgccactgcactctagcctgggtgacagagcaagactccatccaaaaaaaatattaatttttttatacataaattttattatacattattttattatacgtaaacaggccaggtagagtggctcaggcctataatcccagcactttgggaggccgaggtaggcggatcacttgaggtcaggagttccaagacgagcctggccaacatggtgaaagcccgtctctactaaaaacacaaaaattacctgggcctgggtaggcgcctgtaatcccagctacccagaagctaaggcaggagaatcgcttgaacccaggaggcagaggttagagtgagcagagattacactgctgcactccagcctgggcgatagaggtggctcacgcctgcaatcccagcactttgaaaggccaaggcgggtggatcatgaggtcaagagttcgagaccagtctggccaacatggtgaaaccccatctctactaagaatacaaaaattggcctggcgcggtagctaacgcctgtaatcccaacactttgggaggctgaggtgggcagatcgtgaggtcaggagatcaagatcaccctggctaacacggtgaaaccccatctctactaaaaatacaaaaaattagctgggcgtggtggcaggtgcctgtagtcccaggtactcaggaggctgaggcaggagaatcacttgaacctgggaggcagaggttgcggtgtgctgagatcgtgccattgcactccagcccgggcgacagtgcaagactccatctcaaaaaacaaacaaacaaacaaacaaacaaacaaaagccgggcgtggtggctcacgcctgtaatcccagcactttgggaggctgaagctggaggatcatgaggtcaggagttccacagcagcctggccaatatggtgaaaccccatcgctattaaaaatataaaaaatttagctgggcatggtggcagggacctgtaatcccagctactcaggaggctaaagcaagagaattgcttgaacccaggaggtgggggttgtggtgagccgacattgcaccactgcactccagcctgggcaatagagggagactccgtctcaaaactaaataaaataaataaatatttgagacagaaatgcatttactgaggccaggcgtggtggctcacgccagtaatcctagcactttgggaggccaaggcaggtggactgcctgagttcaggagttcaagaccagcctgggcaacacagtaaaaccccatctctactaaaatacaaaaaattagctgggcgtgatggcatgcgcctgtagtcccagctacttgggaggctgaggcaggagaatcgcttgaactcgggaggcggaggttgtggtgagctgagatcgcgccactgcactccagtctgggcaacaagaatgaaactccggctcaaaaaaaaaaaaaaaaaagaaatgcatttcctgaaataatagctgaaataggacttctgtatttgatccagaaagagtcatacaagaggccaggcgcggtggctcaagcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagagtcatacaagaaactatcaccatcaaaacaatattaagcaatatcctatcagctgttatgtattagtgagagggaaaatagtcttttcttcttcaaatgataaactagtcaaatagcccaaggtttcagagagttttatttctagagtaccaggcacataaaaatttaaggctgtactaaaaggacaatgaaaatattaaacaatatatcttggtcatattttatttactgatttttttcttgagacagagtcttactctgtcacccaggctagatggagtgcagtggtgcgatctcagctcactgcaacctccacctcccgggttcaagtgattctcctgcctcagcctcctgagtagctgagactgcaggcgtgcaccaccacacccaaccaatttttgtattttttgtagagatggggtttcaacatgttggccaggctggtcttgaactcctgacctcaggtgatccacttgtgtcggcctcccaaagtgctgggattacaggtgtgagccaccgccccggccatattttggtaatatttttaaggcaagctttaaaaaatgcgtgttatgattataccttgggaaaagaacattttgacatactgttaaggaatataaattggcataagcaatgtacaactggaaatatatataaaacttctaaatgctgatggaaggtcacctttgtaatgggtggggttttcattttataccctatatacttccaaactttttattttttattttttaattttttgagacaaggtctcactctgtcgtccaggctggagtgcagtggcacgatctctgctgactgcaacctctgcattctgggatcaagcgattctcccgcctcagcctcccgaggagctgggatgacaggcacacaccaccatgcccagctaatttttgtatttttagtagacacggggtttcaccatgttggccaggctggtcttgaactcctgacctcaggtgatccgcctgccttggcctcccaaagtgctgggattacaggcgtgagccaccaatcccagcccaaactttacttttttgcaatgagcacagattaacaaaaaagctaaacaatgaaacactacaaccttctctagtcacctatcacagttcgccacggttgttaaatatctgaattttggtttccatgagaaaatgaatcatacattacttttctaccctctaacataaaatttcaggacacttattggcatcacaaccattagaaaggaaaatttattttttaatgttaaagatacagacatttccaatgaggaatttattaaggtaaaatttaaattaaaaagtaaataaaggccgggtgtggtggctcatgcctgtaatcccagcactttgggaggccgaggcaggcagatcacgaggtcaggagatcgagaccatcctggctaatgtggtgaaaccttgtctctactaaaaatacaaaaaattagccaggcgtggtggcgggtgtctgtaatcccagctactcgggaggctcaggcaagagaacggtgtgaacctgggaggtggagcttgcagtgagccaagatctggccactgcactccagcctgggcgacagagcgagactccatctcaaaaaaaaaaaaaaaaaaaaaaaagtaaataaatagggctgggcacggtgtttcacacctgtaatcccagcactttgggaggcccaagcgggtggatcatctgaggtcaggagttcaagaccagcctggccaacatggtgaaaccctgtctctactaaaaatacaaaaattagacaggtgtgacggtgcctgcctgtagtcccagctacttgggaggctgaggcaggagaatcacttgaacccgggaggcagaggttgcagtgagctgagatcaggccactgcactgcagtcccagtgacgaagcgagactgtctcaaaatgaaagaaggggccaggcactgtggctcatacctgtaatcccagcacttggggaggacgaggtaggcggatcacaaggtcaagagattgagaccatcctggccaacacggtgaaaccccgtctctactaaaaatacaaatattagctgggtttggtggcacatgcctgtaatctcagctactcgggaggctgaggtaggagaatcacttgaacctgggaggcggagtttgcagtgagccgagatcgcgccattgcacttcagcctgggcgacaagagtgaaactcggtctccaaaaaaaaaaaaatgaaggaaggaaggaggggaaggagggaaggaagagacatttttatcagtccgatgcaatctgttgttaagcagttttactaacaatattatttagcaaagcaaaacaatatggaaaccttgataacttcttaaaactagaaaatgaatctcacctttgcatctatttcttctgctttctcattggcttcttgttcaatgaaagccatcatatgctttatctataaggaaaaaaagttttattttttagttcaaaaatatggaaatatcttttctgattcattgaacaagtaatcataggtaggtgcagtggctcacgcccgtaatcctaccactctggggggccaaggagggaggattgctttaggccaggaggtggagactagtctggacaacacagataccccgtctctactaaaaatttaaaaaagtcaatcacttactgaatgcatattgtgctaggctctgagtacaaggataagtgagatcattcctattctcaggaaacttaggatctaaaatttgttcaagaaaatagaccagatacaatactcaataacacagataaataggaccttcatcctcctctcaaggaacttggaatacaagttagccagcaccctccctttctcttctccacctgtaagaaagtatgctgaagagctatctatacttactctttcaactttactacctttctctcaacactgcagtctcacttgcacccttctctgtactccactgacagttctctcataaagtgaccatctcctcgccccttgatcttggccttttcttacttgatctttcagcatcagttgatgtgttcagcaaccttccctttgtttttttttttttttgagacagagtctcgctctgccacccaggctggagtgcagtggcatgatctcggctcactgcaagctctgcctcccaggttcaggccattctcctgcctcagcctcccgagtagctgggactacaggcgcccgccaccatgcctggctaattttttgtatttttagtagagacggggtttcaccatcttagccaggatggtctcgatctcctggccctgtgatccgcccgcctcagcctcccaaagtactgggattacagacgtgagccaccgcgcacggcgagcaaccttcccttctttaacaatcttccctttgcgtccgtgacttcctcctgttctcctttccagtctcctttggggccatactcttccactcttttggggccatactcttccactctgcctcctagacagctctttttgaacatcctactcatagtaatttaaattcaacacattcaatactgaactgctcaccactcctctccccacttctcactttgagctctctctcagggattagcaccaacacccaactgtgactattcctcctacctcagtccttatatccaagcaatcaccaagttctattaattctctcttaatagttctttaccggccgggcatggtggctcacgcctgtaatcccagaactttgggaggccgaggcgggcggatcacgaggtcaggagatccagaccatcctggctaacagggtgaaaccccatctctactaaaaatacaaaaaattagccggcgtggtggcgggcgcctgtagttccagctacttgggaggctgaggcaggagaatggcgtgaacccgggaggcgaagcttgcagtgagccgagatcgcgccactgcacaccagcctgggcgacagagcgagactctgtctcaaaaaaaaaaatagttctttaccttgcccacctcgctccatcatcggagggactaccatagtccttgccatcatctcctctcagctaaactactacaacagcttccaaatttgtcttcctgccgctattcttgttgtttctaatcgactctacattgccaccagagagatgctttcaaaatgcctatcttatcatgtaacactctacccccgcttaagataaagattttagaaggtacaggatcttatcactgcttatctgtctttttttgagacagggtctctgtctcccaggctagagtgcaatggcacaatcccgcctcattttgacctccgccttctacagctcaagcgatccccccgtagctgggaccataggtgcgtgtcaccacgtccagcttaattttgtattttttgtagagaggggttttgccatgttgcccaggctggtcttgaactactgggctcaagcgatcctcctgccttggcttcccgaagtgctgggatttcaggtgtgagtcaccgtactcagcccactgcttacctttcaagcatcatatgaaacaacaaacccttcactactcaccatcttcagactcttagttcctaccatactaaacttatttcagttccttgagctcaccattctttctcatctccaagatttcaaacatgctgttccttccatttggaacattcttccttctaactttttgggcctcagcttgtataactatcacctccttagggaaatctttcctgtacctagagtactttgtacttcctctatcatggcacctaaacttgtaattgttgcttatttgtccctatcctcaactgaactatgaggctaggaacttgttaaaggttcctagatcaccggctacaattggagaataaagtccaatgaaggcttccgaatggggcttggggaataatccaacttagactcataaatgaagtatcatctcttgtggcagatataaaatatacccaagtaaaaatccaaccgacacagctcatcaaactcactggttgtgggatgcaatggtagcttcatttcctaagggagtgatgaaatccaaaaaggaaaaaaaagctaaaaattgacgtaggatctttaggtcattaattcattttgtttattaattatcccactaaaaggtaagcaccactgagtacagggatcttgtcttttatgccagtgtgaacccagaacatggaacaaccaccaccataggagatgctcaaaaaaatttgtgaatgaatgcaaatctgttgggagtttcaagacttctaaggaatacaaggtatcccaggtactttttagggtttaacaatctgtaaacaatccccatagcagcttctccatataacacaagatatcataaatcttaagtatacataggtgtaccaaaacgaattaagaaagcactactgggtggggagctaggggagggatagcattaggagaaatacctaatgtagatgatgggttgatgggtgcagcaaaccaccatggcacgcgtatcactatgtaacaaacctgtgcacattctgcacatgtatctcagaacttaaagtataatgaaacaaaaaaaagaaagaaaagaaaacactactgcctgggtatggtggctcatgcctgtaatcccaagaccctgggaggccaaggtgggtagatctcctgaggttgggagtttgagaccagcctggccaagatggagaaaccccatctctactaaaaatacaaaaaattagccaggcgtggtggtgcatgcctgtaatcccagttactcaggaggctgaggcaggagaatcacttgaacctggaggcggaggttgtggtaggcatagattgtgccactgcactccagcctgggcaagaagagcgaaactccgtctcaaaaaaaacaaaacaaaatgaaacaaaaaacatataggaggattttagaagggacagtttttttgttttatcaaaaatcttggagccaccctacttttcttttttttcttattttggcaggtgagttgttacacactcagtggattccaacttctgtggccaccatcgtgtttccaatcctacttttaaggagacaaaaagttatgatgatcaaacctatgttatagataacatggtacttacaatatcttgagccttgaaatacttggggtacctaatccagacctagatgtgtgggaaatcactgaccttgcttaaaagatcagctccacaaatttgggagtatggagaggggtcatggtaatggtgtctacaagtttagtttgaagtctcactgaacttattctatctggaattttaagtcatttaactagccgggctcacgcctgtaatcccagcactttgggaggccaatccgggtggatcacgaggtcaggagttcaagaccagcctgaccaacatggtgaaacctggtctctactaaaaatacaaaaattagccaggcgtggtggcgggtgcctgcaatcctagctactcaggaggctgatggaggagaatcacttgaacctgggaggtggaggttgcagcaagccaagatcacgcctgggtgacagagcaagactctgtctcaaaaaaaaaaaaaaagtcatttaactaaatacagtaatcaaaaccggtgtttataaatgctacaagtttggcctctaaaggtgaaccctgattcggacctggattatctgcctttagcactctgctgcacccttggctaccagatttgaccagaccagcacagcctagagcaaactgcgctaattctaacccaggtcagaagcctatttacagttaacatgatcatattcttttaagagttccaagaagagatatagtcaaccctttaaggacatttaactccacccctaaggcagaaaatttgacctttaaaaaaacagtttcttcttcctgctcagtaattaaggtttttagagtcaggtttctttgtaaatttgatgaaataaattaccatactccccaggaaaaaagcaaatatacacaaatattttcatgcaatggagaagtcagaaaattcaggatttattaagcatctactatgggcttggtgcttcatctatttacttatgagaatacagtaaacaacacacactgtcctcatcgagctttcatgtagcatgaaggattataggaaatagacaagattccttctttcaattttacataaataaaaaataggccgggtgcagtggctgacacctgtaatcccaatactttgggaggctgaggcgggcagatcacgaggtcaggagttcgagaccagcctggccaacatggtgaaaccccatctctactaaaaatacaaaaattagctgggtgtggtggcgggcaccagtaatcccaggtactcaggaggctgatgcaggaggatcgcttgaacccgggaggcagaggctgcagtgagctgagatcacgccatggcactccagcctgggcaagagagcgagactgtctcaaaaaaaagaaaaaataactcatgcgcagtggctcacgcctataatcccaccacttcggaggttcaagaccagcctggccaacgtggcgaattcccatgtgtactaaaaatacaaaaaaattatccgggtgtggtgacatacgcctgtagtcccagctactggagaggctgagacaggagaatcgcttgaacccaggaggcagaggttgcagcaagctgagatcgcgccactgcactccagcctaggcgacaaagcaagactccatctcaaaaaaaaaaaatcattttgatctagattccaaggaactatagctttatctttatactagcttttcctatggaagccttagtcttcaatatattatgacaaggagggaagaaagggaacaagagggagagaattagcactgtggccactaagagtatatggagggcattttacttttccactgcatcaagcttttcctatattgaaagaagcagaagaagcagtgaacagaagaagcagtgaaaaaggtttaaaaaaaccctttggttctgtaagaatattgtatgatttcttaaacttctccatagatactaattttgtcatctctatttaccctttggcattagcagaaccacaaaatgaagaagaaatacccactcgtcttagtgcatattaggttaagaataaaatgaaaagacactttcaaggaaatggaaacatccaacgaaaaacttttttttttgagaccgagtttcactcttgttgcccaggctggagtacaatggcatgatctcggcttgctgcaacctctgggttcaagcgattctcctgtctcaggctcccaagttgctgagattacaggcatgcaccacctcgcccggctaattttgaattttagtagagacagggtttctccatgttggtcaggctggtctcaaactcccaacctcaggtgatctcaaactcccaacctcaggtgatctgcccgcctcggcctcccaaagtgctgggattacaggcgtgagccggccaggaaaaaattttattgctcatctcagaagattcataagacagtgagtgtgctttagtaagagaattttcctagcacagtacttcagaaaaaaaaggacttagttctctaaactatgtgcaaattaaaactgcagccttaaacttccttctctgaaaaatctatcggcaatatgattactaaatgcaaggattctgatttgttagttataggcttataaactgctactatattcccctgagagtcttttgcatgacaaaattcttaatacctacagacttgaaggtatggcacttaaaaaaaaaaaaaaagtttcccaggactgattacactttgaaaactgatgtgggttcacgacttccacaacaattttttcccataaactctgatacatctacttggtgccaaacaccgttaggcattgaggctcctaaatgtaagcaaaaggggtcctggccaggcgcggtagctcatgcctgtaatcccagcactttgggaggccgaggtgggcagattacgaggtcaggagatcaagaccatcctggctaatacagtgaaaccccatctctaataaaaaatagaaaaaattagccaggcgtggtggcgggcgcctgtaagtcccagcttctcgggaggctggggcaggagaatggcatgaacccaggaggtggagcttgcagtgagcggagaccatgccactgcactccagcctgggcaacagagcgagacttcgtctcaaaaaaaaaaaaaaaaaaaaagaaagaaaagaaaaagcggtcttccatttgacacaattttgtttatttatttaatatttttagagacagggtcttttgctctctcacccaggatggagcacagtggcatgatcatagctcactgcagcctcgaccccttgggctcaaatgattctcccacatcagcctccctaagtagctaggagcacatgtgtgccccaccacacctggcaatttttttttttttttgagacagtctcgctctgttgcccaggcagcaatggtgtgatctcgcctcaccataacctccacctcccgggttcaagaaattctcctgcctcagcctcctagtagttgggattacaggcatatgccagcacgccccactaattttgtatttttagtagagacagggttttgccacgttggccaggctggtctggaactcctgaccgcaggtgatatgcccacctcggccttccaaagtgctgggattacaggcatgagcaaccatgcccagacagcctggcttattttttaagaaaaaattttttagagataaggtctatgttgcccaggctggtcttgaactcctgggatcaagcgatcctcccacctcagcctcccaaagtgctgggggctacaggtgtgagccaccacacctggcgtgtatttgtgtttattaatattaaaattttttgagatggagtctcactctgtcacccaggctggagtgcagtggcacaatcttggctcactgcaacctccgcctgccgggttcaagcgattctcctgcctctgcctcctgagtagctgggactacaggcgcaccccactaggcccagacaatctttttttttttatttttttgagagggagtctcgctctgccgcccagggtcgctcggcctcccgggttcacgccattctcctgcctcagcctcccgagtagctgggactacaggcgcccgccaccatgcccggctaattttttgtatttttaatagagatggggtttcaccatgctggccaggctcgtctcgaactcctgacctcaggtgatccgccctcctcagcctcccaaagtgctggtattacagacgtgagccaccatgcccggccccagcctgtatctcacaaatgttaacacacacattagtgggagaccaatcattacaatccattatgatagaggggacttccccaaaatgaagattaacagtacatacaggcctggcgcgttggctcatgcctgtaatcccagcactttgggaggcccaggtgggaagatcacctgaggtcaggagttcaagaccagccaggccaatatggtgagaccctgcctctactaaaaaaaatacaaaaattagccgggcttggggcgcgagtctgtaatcccagcttctagggaggctgaggcaggagaatcacttgaacccggggcggaggttgcagtgagccgagatcgcgcccttgcactccagcctgggcgacagagtgagactccgtctcaaaaaaaaaaaaaagaaaaaaagaaaaaaacacagttcataaagtgaacgaccttgtcaaaacactggttggaagcaggtctcttccctccgcactgtttcctatcatatagccttaagcatttccctcagggttaaaaaaaaaaaaagtgacaaggctggtttgttttttttttttctttttccagagggagtctcgccctgtcgcccatgctggagtgcaaaggcgcgatctcggctaactgcaacctccgcctccgggttcagcttcccgagtagctgggattacaggcgcgcgccaccacgtccggctaattttctatttttagtagagaccggggtttcaccattttggccaggctagtctcggactcctgacctcaggtgatccggccgcctcggcctcccaaaatactgggattacaggcgtgagccactgcccctggccacaaggctgttttcaatccttgcacagatctctgtccgactaggcacagtgaatacccttggaaaacagggaatgctgaggtgggaggcaaagagccagggcgttcaagaaggcagcgcgcaggcaagcgggcagtgcccaagacccgagcaaaagtcacatgagctgcggggcaaatctccgtcctcaggccgacctcttggatctggtgacttggagcaagggaccttcctgcggcatctgggcggctcaaggcccgcggccttccctaggcgggctccagcccactccccgggactgccgccgcggcttcgtaagacccaaccaagcccctcacctgcttttgcacgtcagcatcgctgagagccatggcgagagcaatgctaggccggtgaacagtaggctcgagtttaggtttgaaaggtgaggtgagagaaatcggcaaagggaacccctgcgcagatctcgggttcctttactttataaccgcgggttccggttcctgccaggtgactgcacagttcatcctcatgacccttctcagccaatgggaagagagcgacgcccaggaagtcccgccctgtcccggcctgtgggcgcgtcctcgggtccttctacgtcgctgactcgtgacctgaccggtatttttttcctaaactgggatcttgggtaggaggaagaaaagataaggagttcctctatctgaaattagtcgggctgttttgaggagtactggttaggtatattggagaatgtgcctttattggaatttttcgcataattacacagggttatgggcttaggggtacatgattgttggccgggcgtggtggctcacgcctgcaatccggagactttgggagaccaaggcgggtgtatcgcttgacctcaagttcgagaccaggctggacaacatagaggaaccccgtctctaccaaaagaaaaaaaaaagggggatacatgatttctgactattcatgtcaaccttgattacctgaataaagtgtagggtttgtaggtttctccactctgaagttaccttttttaaccccctttccatactgtagtcttaggaaggaagccactatacaaagcccacacctagggagtgggaagctatgctcaacttccttattagggtggagcagctacataatttatttggaacttttctgagatagcctatatatttttcaaaagccttcccaggtcccatttagaggaatattaggacagaaatccccccaggctcatttgtttttatttggatttacctcaagcccgtttttttccccaaaatcccaaaggcaaaaacttttgaaaattcctttatctttaggatagactgactcctaatagtagaataagaggtcaaatggtacacccacttttttctttttactgtgctatggttacccaccatttttattagctttttatcttgaagaaatttgagatatagtaacttgtaagaatactgcattgacctcccttcacctagattcaacaattgttaacattttgctacatgtacattaacactttattttcatacacacacacacacacacacacacacacacttcctattttagtgtgtcataagaacgaggatgtagcaaattcaggaaatttagtttactaggctgaacattaatttcctttgtcccgggccaggcgcggtgtctcacgcctgtaatcccaccactttgggaggctgaggtgggcagatcacctgaggtcgggatttcgagaccagcctgaccaacatggagaaaccccagtctctactaaaaatacaaaattaacaggcgtggtggtgtgtgcctgtaatcccagccactggagaggctgaggcaggagaattgcttcaacccaggagcagaggttgcggtgagccaagatcgtgccactgcactccagcctgggcaataagagtgagactccgtctcaaaaaaacaaaaaaaaaaaaaacaaattcctttgtcccatcaatccatcaatgtactttataaccctttcttttttttttgagacagagtctcactctgtcgcccaggctgcagtgcaacggcatggtgtcagctcactacaacctctgcctcccgggatcaagtgattctcctccctcagcctcccaagcagctgggattacaggtgcctgccaccatgcatggctaatttttgtatttttagtagagatgaggtttcactgtgttggccaggctggtcttgaactgctgacctcgtgatccacctgcctcggcctccgagagtgctgggattacaggtgtgagccactgcacccggccttctttttcttttctttttttttttttttttgagatggagtctcgctctgttgcccaggctagagtgcagtggcagaatctcggctcaccacaacctccgcctcccgggttcaattgattctcctgcctcagcctccccagtagctgagattacaggcatctgccaccacgcccagctaatttttgcatttttagtagagatg

SEQ ID NO: 15198 - DNA, 19377 bp, Human
catcctccccataggcatcagataccaatccgcctttctcctctgaaaggttaaaaaacaaacaaacaaacaaaaagcaagaaaaaaaaaacaagagttacaatgtaagaaaaaatgtccagagatttgagtggccaagactatctctgaagatacaaagggaacctaaatctcatgttaagttacaataggcccagattcggctctctgagaaggccagcatttactgaataaaatcattaaaaggtcagggaacaaaaccgagtactaaattctgtttctaatgctataaacactagataaacactaaagtgtttataggaaaccatcagagaactttctgactggaagagaccacacaaaatcacaaaacatggaagtacctaacctaatccaatccccttcactttccagatgaggaagctaaggtcctgatatgttgttaggtaacttgttctttattctcccaaaggaatctgtttccattatctaacattgtgcttctcaacctgaggaggagaacatcaccgttaggctttaaaaactcacaaaataagaaaaatcacctgggatccttaaaaagttcacaaatgcccacatcctaccccagttctaccgaattaggttctctcactttgggcatcagatacgtttgtttttaaaagctccaagatgtgtttagggcacattcctaactaaaagttataaagttaacgaacacaatctttaccatcttccacgtatgttttacttatcgctctccctcatcaaacaacgagcccaggggaaacaggcagtggctgagcagccgctccctcttcgtccatccctctgtctatcactatagccggcacggagtgtttcagtaagtttaggcaaattaatcgaaataacgggaaggagattcttcattcttagtccacagtctctaatgctctatctcaccccggaccctggaccattcttcggggtccggtgcttggagcacaatgaccatcttgttccctcccgcccagcgagggtacagcattccgggcagacacccgattcccccttccagcttcgcacttgggccttaccagccgcgctgcccaccgcctcgattccagcctcgccatcagactcgggctctgaatcttccgcgtaaactgcgagagacgacagaacattcttcttccccgccatcttattcccacagcccgggcgtggctcactcctatgactcaagacgccgacttccgggcggaaaggcaggttctttcggatcccaggagacccccgcgccacactggaaaccaatcaaaacggcagtttcctgcgcctgtctccgccctcatgccctcgctcgcgctacgtcatcactgcgcgacggatataagattgcgtgggttctgcctaaagctgaattcccagcgctttggcttctctgagttggggttgtgtataggggtcttcgaacagttccggaaccagccagcagcctttaattcttgggcggaccacggccggttctgatatcttagggtgaagagagggaggtgtcggccagccaagagagaaaattgcggatcttgggctcaggaagacgggagaaggggttcggggtcccggggtggaagaacggtcgtcgtggttgcgcttatagaagtaggagcaggtggtggatcttaggaaaacggttccccgttctccaagctgttctgaagacatttatgtttcttctcttgatctgatttctagctctgtgctataccgtggcctggaatagttcaatgttttcattttcattgagcgtaaaagtggagatgttaattactgaggaatgtattgcttgaggcagttcaccttcagctttattacttaaaaataatacattatttaagtgtaatatagcaaattgttacagaaaaataatctgtatttttaatgcaaaacagagggttctcgtggcaaccttttactacctttgccttaacctttggccactgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacattaccaagctaccttcctttaaatttatgctggctataccataacgctgcggcagaacaccctcctcctcacccttcgtactgcctcacctttggtccataactggatttggaaatctttagagttgtcaaagcttgtagtttcgtttatttgttttaattagagatggggtcttggcatgttgctcaggctggtctccaaatcctgggctcaggcaatcctcccacctcggcctcccaaggtgctgggattacaagcatgagccaccacgcccggcccaaagcttgtagttttagtggcagaaccacccagctggtctatatttcatagctagatttacacatggtctttgaaaacacttcagattctcattattgttcgtttgtacacacaaacgaacagcaacagtgagggtggtaggaataacttaactcggtcactggcctcctaggtaattcccttgttgcaggttgagtggccttggtcccagatagagaaggaaagagtaataatgttataaacctgagatacggtgacaaatggaagttgccaagaggcgagcagcaatgtaatattaatgatacatgtctaaacaaaagccctctaagtaatgtcctctcatgtctacacagatgtacccactcatctagcagtactctgctttcatggctgtttagttcaatcatccatatcacagcagactcagacttctttttttttttttttttttttgaaacagagtcttgctctgtcgcccacactggagtgcagtggcgcgatctcggctcactgcaacctccgcctcctgggttcaagcaattctcctgcttcagcctcctgagtagctgggattacaggcacgtgccaccatgcctgggtaatttttgtattcttagtagagacagagtttcaccatgttggccaggctggtctcaaactcttgccctcgtgatctgcctgccttagcctcccaaagtgctgggattacaggcgtgagccactgcgcttgacccagactttttaaatcttgtttttaaccattactagaaatggtttgggcatgtatccaagtttcccaggatccttgcctttttcatagaaaggacaggaggggaattaggattacatcgagaccctcccatgtgccagacactctgctaggtgcttttcctacattctcatttaattttcaacaacttcaatgaaaaggcaggaagcactgagatattgttgtcttgtattttttcaggtaacaaggacgtctttgtgtgcatgcccacaggggcaggaaaatccctatgctatcagctccctgctctgttggccaaaggcatcaccattgtagtctctcctctcattgctttgattcaggtgaggcttagggcaatgaagatggtagcccaaaaagattcggggaaggttttttgaggctggaaatttcacttctctattggtcttttgcctcttattttcttttctttttctttttccttttttttttttttttttgagacagagtcttactctgtcgcctaggctgaagtgcggtggtgcgatcttggctcactgcagcctccacctcccggcttccagcaattcttgtgcctcagccccccatatagctgggattacaggtgtatgccaccatacccggctaatttttgtatttttagtagagatgaggtttcaccatgttggccaggctggtctcaaactcctgacctcaaatgatccgcccacctcggcctcccaaagtgctgggattacaggtgtgagccaccacacccgcccctgcctcttattttctatgatttgcctatctcattcgctatattgggtttctgtatttccccaatgtagtgttctccactggtgcatatcactctgggaggttatgaatgactcctctgaggtccctcaccctcctttgttatttttttgttcagaggagtatgaaactgtatttgtacacacatatacactcagtctcatgtatacacacacgtgcactcgtgatgttgagacagaagttgcagatggatagatagctaagttgatatggggaatccctggtgtcctgcttattttggtaagggcacagtatgtgaaacagaaaaaaagatgagaaactgtctgggaccttattaacatctgctctacaggtgttctgactatttaaggcctgcagatgggctgatagaatcagaattgaggaagtgtggctgtgtgggtaagagccatccaccatgaaggaaggtagagagggaactacagtaataacttggtgaatgttcaccaggtcccaggcttcgtgctaagtgccttacatacattaatttctttctttcttttttttttttttttttttgagatggagtttcgctcttgttgcccgggcttgagtgcaatggcgtgttctcggctcaccgcaacctccgcctcccgggttcaagcagttctcctgcctcagtcccccgagtagctgggattacaggcatgcgccaccatgcctggctaattttgtatttttagtagagacagggtttcaccatattggtcagtctgatctcgaactcctgacctcaggtgatctgcccgcctcagcctctcaaagcgctggaattacaggtgtgagccaccgcgcccggcttacatacgttaatttcacctctcagatgtaaattttaagttatacaacaatgctattagatagaattgtataaatcgttcagagggtaagaaacagccagcgagcatgtggcgattaagtgagccaggatgaaatctaaatctgaagtctgtctgacttcagagcctgtgctctaaaccacttcaccttccatagagattgagcatccctaaagcaaaaatctgaaatctgaaatgctccaaaatccaaaaaattttagtgctgacgtgattccacaagtggaaagttccacacctttctgacctcatgtgatgggttgcggtcaaaactcagccaaaactgttttttcatgcacaaaattattattattatttttaatatatattttttattatactttaagttctaggtacatgtgcacaacgtcatgtcaaaattattaaaaatatataaaattacatctaggctatatgtataaggtatacgtgaaagaaaaaatgaatttcatgttcagacttgggtctcatctttaagagatctcattatgtatatgcaatctgcaaatattcctaaatccaggaatatctgaaatctagaacacttttggtcccaagcatttgataaaggatattcaacctctactacttctatgcaaagagaatatatattggagggtgggaggaggacagtttatgactgggaaatcctccagggacttgcagtgatgtttacctgagtcctgagggccagttacagcctctttctcttctcttaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaaggggtgaggcattgaggtggaggccaagcagctgttagagcagtggggtgcgatgtgatggagatggagattggtctaagacctttggtttttctagctttctcagccaggcttcctaaaacttgtgcacaaaaagagttgtctctttggtttcctggcattgtcctccttaccagggtttccttgttctggatcctgtggaaggcaagcagccagccagtctgtgtgatgcctctgcagacccatgcaaagctcatgaagaggaggcagagaagttaaacaggttgagttttgagcagcttttggcctgttttttttttgagatggagttttgctcttgttgcccaggctggagtgcaatggcgcaatcttggctcaccgcaacctccgcctcctgggttcaagcgattctcctgcctcagcctcccaagtagctgggattacaggcatgcgccaccactcccggttaattttgtatttttagcagagacggggtttctccgtgttgcccaggctggtctctaactcctggcctcaagtgattccccccaccttggcctcccaaagtgctgggattgcaggcatgaaccattgcatccagcctggtcctgctttttataaagtgacagagcctcactgggtgtcctgcctcagaagagactgaagccgacgagagaaggaacacagagcttcttttagagcagggtgcattacactgggcctattgttctgttcttgctatgcttattttcttcctgcatctccccattcagttatctggctgcggcattgtgtactgcaggactagagaggcttgtgaacagctggccatagagctcagctgcaggggtgtgaacgccaaggcttaccatgcaggtaaggggcacccaggccacttgagtctcttcaccctcagaggcttcttagctggtctcttgttctttacagatcctggttatcaggtgacccaccatcttattgcagatactcaggcagagctaaagtgatacacttaaatcccctaaaaggagtctagacatgaatgaggtctaaaatgagaattgtgactcctgagttcttcccactgtatgcctacccagcagcaggtgatacgtttttacaagccaaggtaatggtgttgtaggaagagcacaggctttggaggccaacggacttgggcttgaatcatggccctaacctttgccaaatgctctgtgccacacatgggctagggtctttgtgcctgtcagctgaggctcagtaaagttaagcgcctgatgttaaggtcagacagctgggaagtgaaagattcagggtttgtgaagtgcctagcacacagtgtcaaacccaaaataggcccccggtaaacccaagggaaatgtgagttcccttctccatcttcccctcctttacagggctgaaggcctctgaaagaacgctggtgcagaacgactggatggaggagaaggtccctgtaattgttgcaaccattagttttgggatgggagtggataaagccaatgtcaggtgagctttggttcttgccctgccctcctggtctgggcctggctcagggtggattgcctagtgctgtgcccaaaggaccaggtgcatgtgctccttcgagggctagaggggaaggaagctccaggagagagtccttagaatacagcctgaatgctgacagctcctgtgcggcctgctcccaggtgactgcacggcatggttctggcaccccccaggatggggcagcatgcagtctgtcaggcttgtcctttaacatagtcctgttcactcacatctcagtaggtggatcctatgaggaggtgggaataaaggaactatagtcatgcacctcatgttgatgtttcggtcaatgacagactgcatagactgagatcctgtaagattgtaatggagttgaaaaattcttatggcctagtgatttgcattacagttgcctacaatattcagcgcagttaacactcgatacatgtttacagcctagctgtgcaggctgcagtaccatctagatttatgtaaagactatccaccgtaatgtttgcacaatgatgaaattgcctaacaagtcatttctcagaacgtatccctggccgggcacagtggtccacacctgtaatcccagcactttgggaagccaaggcaggtggatcgcttgagttcacgagtttgagaccagcttgggcaacgtggccaaacctccatctctacaaaaaatacataaaaattagccaggtgtggtggtgcgtgcctgtagtcccagctacttggggggctgaggtgggaggattgcttgagcccgggaggcggaggttgcagtgagctgagatcatgccactgcacttcaggctgggcaacagaccaggaccctgtcttaaaaaacaaacaaaaacaccaaaaaccaaaacacaatatgtattcccatcattaagtaatgtgtgactgtattttaagctactccctgtggaaggtcaaaggcaaggctcttagaaccatcattcctttttattgcttactaatagtctagaagagtcggggtgcatcccagcctcctagccccacactggcaactaataggaagtcttttatatctggccatgaccttcaagaggcgttttgggctacagcctgaagccctttggtctgattaacgacaaataataataccttgtatgatttacggagcatgtttgcatacatggtcttcgtgaacctcacagtgaccctgagttagggacgaaattttatagtgcgttacatttgaaagaacaccgacttcagaatcagagttcgaaccctgggtatgctgccaggtgtagtggttcacacctataattccagcactttgggaggaccagatgggaggattgcttgagcccaggagttcgagaccagcctgggcaacatagcaagactccatctctataaaattaaaaattagccaggtatagtggcatgtgcctgtagtcctggatacttgggaagccgaggtggaaggattgcttgaggccgggggttgaggctgcaatgagctgtgattgtgccactgtactctagcgtgtgcaacagagcaagaccctgtcttgaaaaataaaaaacaaggccgggcacagtggcttatgcctgtaatcctagcactttgggaggccgaggcaggcggatcatgaggtcaacagattgagaccatcctggctaacatggtgaaaccccgtctctactaaaaatacaaaaattagctgggcatggtggcgcccacctgtagtcccagctactcaggaggctgaggcaggagaatcgcttgaacccgggaggtggaggttgcagtgagctgagatcactccactgcactccagcctggtgacagagcaagactccatctaaaaataaaataaaataaaaaacaagcaaaataaataaaatgaatcctgggtctgtggtatcttgttaagagccagttttgaaggcagacacccctaggcccaaattctagctctgctgaccctttactgtgtaaccttgtacaaatttacctttctgaatctcatattctggagaatgggctacctcacatgatggtgactaacaattaaatgagacatatataaactggcacataggaggtatttaataaatattattcctttccctctccaaagaagttataaataacttattcaaatttgcatagctcataagtggcagagcctcattttgtttctttaggtccagtattttttccactgggccctggctgagttttttggcccctcatatgtgctggatttgcccccccttaactcctgctgtggcctctaagctgggctgcttctagaagggagacgtgctgatgggctacaggtgtcttaactattctaactctgggactatccctctccctccctatctgctggcctccctgctctcctagtcatgattactcctccaaaggacactcagcttctccaccatctcatgctgcttgtccctttggatcctacaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggtaaggcttgggcagtagaaggtctttcagtctgacccaccactctccagttttgtgaagctgatttctgaactctgatgatgcttgtgtaagctagaggaggctgctcccaacctgtaagtatagcaaagggaaatggcgtattggttaggtaggcagcttacaacaagctaggttagactttttctttctaaatatttaaatatttaaattatcttaatactagctttttttcttttttcttttttttgagacagagtctcactccgtcgctcaggctggagtgcaatggcatgaactcggctcactgcaacctccgcctcccgggttcaagcgattcttctgcctcagcctcctgagtaactgggattacaggtgcatgccaccatgcccagctaattcttgtatttttagtagaaacagggtttcaccatgttggccaggatggtctcgatctcatgacctcgtgatccgcctgcctcggcctcccaaagtgttggggttacaagcatgagccactgtgcccacctttttttttttttttttttttaagagacaaggtctctcactgtcacccaggctaaagtgcagtagcatagtcatggttcacagcagcctctaactcctggccataaataatcttcccaccttgagtagctgggaccacaggtgtgtgccaccacgcccagctaatttttttttcagtttttggcagagatggggtttcactatggtgcccagactggtctcatgactcctgggctcaagtaatcctcctgcctcaaactcccaaactactgagattacaggtgtgagctactgctcccggccttaatattgtcttttgtgtacatgttattttatgtggtcaagatcagtactgccttgtttcttttgttaaagagatggggtctctctgtgttgctcaggctcaagtgcagtggtgattcacaggcgtaatcatagcacagtataccctcgaactcctgggctcgagtgatcctcctgcctctgcctctcaagtcgctgggaccagaggcatgtgccactgcacctggcttaatcttcccttgttttttgtttgtttgttttgtagagacgagctcttgttatgttacccaggctggtctcaaactcctgagctcaagtgagcctcccaccttaggctcccagagtgctgggattacaggcgtgagccaccgtgtccagcctataagtacttatttctaatctctgccaaaatgacaataaaggggccgggcgcgatggcttacgcctgtaatcccagcactttgggaggccgaggcgggtggatcacgaggtcaggagatcaagacgatcctgactaacacggtgaaaccccgtctctactaaaaatacaaaaaattagccgggcgtggtggcgggcgcctgtagtcccagctacttgggaggttggggcaggagaagggcgtgaacccaggaggcggagcttgcagtgagccgagatcacgcctctgcactccagcctgggggacagagtgagactctgtctcaaaaaaaaaaaaaaaaagacaatagaaggataaatatacataaattcgcaaggataatgaaagtaggagagaagacaacagcaggtagaaatgacaacacattgtgcctagaaacacaaaaaccctactagaaatctactcaatcataagaaaatctggcaaactggttgaatataagagaaatagtttaaagatcagtagcttttctctagtcagatgagagccaaggaaaaaaaaaatcagtagcttttctccacattaccataaatacctagaaatagaaacaaaaaaaaaacttaatttacaacaataaaacttataaaatacttaggaataagtgttacaagctgttaacacgagtttttttcaaaaagctccccagtaggctgggtgcggtggctcacgcctgtaatcccagcactttgggaggctgaggcgggcagatcacctgaggtcgggagtttgagaccagcctgaccaacatggagaaaccccgtctctactaaaaaaatgcaaaattagccaggtgtggtggcgcatgcctgtaatcccagctacttggaagaggctgaagcaggagaatgacttgaacccacgaggtggaggttgtggtgagccgagatcgcgccattgcattccagcctgggcaacaagagtgaaagtcggtctcaaaataaaccaaaaaaagctccccagttgctttgaatatatggccagggttgacaaccactgatttagatgaagaaaactaaaatctcaccaagagaaaacaagctctgggtccaggagcagtggctcttgcctgtaatcccagcactttgggaggccaaggcaggcagatcacctgaggttaggagttcaggaccatccggcccaacatagtgaagcccgtctctaacaaaaaaaatacaaaaattagccaagcatggtggcacacacctgtagtcccagctactgggaaggctgaggtgggagaatcacttgaacctaggaggttgaggttgcggtaagctgagatcataccatggagtggaggacgcactccagcctgggcgacaaagtgagaccctgtctcaaaataaaaataaaaattaaaaaggccaggtgcggtggctcacgcctgtaatcccagcactttgggaggacgaggtgggcagatcacgaggtcaggagatcaagaccatcctggctaacatggtgaaaccccatctctattaaaaatacaaaaatattagctgggcgtcgtggcgggcgcctgtagtcccagctactcgggaggctgaggcaggagaatggcatgaacccggaaggcggagcttgcagtgagcccagattgcaccactgcactccagcctgggtgatagagcgagactctgtctcaaaaaaaaaaaggccaggcgcaggggctcatgcttgtaatcccagcactttgggaggccaaggcgagcggatcacttgaggccagtagttcgagaccagccggccaacatggtgaaaccccgtctctactaaaaatacaaaaattagccgcgcgtggtggcgggctcctgtaatcccagttactcgggaggctgaagtaggaaaatcacttgaacaaaggatatgaaaagcaaataatatgaaaagaaagttcccagaaaaatttatcaaatgacatgtttaaaaatgttaggctgggtgaggtggctcatgcttgtaatcccaacacttcgggagaatgacatgggaggatctcttgaggccaggagtttgagtagtttgggcaatgtaacaagactttatctctacaaaatatttaaaaattagctgggtgtagtggtatgcacctgtagttccagctacgcaagaggctgaggtgggaggatcacttgagtccaggaggtcaaggctgcagtgagctgagatcataccattgcactccaacctgggtaacagagtgagaccctgtttcaaaaactaataataataaaaaaaattagctgagcatggtgatgtgcgcctgtagttctagctactcaggatgctgagctgggaggattgcttgagcctaggaattcaaggctgcagtgagttatgatcatgccactgcactccagactgggtgacagagcaagactctgtctccaaaaaaataaataaataaacaaataaaaattcaatgctgtatgtggaaacttgaaggaaaaaaaagacatcttcagataacaaaggtttcaaaaactttcccctggtatgtcatgtctcagaagctattaaaggatgttctccattgtagagaggcagtaaacctagaaagcaaagatggaaacttacccaggagtaagtcttggcacaggacaatattggggagtagtccggaaagacagctgtgtcccaggcctagggaaaactggtccagattgcactagggggcagaagactccaggaaggaaggttctaaacatcaaagtggaagctggcatctctggctcctatcgaaatgaattgttcattatgttaggacagttaggggtgaattaataacatactgaaatctaagtaaatggagaaaaacaaagctatttcaggggaaacacagttacacaagaaaggaaatgtgatcacaggaaatataaaaatgcaatcacttcggtttagctgtgaactctgttgacatagtcataataaggaaaatatggatttaataagaaattgtgttgtaaacatattgggaagttgggggtacagaatctgtgtgtatttgtgtgtattggtggggatgagttacctgcccaaagcagaaactcaatagatgatgtctcagatatcagtgtctggtttttgtttttttggggttttttttttgttttgttttgttttgttttgtttttcagacagtctttgtcgtccaggctggagtgcagtggtgcaatctcagctcactgcattctccacctcccaggttcaagcaattttcatgcctcagccccccaagtaactgggattacaggcgcccaccaccacgcctggctaatttttgtatttttagtagagacaggtttcaccacattggccaggctggtctcgaactcctgacctcaagtgatccacctacctcagcctcccaaagttctgggattacaggcataagccaccatgcccgggctctttttttccttttctgtattaaataattcacagtattttaaaaggatatgttggcaaatagacatgtacacaaaaaaggccgctgatgaataatcacatcactcacaaatgctcagtattctgctagttgattcagccacaagtccatagacaggcttataacagagtgaagccaggaacggtctctgagcagagctgcaccagagcttcggtcactaagaggggaattacctccaggaatgggcaaggaaggaagttggctgccatctttagagttccactgccctgaccaggtgtccacatttgaaatgtatagtgcccattccttacctaatagtggttcctggcccaaggtgagcctgtactttgaattggataagggtgcagaggtcttcctggtgggaaggcctggagctgttgttgctcagctgtggggaccacctgctattgccctactcccctctagtgggagccaaagggaaggctggctgatgagtgtctgcggattgaggatgtggcagggactggtgcccccacctccctccgccccaccaccaaagatggggctctgcctgctgtgtgcctgtcaccagcaaccggcagtcatgccttgggtttcccaggtggagaggtggcaggcaacattttaaaaagaaaacaggaaactatattgtgtgggggaggcaggagtggagatgagaaaacagtttggattttgtgagaggggctttgggggagtttggtagttgttggtaacttaagtgctttttcttccttttaagttagttgcaggctttggtttggaaagccccagggaagtggggtgggggacagaaacctgaggctcttgcccctttatctgccttcacagtaccatctccttcccccagctttaccctgcgctcaggagccaggcctcagcgcttcctgctatccacttcccataagccactcctctgatattagtccatagccaaaggagctgtgggtccaggcctggtgaccagcccagctcagcccgctcattcagggtgctccctacctgcaggcaggaggcaacaccctgtctgctaccattagcaccttccagagcccacctcccctgcccagccgtaccctgctctgccccatctgggatgctgtgctcaggcatgagctggcagggccgcacacagcctccctggtaagtagagactcaggaaacctttggggtcctcctgttttctggttgtgtgatccaagtggtgcacactggccccttgggtgccaactgaagggcttgggaatcttgctctcctggtgtagctggcagctgcccacccccaccccacatgggtttctgagtcggcaggtcaagcattattttattttattttattattttatttgagatggagtcttgctctgttgcccaggctggagtgcagtgccacgatctcagctcactgcagcctctgcctcccgggttcaagtgattctcctgcctcagcctcctgagtacctgggatcacagacatgcaccaccatgcctggctaatttttgtatttttagtagagatggagtttcaacatgttggcaaggccggtctcgaactcttgaccccaggtgatccgcccacctcagtctcccaaagtgctgggattacaggttttaaattgtattttaaattcatgttttaagcttatcaagaagagtcacttaaccttttaatatatctccctccaatatacacagaagtatatgtgttcatatttgttaagttcacaacatttgtgcgtgtatttactattattaaaataggtgatattatatagcgcttcctaaatgccagtctgtgggccctttgcatgagaacctcctgagaagcttttcggaaactctcaaaagctcatcccagaaaattcagttcagtagtctgggggttatgatacatagtcaggtttggggacacttttgtaaatggctttattactgtcatttaatatttttctcccttgttacttttttttgtttttgagacggagtgcagtggcatgatctcagcttgctgaaacctccacctcctgggttcaagtgattcttctgcctcagtctcccaagtagctgggactacaggcatgcgctgccacacctggctaatttttttgtatttttagtagagacagggtttcaccatgtaggtcaggctggtctcgaactcctgacctcaaatgatcctcctggctcagcctcccaaagtgctgggattacagccgtgagccaccgcactcggcctcctcattactttttgtggctctaaggtagtccaattctataagacttgctaagtggtcattttttgtccccaggaaaagagaggaaacaaagcatctgataaagccactatcatggcctttgatgccctggtgaccttctgtgaagaactggggtaagtgacttattttatatgtggagcaaagtgtcagtgagatcatttacttccccggcacgccctagttaagcagctgacataagacagcccgtaggctaccaagggacacctgcctgcaaaggccattgtgtcgggcagtgtggaagtcaggaccttgctcttctctattggaggccccgggatctctcgcagtgtggggatttgctcagtattctgagtggtgtccttccctccactccaccctcttctgggatggctggccccacaagccactcagttccaagggatgtgaccagctctgagccatcggctttgtggtcatcatgtgccaccgagctgggacttctggcatcacttgagtagtcctcacccttatccaggacccacacagaagcctgtggccccacttacctcggggagtcatgtgctttgaactcacgcatctgttttacctgcatctgcaggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtctgtattggctactgttctttgaataagtgaatgtttctttattgcataactggcgtgtagcacaaagaaaaagccccttctccaccagatatttgcttcctaagaatagttctcattggaggctgaggtcgaagcagcctcccaccagcgatcccttggggcgggcacctggcagtgagggacagagctagtggggtgggctcagcagaagtgggtgcatttctgcaaaggaagctgtaggtttcttgtcagtttgttgtggggtctgaggcacatgggagtgggaccagcagaaaagatactcaggtcagttaactaatgaggcggggctgtggcagccagcggttttcctctcttctctatctgtagctactttctctgggctgcagccttgaaaaagcagtgtttgattattcataacaatgagtgtcttttagtgtcacagggaacagttattaggtttgaagcaacctccagcttgaggcctcggcatcttgagatggaagagcagccttgtgtttagacctggattg

SEQ ID NO: 15199 - DNA, 8282 bp, Human
atggccccggccatcatggccaaaggtgaccaggaggggccggagctgggcccaattcccactcccttgaggtaacgatcggctaatcctgacatgctggccctggtgggtccgagtctgatggaggtgagtcacctcaatggctagcccatagtttggctgcttctcccgggtccagcgaaggaccgcagggctcacatcaaaagtttcccaccgtgtcacattgtggtggaccagtctcgtgtccagtagtcgtgtgatgaggtgcccaggcaccacttctgctgggggcttcataacctcataaatgtttatacggtggaagcccctttcccaatcagggccctggtccacctgctcccggaagagccgaagctctgcagaggagatcacctcgttctcagggatgctgctgaggttaaagaggaaacgaaaagcagagttttcactggtccctgggatgttctccagatgttctaggcacagttaggaaggaaggggaaaagaaaaagcatatgaacttttttcaaagatggaagagtcaagagatagctcagggttgggcaatgaatggtgaattctgcttatgcaggggaaacctactgggggaaaataagcataccccttaatttgaaggagcagataagtggggcagctaacaaaccagcaaaatgtagctagcatttctcaagcaccaaagacagaaactatatccagcctccttgatatgtctaataatttctatgtgtcaactcctctatggcaccacaatcagactcctcttttaaaccccccaccttggctttgtgtccacagttttctttacaagtggttgtaaagaaaaagaggggccaacagagcacaggcaggaggaaacatgcagacaaccaccctctccctcttccactattgagtatgttactaaacatttccccagcgatcttggaaacacagagcatgccttgttgatcatgttacagaggggaaaataaattccaacacagtaatgatgctggtggattaataactcagatttactttggaaaagaaacatccgctaggaaacattcagatcggattacaaggcccctattgaataaacccgacaaacacacagctgtaatattaaattcagtaggtgctttgaaaaaaacgggcagaaaacctagcagaaaaggctttgatatagcaaaaacacaccgctggggctagcccacgtctgagtgctgtcattccccttcccctgaacacctccccctctgtctccaaaaaataagttcggcggcagctctgcaaattcttggaggtaagcagctctgttcctcagcctcctggactggggctttgatgtaacccgaactcttcttccccagggctttcactgcccctctagccagtcccaccagccctcccccacgcagactgggggaagagactgaccttcgtggtggaagctcctcacggtgttggcccggctggccgggcgctcaggatactcaagaccagtgctgtggatctgctcttcctcctcctccccagactgaagccggtaaagatcccgcatgtagtccggaatgacggcactcttgctaggctgcgggcggcggcgcagcccaaacatctgcagaagtgtcgcctcgaagtcccgcaggagctcatggctctgccctgagcggcgtcctcccgcgtggccctgaatctcggcgacttttttcttccccgtctcaggtatcaaactagcatggctcgcgcctcctagcaggacttggcataataaaacgaccatcagcattcggttaccaggaatcatggtgtctctggggagggggaggggagtggaaggttaaagaataaacaaacaccaataaatagggagaaatagagatgtgtctgcatatgcatttagggctagaaatggaggggcaagatggaaagcaggtcagaaagatcaagtttgtgtcttctccctcacaccacccgcccacccaccagctgcagccatgcacggcctgaaagtaagaattgccctgtaattacttggtctaacttgtttacagtcaaataaccccaaatcagatagcctccatcctgttaatctttttttgtcctaactgctatctgggccatgatctcagcgtggcttcttgaaggataaacagttaacattgagggggtgaaaaggggtgggggagggagaattaaaatggcattgctctccactttagaccttcagcttctctcccttttcctccaccctcagagcccaactttcacaacttccagttggttcagagccagagggagggaaagtgagaggcaggggctgggcgaagacagagggcgacagggtccagaagccgagaaggtggtctgggagctaaccgggtggcttgagggcttattttattgtggccgatgagtttgaaatattcagccaaaagtgcctgatcgtgcccgctcatccccagggaaggggtgagagacgattccggagagacctctgtgagttttgacaagagagtgggaacgcgccacggagacactgggggctctcccagacaagttggataggggaagggagtggttagccctcaaggtacaaccccgggctttcatctctttagctccctcgcgctcccctttcttgcaacgctgagagggcgagtgcgcgctagcagcactttaaaaggaacccgtacgcttccagcgccccggctgccgggccaagaagggagcgacagtgctgccagggagcagagtgtggatattgtaaaggaggtccgacggaagggacagccggcgagcaggggtggtgagggcagagtgaattccggggagggggaaggaagaggtgtctactcactgacagaaaacaaggcatataataacagtccatgattcttgacagccaatcttgaacaaacttgctggaaaggctcagggaagctgcagcagtgcgttgctcgggatggcactacggaatggctcctaaaaggaatatttgaatataatgagactccaccgcagacaggctctgtttttcttccagcccctcggagtcacgtgagcgccgaggcccctcccgcggcaggcggcgaaagggcctgcgcgccctcccctcctccacagccccccgcccctcgcgggcccgcccctccaggcgaggccaacctccgcgcccgccgcccgagcctcagcggtccgggaggagctcccggcggcgctcggcagagccctcggccggtgccccgcggccgccgcgctcccagggctactggcgcagcgcacggagaacccggttctcggcgcggtgcgtcgtgctgggcccccgcgccgggccacctgaagccagaggatttggggcgcactgaagggactgcgtctcccagctcgaacccggcttaagtggggccgggagcgaggtcgggaaagtctcacccgcccaaagcctcaccaccgagaggcacttaaaaaggaaagcgcagagggaccctgcccacgcgcgtgtacacacacacccccccacacacacacaagcaaacacgagctccccgccacttcctccccagggtctcctcaaggccaaatattgctcccaatgacagccagtcaccccttggcgaacgcctgctaaggctccgaagagccgggccaccgatctagctcccggctgaaagcagccgaccttgtcacgcgcggggccgggaatgggagggagggtgttagagggtgatcgctgtgggaaagtgagagggagcggctgttagtcattgctccgggtccattaccgagaatccccaaacctagtccgccgctgcgtggcccctctccccatgcaaagcagacccccgaagaagccatgccaggctgagggacagacgccggggctcgaagctccgggcagattcagaaagaggcgtcgctgcagaaaggacgcatcacagttttcagatcttaatgtggccgaggttttacaactcccgacccggcgcagaaaggaaatcccaccatgttccccggagtcgagaaaacggtgaacagctttcggcctgcgctcgacctctgcgtctgcgtctctctcgcctcggcttcccttattttttaaaccaccaccacactccttcccccgccacttccttcccccacccccttcctccgttgcaccagcagcagagtcgcacgcagcaaatactccttcaagaattttacctacctacagttcaagcagttactgggatgtcctgactaatcgaagatgctgccgcgcgcgtgggtcgctctgcgcaagggcctcttcgaaaacccgactaggcgcaactcagcgttcagcagggccgggagcgccaggtcgtccccggggcccgggccccatgactcctgccccaaagcccactccacccgacctccctttcctgaggctgttcccagttgctgctttgggtcgctccggagctcaagaactcgggttgcctgccgccccactctccacgcacatacttggttttcttcttaggggcattggcaggtagactttgaggaagaaaagtaaaggatcgaacagctcagccctccctcccgaccgtggatgcccggagtcgaccaacacctcaggtccgggtgcggaggccgcgggcgcccctgcgcgaccgtccgcgcccggcaagagccgcgcggctttcgcctttgctggtcccgcgccaccgctggggcgggctgcgaaagggttgggaagagcaaagggtttttttgttttgttttgagacgcagaagccctttaaaaagcccggcgaggagaggtccagaagtagagaaagcagacggaggcaagctgtgcccgcggggcaaagggacagtagaaggggcgggcgcccgggttccccggaaaaccctcggccccaaggaatctcctggggcgggagagcgcggttctaaaaccgagaggataggaaggggaagggggagttgtgtttcaatttcggattcaccaggattcatctctagtcacatttttcttctcaaatttttaaatcgaaaagataaaagccaaaagaactttcatccccagagctttttattgggggaaaggaatgtaactcggggtggttgtccttcacttccctactcgaatcttctcctaatgccgaaatgtgtttacaggtagcctcagtttaccaagtatgtatcttttgggggtttaacctctcacaaagccttcaactcacaaaccgcgatccttggaaaccatcctccaaagcagtgcttggaggcctctaaggcccccggaccaactcccgctggaagaagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccgtagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtccggggatcgcaacctccagcccgtgggcaacgcgttcagcccaagaccccacagtttttcccaacgacccccctaccaagggcttctcttgtttctgctctcctgccccgcacttcccaaaggtgagaatctcccagggactgctggacagagaaggcctgggcaggggcagtagccgatatttaaaggtctttcagcgccagcatccccacctccagcaccactattggaaaataattaggccaccttttgcctcggtcacagcctgtgaccagcttcttccccccaaggaggctcctagaccccctctgcctgtctcccctcaccaggtagccttgctcaccataggtccctgcagtagcgggctcgccagcagcagctcctggggacctctgaacggttgcagtgaacctgggcgagggccggggactgtggcgctgcaggctcgagatagcttggacgggaatcccatcggggagacaagctagatactcagccggagcagcagcggcgtctcaggctcgcgtccctcagctcggatgccacactcacctagcttccgggccgggctccgcgctccttccctccctccctcctcctctgccttctcgcatcttccttcctcctctttccctccctcgctttctttctttccttcctcctcctcttccccggcggcccctccctccttccctcctccctcgctcgcctccctttctggggatgggagccccgcccacatcctcccctccagccgcccgacctcgcctagcaggcccgggtcccggaagcccaggcagcgcccgagtccgcagctgccgtcggagctgggacgccgctgcctccagctctgggaagcggctggggctcacctggggaccacgtgcggaggtactagaaagcatgcaccgactagtcgccgtaccttccaaaaatacccatgggagtctgggcttccctgagtttagtgtaactgctgcccaaactgatgattaaaacactgagtaatcaccatttaccctgagtaattagagataatgaaacacctctaaaatcaggttatggagaaaggagctgttggatcggtttaaaaggtggccttccataaactgttaaaagatttccaaacgttgagaaacaggctgtgtgcagaactgtgtgccagagagagatacctcttgggctgttaaaaggtgaatttccttccaaaacattcttaaagtgcgttttgtagaacaccttggtgatgaccctgaggtagaccccagtaaatgagctcacttccctcctccccccaaggcctaaagacagaggtggcctgcagacaggctggggccacgttttttacagttagaaaaatctgtttctagctcagaagccgtcttaagaaccgacacagcagttatttttgttggtgttatggttgttgttgatttttttgttcatttttggtgtacctaagagtcctgacactctgtctttccaaggagataaccacagaagcagtaaccttttaggccacagggagacaagaaaagatgccccttggtctgtttttaaaggaagaggggagatgaggaattggccctttcatataaaaacattttagtaatcatattagcagggaggtggaatgtggtggcttttaaaccttcccaaacaggaactaatttcacacactgcctctgatggagctgtgagggagctatcagcctcatctctctgttttacaaacaaggaaaggaaggactaccaggttaaagggacttgcccagatctctgaagtaaatcacagcctctgctccagagctaatgcttcagggaggggttgaggctcatagcctgagctccaggtagccagaggagtgctggaagactgagcatttcctgtcctggatttctttccctgggacagacatgacactttactgtctctgcaaagcatttaggtctttacttaaacagatattggccctgggtggctcatctataaaaactttacgtttatacaccttcgatatttaaaaaacaagaactacttcctgtgtggaacacagattacaaagggtgggaaatatctgagatcagagaagcaactgtcagagcaaggccaagacatcctgccatattttccatctattaggcctaggtcttttggcctaatgcaccaaacaacagaaacaagctgtatggctttgggcaagtcttttcattcctatgagcctcagttttctcatctgcagaatgaaaggattgggccagatcatctgcatgctccctttatatttgaaaatgatttgattatttaattgtaattttagccaaagtccgtcttccttcattttaagtcactcctgagttcactttctctaagaaccactgattaaaacagggcagggcaataacaccaccccaaaaggaggacaaaatatacctgtagcttccaaatagtcaaaatcacaattaattattaaaaataataacagaa

SEQ ID NO: 15200 - DNA, 63804 bp, Human
  misc_feature (1)...(63804): n = A,T,C or G
gagacggaggttgcagtgagccaagattgtgccactgcactccagcctgggcaacagagtgagactccatctcaaacaaacaaacaaacaaacaaacaaaaaactggactaggcgtggtggcggtttgggagactgaggctggaggattgcctgaggccagcagtttgaggttacagtgaggtatgactgtgccactgcactccaacctgggtaagaccctatctctgaaaaacaaacaagcaaaccccagaactctggctgcaaaagtagtacatatttctttgaaggaaaaaaaggaaaacttgataatcctaccacccaaagatgtttttaaatcacttatgtggtactcagttatgtgccatgcactgtccaagtgcttacaaatattatactaactccctttgtgtttataacaactgtctgaagtcagtagactcattttccagttttccagtttaggaaactgatattacaccttttctacagatggggaaacttgcccagggtgcccaggcagtccgcagaaccatgctttgaatcagggcagtgtggttccagggtcctgtacagatcaaacaccctgactctgccattccatcagatacatgattcatattttggtgtatttgcctccaatcttgagcaaagtgggttgtccctgtacatactttgtgtaatcttttagcttaacaggtgtcatgaacacttccgtatcataaatctttcccagcatgatttttattatctatttaatatttctcatattcaatgtagaacaatgcacttaaccaatttctcatttttgtaataattttcttcccattttcccctgtaataacactgctgagatatatatttttttcttcttttttttactgttctgaagatactctggcagaaatgtatgttcctcaggctaaatcttttcacacatccacaatcattttatcataaattctagagctggaaacgctgagtctaatgttttatatatatatatatatatgttatatatctgtcacccaggctggagtgcagtgtggtgtgatctcagctcactgcaacctccgcctcccgggttcaagccattctcctgcctcagtctcccaagtatctgggactacaggcgcgcgccaccacaaccggctaatttttgtaattttagtagaggcggggtttcaccttgttggccaggctggtctcgaactgctgacctcaagtgagccgcccgcctcggcctcccaaagtgctgggattacaggcgtgagccaccgcgcccggactgttatatattttaaaggcttctgatccatatcgccaaacagtcctctggatcgatttgcatctgtatccgctgctccatctgcagtatacggacatgctccacttcacccacactgggtcattaaaagaacaaacaaaaataagaacttgatcgatttgggattttaaatggaaatgcactaaaaattccttaattccaccattcaccgtctaccatagaggaacagcccatctgcacggagagacagctacgtaattcactgcagcattataatactgaaaaattaaaatgaacgaaatgttccataaccgacgaacggccgaatgaccggcgtctccactccgcggaacgttctgcgagcgctaaggggatggcgggagtgcatgatttggagcgggcggtgagaaaagcaagctcccgccgcctctccgttttggcaacccggctgacggtcgtttcggcttctggggccagccgtcggtctgggcgagggacatagatccggattcgcatcctgactggccaaccaacgctggccgaggtgaccactctcctcggcatccgcacctgccctccaaggcgtcagagaggccggacccttgggtgctagggctcgtgagcgccggggccaagtttccgagtgccgctctcagcagcgcaccaaccggaagtgatcgtgttgtggcggaaggaggagctttctgggagtagccggtgctgagagaaccgtggctggcaaagatgattcaggcgattctggttttcaacaaccatgggaagccacggctagtccgcttctaccagcgtttcgtgagtgcggcccggcttcaccacgccccttcagggcgcccactatgtcttccctcctctttggcctctcggcgcccgggggcaccgctctttggtcacctggggctcctgcaccgagcatgaccctcgccctacttaagcatttaatctaggcgcaggctggtgccaggccttctgtctcccgccctactgccccgctctcgctgacccttttcttgatcctggcatttctgtgccattttgtgacattttcccgtgggtctctgggaacgagatagaagcgacagtggggagtgtgcctcgatgagaacttgagtgattgaagtcacattctgtcatctttttggttgttgaccacagtttcatgaggaagaaatattaagtttctgaaagtttttgttatagccagaactggaaaagttcttttttttttggaattattttgcttcagtgttggctgggactttccagagactagatacccttcactcttagggttgaagaaaatcagtttaaaagtggaaaaatgatgagaaattataaatgctgccgcataagggctcaataagtgattacgtaaatttgaattttcccaacacgttcctttgcaaacacataaacatcagtatttgcttcctgtcttcgaagattatatttcttcatggcagggtttcaaaatgttacataattgggggactggtggaactgaagaggggaaagagccagaaaacgtgttcaggcttcagctccaccttttctactcttgcgtctgttgacaagttaataaacccttttcagacttttattgtcttttgtcaattagaaatgaaaaaataattttactccttcataagatttttaaagctagattacattttattaagtagattacatcgaggtaaaaatatgagtattcaggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccaagcgcggtggcgggcacctccaagtcccagctactcaggaggctgaggcaggagaatggcgtgagcccgggaggcggagcttgcagtgagccaagatagcgccactgcactccagcctgggcgaaagagcgagactccatcacacacacacacaaaaaagtatatatatatatgtatgtatatgagtattcagcgtaactatttgtatttgcatttgtgtgtatgcaaatttcccccctagtttttttctaacagggttactgagataaaactaacatgccatactgtttacttatttattttatgttatttacttatagagacggggtctttctatgttgcccaggctggtcttgaactcctgggctcaagcaatccaccggactcagcctcccaaagtgctgggattacaggcatgagccactgtgtccggccccagtttacttatttaaaggggacaattcagtgttttttagcatgttcacagaagctgtgtaaccatcaccacaatcaattttagatcattttcatcaccccaaaaagaaacctctgcccattagcagtcactccctatttctccatgactctcccagccccagagagtttctttccctctaaatttgccagttccagaatggcaaatggaatttgcctattccgttgcctataaatggaatcataaataagtggttttttgtgtgtctgccatgtttcatgtagtataatgttttcaagattcatccatgttgtagcatgtatctgatgttcttcatttcttttattgctgaataatattccattatatggatatgccatattttgattgtcaatttataagttgatatttctgctttttggctcttctaattaatgctgctatgaacattcttgtgcaagtttttatgtggacttatgacttcatttctcttggttatatacctaggagtagaattgctggatcatatggtaactgtggtgaacattttgagaaactgcaaactatttgacaaattttccaagtggctgcaccattttacatttccatcagcaatgtataatgattccagtttcttcacatccctgccattcgttatttatttatttatttttggttaaagacattttagtgggtgtaaagtggtatctcactgtggcttttttttttccccccgagactgaatctcactctatctcccaggctgcagtggcgtgatctcggttcactgtaacctctgcctcccgggttcaagtgattctcctgcctcagtctcctgagtagctaggattacaggtgcccacgaccatgcctggctaatttttgtatttttagtagagatggggtttcgctgtgttggccaggctggtctcgaactcctgaccacaagtaatctgcccgtcttggcctcccaaagtgcagggattacaggcgtgagccaccgcacccagctcattgtggttttgatttcagtttccaaaatgactaatgatgttgagcatcttttcatgtgcttattgcccattcgtgtatctttggatcataggatttttataagacctcatgagctcatggatgaaagtaccttgaaaactacagagtactaaaaagatatgaggggttattaaaatcactgaggcatgtaagcaattggtagtttacctttttattgaactagaaattaggtagcctcatcatttcgtaccacttccccactgctgccacttcccccagagtcagataaaaggctttagttcaaaagatgtctttgtcagttttaaaaagtgctgatgcttagcatgttttgtattttgcatatatagagttcgtctcctacagcatcctgtcatctgtgagctttgtttgttctttaaatggaaatgaggaaaatagtgattaatttactcaaatttgtagtgaccaatgattagcaagttttcattcagtcagtaaatactgtgagccattccatacccatgtgagtcaaagtaatttccccacaattacgttttcccttttttcccctctctgtttcttttaaataaccatttcaaagctaaattcagggctatagaaagaaagggattaaaattacttgaacctattttctaactcttggggcaagtccaatttgaaggttttcttatgattcgttactcaaagtgtggtccccagaccagcagaaatgttattgcctgggtgcttactagacttgcatctcaggacttaacctatacctgctaaatccgaatctgtattttaacagcattcacagctgattcattgcaaatgaagatttgagaagcaatgctctagagctttaagttattatctgtcttaattgctggtttctccctctcttacccttttaaccatacttcttctgaaactcatatgtataattagaaatcaaaggtgagttatcaaagtgatttcatcagagttgagctttcttatgcacgtagtaagtgaaaaaataaggccagacatggtggctcacacctgtaatcccagcactttgggaggccaaagcaggtggatcacttgaggtcaggagttcaagaccagcctgaccaacatggtgaaaccccatctctactataaatacaaaaattagccgggcatggtggcacatacctgtaatctcagccactggggaggctgaggcaggagaatcgcttgaacccggaggtggaggttgcaatgagctgtgatcacaccactgcctgggcaacagaacaagactctgtctaaaaataataataatacattttatttgtaactgttcaaaattttaatctgtaatctatttttctcaataatactttgttggtgagtaacacagcatcttatatgtagtatctatattaccagtacaaaagatggcagctgtatttgccaatataactttttaaaacatttacatgattacttcttgacctttttttttttttttttttttttttgagatggagtctcactctgtcgcccatgctggagtgcagtggcgtgatctcggctcactgtaacctccgcttcctgggttcaagcagttctcctgcctcagcctcccgagtagctgggattacaggcatgcgccaccacgcccagctaattgtttttttgttttattttgttttgtttttttttgtatttttagtagagatggggtttcaccatattggtcaggctggtctcgaactcctgaccttgtgatctgcctcctaaagtgctggaatttcaggcgtgagccactgtgcctggcccacatcttgaccttcttaaaatgttagacctgttgagatttattatatctttgtcatagatgttttccaggggaagacaaaatatttcaggatcaggccttccagttattctctgactttgtatgagagtttatcaatgttccttttcttgtttaaatatcagcttacctataggacagtaatggttagtgacttagatatttaggtaaatataccctatcttaattcctgtatcagagcattgtcacccatctttcatagattcactcctattttttctcatcatttttatcatttctagaaacaagtactaaatgtttagatgttcccagcttagaaacacttcttcccttgtccatccccatggatgggatgtagtttttcaggcttgcccactgattcacttatctttttgtttcatagccagaagaaattcaacagcagattgttcgagagactttccatctagtcctcaagcgggatgacaacatctgtaacttcttggagggtggaaggtaaactgtcagcttcatttttctccccatatatccacttgtgagtggccttcattattgcatcttctgacagtactcaagtgtcaggtgggtacttgatgcaactttagctggtctcaccatgatctgctcagggagagacacaattctctttggggcgcagttcaattattgtgcttctgatattgctcatttagatgattgatccccgggaggataggcaggagaagaggtgaggtaaggtggctttaggtacctctgccaaacttggttgccattcacctagtaagaatggcctgcttctagcgtttggccttctcctttccagtgggtcctttctcattctttggcacaaggtttctttttgatgtgtttaattaagctgtgggcatttaaatgtttcccatcttctgcagtttgattggtggctctgactacaaactgatctaccggcactatgctaccctctactttgtattttgtgtggattcctcagagagtgaacttggaatcttggacctcatccaggtatgtgtagtcagctaatgatggcagcagctttagagagtttccacgggatttttgagtaaccagcctgtagaaccttgtgtccatctccttattgatactagtaaaagttgccagatgtccaccagatggtgctctgggagagctcctgagaaaccctcagcacttttagatttattggtttctatctagcccttgcactgcccttggttttcatttacaaatttatactttggccgggtgtggtggcccacagtctgcttacagattgtctttattaccttcatgaaaactgagatgtgtagggaccctagcttgggaactatttatttagcattatttcatcgttttatatgtgagattctagatgagcttcttttaagtacttgaataagcccataggtagaaagcactcaaatagatgctacattgaaaacttaagtaacaacaattgtggaaaagaaaattctatagctataaaatgtaaactttaaatgcttacaacaggccagacatgtacattttacagctatagaattttcttttccacctatgggcttataggctcatgcctataatcccagcactttgggaggccaaggcgggcggatcacttgaggtcaggattttgagaccaacctggccaatgtggtgaaaacccatctctactaaaaatacaaaaattatccaggcatggtggtgtgcacctgcagtcccagctactcaggtggctgaagcaggagaattatttgaacctgggatgtggaggttgcagtgagccgagatcatgccactgcactccagcctgggcaacagagtgagactccgtctcaaaaaaataataaattaaaaataaataggccgggtgcggtggctcatgcctgtaatctcagcattttgggaggccgaggcagatggatcaagagttcaagaccagcctgaccaatgtggtgaaacccggtctctactaaaaatacaagaattagccgggcgtagtggcacgtgccagtaatcccagctactcgggaggctggggcaggagacttgcttgaacccgggaggcagaggttgcagtgagccgagatcgcaccactgcactccagcctgggtgacagggcgagactccgtctcaaaaaaaaaataataataaaaataaatacataaataaatgcttagaacaaaatttgttttcttaagataaaagtttaaaagctaaatatatcttggaacaaataaattgaaattttgaatatatagttttgtaggataattaaaaatttcatacgtcgtattcacttatacataaaaatataaataaagatgaacccatctaaaacagatgcatctcggagataatttttaaatactttcttaaaacctgagtcagattggacattgataatcagcataatagaaagagctcaaggcggggtgcagtggctcacacctgtaatcccagcactttgggaggccaaggtgggtggatcacttgaggccaggaatttgagaccaacgtggtcagcatggtaaaaccatgtctctactaaaaatacaaaaaattagctgggcctggtggcatatgcctgtactcccagctacttgggaggttgaggtgggagaatcgcatgaacccaggaggcggaggttgcagtgagccaagattgtgccactccactccagcctgggcaacagagtgagaccctgtctcaaaaaaagaaaaaaagctcaagatctagcatcagaaaatctgggtttgggtcatgaatctaccatctgaaaagtgatattaggttgtagaattcaaatgtgagaatgtgctttatagtactgttaactgtatgtagcaggctatagaaatgtgtacataatacgagtttatttgaaaattaaggaaatatagtgataatgtattttaaaaattgggatggagtgcttgcctcagcagcatatattctaaaagtgtaccagtgcagaaaagattagcattgccactatgcaaggatgacatgcaaattggtgaagcattccatattataaaaaataaagaaaattttttaaaagagaaaaaaaaattgggccacagttattagagaaaatggaccttggagatttgtattaacaatacaaaaagactaactttataactttttttacttttttatttatttattttttttgacatggagtcttgctctgttgccagtctagagtgcagtggcacgatctcagctcaccacaacctccgactccctggttcaagcgattctcctgccttactcagcctctcgagtagctgggattacaggcacatgcccagctaatttttgtagttttagtagcgacagggtttcaccatgttggccaagatggtctcgatatcctgaccttgtgatccgcccgcctcggcctcccaaagtgctgggattacaggtgtgaaccactgcgcccggcctctaactttataatttaatagacacttattaaatatttagtgtacattgtacattggatttggtaagatcagataagtaaaatgtaaaaataataggaactaaaaagtttgattttttttttttttttttttttgagacaaggtcttgctctcaaactgtagtgcagtagtgtgatcacagctcactgcagcctccatctcccaggctcaacccatcctcctacctcagtctcctgagtaatggggcctacaggcatgcgtcaccacatctggctaattttttgaattttttagagatgaagtctcaccatgttgtccaggctggtctcgaacatctcagctcaggcagtcttcccactttggcctcccaaattgctgggattacaggtgtgaaccactggacccatctgatctttgaaaagacaataaaaattaataaatagttggcctaattgatataaagaagatagaagtcagaaatagaaaacattgttttaaagggatgatatatacatagttatactaccaatatatttgaaatagccgactacaaaaataactgctctggcctggggcagtggcacatgcctgtaatcctagcactttgggaggccaaggagggtggatcacttgagaccaggagtttgagaccagcctgaccaacatggtgaaacttcgtctctactaaaaatagaaaaattagctgggcatggtggcacatgcctgtaatcccagctgcttggctgtttgggtagccaaggcatgagaatcacctgaacctgggaggcagaggttgcagtgagctgagatcacaccattacactccagcctgggcaatagagcgagactctatctcaaaaaaaaaaacaagaacaaaaaactgcccaaatgaggtcaacataaaggcactgaaataatattaggatgaaataatagatgttaaaaaaagaactgactccctaatggggtcacagtagaattttttaaagttgaagtacattaaaacctggatgttacattaagttattttttaaaacttagaacaaggaatcctactacctaagcgcattttatggaataaattggttatcatccaaaaacctgactctaaaaaggaagatgggccaggcacagcggctcacgcctgtgatcccagcactttgggggccgaggcaggaggatcacgaggtcaggagttcgagaccagccaggccaatatggtgaaaccttgtctctactaaaaatacaaaaaaaattagctgggtgtggtggcatgcgcctgtagtcccagctacacgggaggctgaggcagaagaatcgcttgagctgggaggcggaggttgcagtgagccgagattgcgccactgcactccagcctgggtgatagagtgagactctatctcaaaaaaaaaaaaaaaggggaagatgttcgtcaaatattgcgtattagtactggtacaaaattacttactaagtaaaatcttagccgacaatcagttgaaccaagggattgtgagacctgccttttttttctttttgactctgccattaacaagcagtgtgaccttaaacaaatcatctaggctttattggccttaagggtttttgtttgttttgcattttgtctcttctgtgtgttgagtggtttttttttaatctacaaagatactagatattcttttctagccctaaaattatttctttagcaggaaaactgcatactattaaatagaagaattatacattgtgtccaaatagtatttatcccaagaatgcaagtcagtataacaaagaaaaattaatagtctattatagcagtaagaaaaactaatataataaaaattagtagttgctgagaggagcgattatacaaattatattaaatacactcaaactggaataagaagcatttttgattaaaagtacacatttattaatgtaactgtttactttctgaagaaatgaatatagttatgtggttcagaattcagaggcacactatgagtatacaggttgaatatccctttgaaatgtttgggaccagaagtgttttggattttggactttttcagatttggggatatttgcattatacttatcctaaatctgaaagtccaaaacctgaaatgaccaataagcatttcctttgagcatcatgttggcactcaaaaattttggattttgcagtgttttggatttcaggtttttggattttaagtgttcaacctgtatagtgaaaaatatccttcttcccctttccccttatcacctagtttactttccttgaagcaatcaattttagtttcaaaaccaagagccaagaaccagagccaatgttatctcaagggtgaaatctgtaggcatttatgaatgctcttgttgggtgtttcgtccaggtgcagtggctcatacctatagtcccaaccctttgggagcctgaggcaggaggatcacttgagctcaggagttcaagaccagcctgggcaacatagtgagacctagtctctataaaaaatcaggtggtgtgcccctgtggtcccagctactcatgtggctaaagcaggaggactgcttgagcccaaggggttgaggtttcagtgagccatattcacgccactacactccagcttgagtgacagagcgagattctgtctcaaaaaaaaaaaaggagtatcttttattgtttactctaattttaacaaacatttgtagtgagtgatacaaaaacaaatgaagaagtgacatagtaaagaaagaaagagaggtaagttatcaatgtaaggtggccggattatggacatagaaaatatttttaaagaattataagtaaggaaatgatatgagcaaaatgacagaatatgagataaagccaacaaaattaaatttcctatttctgagaaaacagctagaaaattcataattaaagaagtctcatttacagtaataataaaggatagttagtgcttgggaattaacttggtatggaatacttgacattgattccaataaaattataaaatcttaaagaaaaaacaaaggaatagttggaacaaatggagctacaaactctcccgttgttgggaagagtcaagcaaagatgacagtagtcccaaaggtggtgagcaatacatcaaatggaaaaccaagtataattccgtcaggagagtttatagaactcagtaaaggcaaaatttatcagggaaaaggagtggccaagaaatgcagaagtatatttctagggaaaaaggacagtgatgggagatttgctttactagttttcagaatgtataatagttacagatgaattgattatctagaaaatccaaatcagttggaaacaattggaactaataatagagttctgtaaggtgactaaatacaagtttaacatatggaaattagtagcttttggccaagcacagtgggtcacgccggtaatcccagtcctttgggaggccgaggcgggcagatcacttgaggtcaggagactttgagaccagcctagccaacatggagaaaccccgtctctactaaaaatacaaaaaattagccgagtgtggtggcacatgcctgtaatcgtagctactcaggaggctgaggtaggagaacctcttgaacccaggaggcgggggttgtggtgggctgaaattgtactctggcccgggcaacaagagcgaaactccgtctcaaaaaaaaaaaaaagagtaggtcaaagcagaacaggggggtaaaatgagtgttctcagctgattcaggtagcagagcacctaggataacagacactggatactttgtttctttttttaattaatatgaataaaactactctaagtctttatgcaaacggttgtgcctattctgctaaaaacagaatgcctggatcaaagggaattaatatttctaatcataatgcatgttgctagatagatatttagaaagagtatgttagccaggcacggtggctcacacctgtaaccacagcactttgggaggccgaggcgggcggatcacctgaggtcaggagttcaagaccagcctggctaacatggtgaaaccctgtctctactaaaaatccaaaaagttagccgggcgtggtggtatgcacctgtaatcccagctacttggggggttgaggcaggagaattgcttgaacccgggaggtggaggttgcagtaagctgagatcgtgccattgcgctccagcctgggcgacaacagtgagactccatctcaaaaaaaaaaaaaatgaagagtatgttaatttataatgcctctagtactatataagtttgtttccttgtaactccagtactgaaatgtgtcattttaaatttctacccaggtagaggtacctcacacatttgaatttttattaatcatgcttcctttttccacgtgtgggtttataattttgttttccatgtcagccttctataatataattgaaccacttgtccagtgaaatctagatcctggcttataatgtcatattttgtatattctaaggtgcgcattttatcacacttcaataactctaaaatctggatgtgtgttgtagtgggtgacatcttaacaattataattggcagcattttttttctttgttagataaaataatggtttgccttatcatcaacaaataagtaaatctgcgtattttgagtttattttaaaacttatttaactaattattgtctaacctattatattaagtgtaaataatccatttttacctccccttgttgaagaaactctaatgttgtatactgtattaagttcagagtgaaacccaagccccctattacagcctgtaaggcccaacatggtccggctcctttgcctctctctcccctcaccgtatacacgctcatcttcactatgctctaggcttcttgctgttcttcaaacacaagtacatttttgtgtctgggcctttatacttgttctgtcccctggaatactctcatctaggttccttcacttcagctctttcaatgactgacttttaccatttatgtctcagctcgaattttaatccttggacaaactttcttagcactctatctgaagtaacccctgtcacatcatcctgtttacttccttcagggcacttaggacaatagaaaatatcttgtttcatttgcctccttgttcttcccacacccagaatataaactggataagaacatgacttgttgactgtggtgtcaacaatggtatgttcctagcatgtagtcatcacacctttaacaatggttgaataaacatttaatacataattggatttagtttttacccttcatttcttcattttattctactgagttaactgagttacatttttctttctgcattactttcatgttgttttatttattgtttctttttttttttttgagacggagtcttgctctgttgcccaggctggagtgcggtggcgcaatcttggctcactgcaacctccgcctcctgggttcaagcgattctcctgcttcagcctcctgaataggtgggactataggcgcccaccaccgcacctggctaatttttgtatttttagtagagtcgggggtttcaccatgttgaccaggctggtctcaaactcctgacctcggcctcccaaagtgttgggattacaggcgtgagccactgcacctggctatttattgtttcaatatagtttcacatacctagtaagactagttatttcccctttgtggcagttgtttttcagtacgttctctgatatttataactatttgttcatccatatgtattcttgaataatttgtaaaggtcccaaaaagtccctgttggattataattataattagaagtgaattaacagttagcatttccctcttgtttattcatttcttcttttgaatcttacattaaagtttcttttatttattttttattttttggagacagagtctcacttcgtcacccagactccagtgaagtctagatcctggcttataatatcatattttatatatcctaaggtgcacattttatcacattctaataactctaaaatctgagatcatgccactgcacactgggcaacaagagtgagactccatctcaaaaaaaaaaaaaaaatgaagagtatgttaatttataatgcctccagtactatgtaagtttgttatataatttggagtctcactcttgtcgcccagagtgcggtggcgtgatctcagctcactgcaacctaactttgaggttaggagttcaagaccagcctggccaacatggtgaaactgtatctccactaaaaatgcaaaaaaattagccaggcgtggtgacgggtgcctgtagtcccagctactgaggaggctgaggcaggaaaatcacttgaacccaggaggtggaggttgcaaagagccgagattgtgccactgcactccaggctgggtgacaaagtgagaccccaaaaaataaaaattaataaaaattaaaagtaatcatactctatatatagttctaaaactttctttttcatcatttaagttctggagctttttccacatgcagttttttttgacggtgtgtgattttccataatatggatgtatcatcatctttgattcatcatgctacttgtgggcatctatgtttttcccaattacttgctattgtaaaggatgctgcaatgacatccttccacgtgcatctatatgcacatatgttaattcccatagtacagatttctcaattggaattgctgctttaataagggcatgtgttttttaaatggatagatactgctgaattgcctccaaacaaaggctttgcctttgatacttgtactaatggaatgtaataagaatgtatctgtttacccataacctcactgacttttgaatattaagaatattttcacactgggtgcaatggctcacgcctgtaataccaatactttgggaggccaaagcaggaggatcgcttaagccctggagtttgagaccttcctgggcagcatagtgagactttgtctctacgaaaaaattagcctggctgggtgcggcggcccacgcccgtaatcccaacgctttgggaggctgaggcaggcagatcacttgaggtcaggagttggagcagcctggctaacatggtgaaacctcgtctctactaaaagtacaaaaattagctgggccattgtgcgggacgtctgtaatcccagctgctcaggaggctgaggcgggagaatcacttgaacctgggaggcggaggttgcagcgagccgagatcatgccactgcactccagcctgggtgacagagcgagagaccctgtatcaaaacaaacaaagaaacagcaacaacaacaaaaattagcctcgggtggtagcatgcatctgtgattctcagctacttgggaggctgaggttgaaggattgcttgagcccaggagatcagggctgcagtgagctatgattataccactgcactccagcctgcatgacagaccaagaccttgtctcaaaaataagataaaaataagaatattttcaaatgtttgccaatctgatgggtgaaaaaatgcaaattcattgttttcactagagtttccctgaatagtggtgaggctgcgtatctttggtatttggaaatgtctacgatatttgtccacttttcaaaaggctcatttgttttgtttgtttgtaagttagattttttcctaattgtatgcatattctttttttgttatatttattgcaaatattttctcctactccattggtctttttgctttatgtaggtacatctggaagttgttttcttcatagctcccaaggtatgaaaatattctcctacagttttgctgttgttttttttttcctttggagaaaaccatttttattatcatcaccacccagcttatttgtgctggattatgtaccagtggcaagatcttctaacgaacatctgcataacatttattttatgttttaaaagatgaaaataactgtacaaggttaagtacaaaagtacacaagataacagacacaaaaaaatgcatgtatgagatttcattctacctacagcactttatgttcaaaaagtagaattcacgaaccaaaaaatattgtccttctatagtcctgtcaggtttagtgaaagcgagtctaacatgattacaacacctatatcactgatctgatatttatgaaaaaaatcttatttttcaataaattaaagccaatgcaaatgggaatagcatttcagttttttggtgtttttcttttttttaattttttttattttgagacagagtctcactctgttgcccagactggagtacagtggcatgatcttggttcaccgtgacctccacctctcaggttcaagcaattcttgtgcctcagccacctgagtagctgggggttttcaccatgttgctcaggctggtcttaaactcctggcctcaagtgatccacctgcctcgccctcccaaagtgctgggattacaggcatgagccaccgcgcccggccatgtttcaggtttataaaatagagatatgaacatggatggtggtgatggttgcacattatgaacgttatcgaatgctactgaattgtacacttaaaaaatggctatgatggtaaattttatgttacgtgtattttaccacagcttaaaaaaagagagaggaagaaaagccagtgcaacaccctacaaactggaacactagctctttgggaacaaggacctgacatcagaacaagaaggctataagttcccaaaccttaaaagtatgatctttttcaaactgcatccatttctcacgttgaagatgtgaaacccaatcccgttcctctttatgtgtgggtctgtgatcttgccttttcatactgagcatctaaatttctaaatacagtacttcctattgcttcaaagtcttctaactttcttcatcaagtgagctacatctagcttcatcttcactcttaatacccactaatttccatatatatgacattttggtccttgtttcccaaagtcatagttcagcagacggggagtttgcccagtttttcttgccttgacttttttcctcttgttcagcaaatttcactggatttccagctgctgtgtcataatccctaggtacagctgttctgtctctgccaaagctgttgcttgcagggctcccatttgagctgccatagctatctgagttactggcattcctgatgccaacagggcagcaacattgagaacaaaatctctagtaactggagctatttcttgtttttgtttttcaatgatttctttttcttttaaaaaattttttcccaacacccatcccaactatttctttttcttgctgttcttgtaatttctttgcctagtccatcctcccagctaaagcttcttatgcatcctttgctgtgcctctgcctctgaagagagatgaactggaaatctggcttaaacttctgctaaatcttagtttctcaatgctcttctttctctcttgtcttctgcttcctgtactacttctgcttctttcctatgcatgtcatatttatttatttacttatttttcacacgcaacacagatgtagtttttatcttgaacaggagcaagatctgatccatggttttctttctttcttttttttttctttcctttttggagacggcgtctcactctgttggccaggctggagtgcagtggtgtgacctcagctcactgaaacctccacctcctgggttcaagtgattctcctgcctcagcctcccaagtagctgggacctcagacatgcatcaccacgcctggctaatttttgcatttttagtagagacagggttttgccatgttggccaggttggtctcaaactcctgaatctcaggtgatctgcctgacttggcctcccaaagtgctgggattacaggtgtgaagcaccatgtccagcccatggttttcttttcctgcttctagatcatgatcgttcttctctctgcttctggattgagactacttcttttccctctactacgatgatgcctttcacgagacctgtatcttgagtgacttctgcttcttgatggctttctttgtgtttgtgtctgtcctcatcattttcagatgaatgtatttatttattgagacagcatgtcactctgttgcccaggctggagtgcagtggcacaatcacagctcactgtaacctctgtctccccggctcaagcttctcaccacagcctcccgagtagctggaatcacaggcacacaccaccacgcctggctaacttttgtgttttttatagagacagggctttgccatgttgctcaagctggtctcaaacttgtgagcccaagcaatttgcccaccttggccttccgaagtactgagactacagacgtgagtcactgcgcccagcccattttcagatgaatttagtccctctcttcctttatcagaataatgttctttgtcattatgctcctcagaagtgtatttcttagaggatttgttgtaggattcctgtcttcttgcctcatcatgaaataggcttattattttcctacctgagtctgcaatgtcttcagttcagcctctttgcccatcagcatgcgctttgtgttttcgtccttcgttttctttcttgttttctttctcttgaccttgattgtgatcttgaataatattttgagtaagaaaaacagatgcatctgacagttctttttccacccactatctggggatgtctttttctggggctagtccatcttgtcctggataactaccctatcttgagaacccagtcttagtttcatgaaacatctttaatgaaaacagccttttgggatggtgctgctgcaaactgtggtctggctctcctcgcatgtgctctggctgccgcagaacagagctcaggccgctagggggcacctccacgtgccgcttttagcagtaccagccacctcaaagctttgccacagactgaatagctccttccgggggcctggatggcacccaggggatctgccgttgcttttttaatttatttttttacatttagctcattaatatctgttagatatttttatgtctgcattgaaatatgtaactttatttttcccccaaaggataactgttccaacattatcagttagcttgtcttttccccaccaacttaaaatacgactcttatttttaaaattgcattttataaacatgtatgtttcagtaatttatattctgccccactgatctatattcccatcttagaattatacttttattttatttttaaaatttatttagagacaaggtcttggtatgtcactcaggctggaatgcagtggtgcaatgataattcactgcaaccttgaattcctgggctcaagcaatcctcccacctcagccttccaagtagctgggactacaggtgtgtgccactatgcctggctaatttttttatttttatttttttgtggagacgatgttttgctatgttgcccaggctggtctcaaactcctgggctcgagggatcttcctgtcttggctgcccaaagtgttgggattataggcatgagccacctcacccagccttagtattatactattttagttaacaaagctttacaatgaattttgatacctagaaagactgcacccaggtgaaataaacagccttgtttctcacacaaagcctgtttggtggtctcttcacatggacacgtgagacagatttcgctagggaagcaaataaccatggaggtgggcaagaaatatccatgattgtagagctttcaatcagccttttattcttgtaacaaatgaaaaacaaaggattatcagacatctgcggaaaacctctaacatagaagaaggagataaaatgaacaaacaataaaaagcaacttaaaaatggacaccatataaagaaaggaaaacagtttaaaaaaaaaaaaaacccaaaaccctattcttaagctacagagaaagcctggccaacatggtgaaaccctatctctactaaaaatacgaagtattttagccaggcatggtggcacatacctgtagtcccagctgctcaggaggctgaggcaggagaatcacctgcacccgggaggctgaggctgcagtgttctgagatcacaccacagcactccagcctgggtgacagagtgagaccttgtctcaaaaaaaaaaaaaaaaaaaaaagccacagagaaataagacatttattttaaataataataagacccatttattaattagaaataaaataagacccatttatgtcttattgctaaatgggtgctaaacaaaaacactcacagccttgttgctcacacaaaatgaacaaaatggtctcttagaaataaaaaatgagaggaaatggaaacaaacaaaaacccacttcaactgaagtattagaaaatcaagttaatcaattgtctcagaatgggcagagatggaaaatgggagagaaaagatgagaaaataagacagaggccgggcacagtggctcacgtctgtaaccccagcactttggtaggccaagacagggggatcacttaaggtcaggaattggatatcagcctggccaacatggtgaaacctcgtctctactaaaaatacaaaaattagccaggcgtggtggtgcatgcctgtaatcccagctactcaggaggctgaggcaggagaattgcttgaacccaggaggcagaggctgcagtgagccaagatcgtggcactgcacttcagcgtggacaacagagcgagagtctgtctcaaaaaaaaaaaaaaaagaagacagacagaggtccaatacttgaatataagcagctccaaaaagattgattaggaatgtggaaaggagggaattctcaacaaaataattcgataaaatttcccagaactgaaggacttgaactgcaggattataagggcttaccaagtacccagcatagtgattgagaaatagacccatttaactatgtgtccttatagtgaaatattctggcactgttaaaaatgtaaagatttatgaatggcactaatatgaaattattgtatgtggtttttggcatacatgtatatatctgttagatatgttatctgggagtagaattcctagatcatagagcatgcatacataatgtcatagttttccaaaatggttggtatctggcaaaatacagtgcactggttaccagtctcaagaaaggaatctaaatgctcttgcccattgcatcttggtatcagagtcggcaaggaaaaagtgcaaacactggataaagctttacttacatagagaagagacagagcaggatcagctccaatagtgtgcgttggttcctcatggcaagtgggtctgtctccccagcagccgctgcagggtggtttgcctatgagcacccatcttgtgctacagtggaacggtgtgcctggtctctgtcacttgctggcctcaagtaagacccattttcatgcagtgccgaacaattcatgacactgctgacaatgagattgtttaaatgaggtcattgtctgagagaaattaaacagttatagatagatacctaggttgtagttacatggtgtgttcattctgaaaattcattaaactgtgcccttgtcatttgtacacttttctgttatgttttattaaaagttaaaaggttctatagagaagtaagctcagggcttttaaaaaaaaattttaagttgtaaacacgtcaattaaatttattcataggaaggtattttgtaggctaaataactgaccaaaaaaattaaaaagggaagatgttttgaagttaattttggctgaaattaaaacacagctatgttaaccctgtaataatgaaaaattttttgtacatgtattcattgaggacatagtattgtaagtagttggtttttttaatttgttattcttttatgtaattttttttcttttttcttttttttttttgagagactctcactctgtcactcaggctggagtgcagtggtgcgatctctgcttatggcaacctccacctcaaatgattctcattcaagctattctcgtgcctcagcctcccaagtagctgggactataacaggctcgtgtcgccacacccagataatttttgtatttttagtagagatgggttttcgtcttgttagcaaggctggtcgtgagctcttggcctcaagtgatcctcctgccttgggctctcaaagtgctgagattgtaagtatgagccaccatgccctaccataaattagcatcttataaagggggaaagagccacatgtgtctgctggttgtgttgctatgctgaaaacaaggttttcctgtcctagattattccctctaaatcgagataagtagggtgatcagctaatgctggagacaaaaggtaggtgttttaatttttgagatttatcataaagtaaatagtattgtgacagccccttttactttcagatgtgacattgataaagctgtgaatgtgttcctatttctcttctttatctatttctccttgttttctaggtttttgtggaaactctggataagtgtttcgaaaatgtgtgtgaattggatttgatcttccatatggataaggtatattctcttgcagttctcttccaaactagggttactagaaaaccaagagccttgggcatctgtagccacctctacatcttcatattgtttcttgtttttttttactcttaagatagtcctagaacatgttttatttaatagatttaatagtttgggttttgttttgtttttgctaagatctactaacagttttaacgtgcataagattattactaggcctatatcgtggttcatctgttcacagactgatttcttgatataggagaatgatgtcactggctacttggccaaaggtgagataaatagttttatgctgattataaaattagtttcctagtcataggccagtgacaatgaaactttggaataatcatgacgcaggggctttgacttagatagtaaaatttatatctttcctaaagagtaatatagtgactaagagatctgtaatgtaattcaaggtcaggtgatattctataggaaggtagactatcagaggcagaattaaaatggccccaagtaggtgttctcagatttgttttgctaggataactgtgacatggcctatgtcctcatatgccaaattaaacttgggcaatagccagcaagggaataggaattgccatgtttattttattcaacttaccacatgctgtcccctgtgcagtttactggtgcgtctttggtttgcttggtcctggtttttcttcaactgattgttgtcattatgatccctggcccttggagagagatgattttttaggagactgctgctcattgctaagccatgatcctttattaaccttttcatcatgatgaagtaggagtttttagatccatcgttgctagcattgctgtctaaaggactttcttgttgtttttcaatagggtcttcagtcttagttgactctgttgaggttggcagatccccactttccaggctaatgtagtgaatgcattcttgagtttggatgacattagaatggagtaaagttttgtctctcaccatctgacatggctctgtgactctatcagcatcctagtgcaggaacatcatggaacccttttccttctttagatacttaactttggactccctgacaacctcacggggcttccagtatttactgatgcttttgagtcaccctccctttcatatgaaagggttgtatactttttggaaacttcagcgatctcttagcaccctttctttgcaagcacttagagttgttttgtacttttcatatgttaaagatttgctattttgcaacttctgtcaaggagagccatagctcaaatctagttcccttttgtactagaggaactagagtccctttcaagtattaaagagacttgaaaatatagggggaatggagaggtgccttctgtaggccttattgttatgattttaaaataatattgttaaatacaggccgggcgtcgtggctcacacctgtaatcccagcactttgggaggctgaggtgggcagatcacttcaggtcaggagtttaagaccagcctggccaacatggcaaaaccttgtctctactaaaagtacaaaaattagccaggcgtgatggtgcacgcttgtaatcccagctattcaggagaatcgcttgaacccgggaggcggaggttgcagtgagccgaggtcgcgccactgctctccagcctgggcaacagagcgagactgtgtctcaaaaaaaaaaaaacaaccaaattgttaaatacaaggtgttactttcgaagttaccacctagtgtgcaaagtgggttctttgaagatgccacctgttgctcaccaggctgcaaatgaatttcttaacatctcaggtgtagattcagggattcaaggatagattttactaggaaagggggagttttctttttttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgcgcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagcccatggaagaggtgtattgaggtgtctctgctggaatgactcccatcacccacctcctccaatgctgtcttttttatcaggcacctgtgagagtagctttgctagtggagagataggcagaatgcttagaaaccacgaaatctgtatttgtgtgccagctgcttatagatgttgtctaggggccgggtgcggtggctaacgcctataatcccagcactttgggaggcctgaggtcgggagttcgagaccagcctaaccaacatggagaaaccccgtctctactaaaaatgcaaaattagctgggcttggtggtgcatgcctataattccagctactcaggaggctgagacaggagaatcacttgaacccaggaggcagaggttgcagggagccgagatcatgccattgcacttcagcctgggcaacaagagcaaaactccatttcaaaaaaaaaaaaaaaggaagttgtctgggaatgccagctgcccaacacctggaaacttagggacctgtgggataatacacacctggagaagacagctgtaggtgctgtgggaagttgtgcttgggtgcagcccctctcactgggagaaggggtagcctcccaaccccctagtctaagctagttcattgtctaggcaacgtggagtatacctccatggtgactttttttttttttttttttttgagacggagtctcgctctgttgcccaggctggagtgcagttgtgtgatctcggctcactgcaacctctgcttcccgtgttcaagtgattctcctgtctcagcctccggagtagctgggactacaggtgcctgccaccatgcccggctaatttttgtatttttagtagagacagggtttcatcatatctgtcaggctggtctccaactcctgacctcaggtgatccacccacctcagtctcccaaagtgctggaattacaggcgtgagtgagccaccgcgcccagcctccaaggtgactttgaaagtcaacatttgttgttttgtgttttaccttctttgctccgtgttatttgtaagaatcacccattttgttacatgtggccttaggaagtttaatttcattgctgcataggatttcattatatgaatttatccattctatgactgatggaattagattgttttgagtttggagcttttatgaaatatgttgtcatgaatattcttgaaaatggatgctattgtacatttttgtacattttcttgaaacatctatttctcttaacagtgcaattcctgggtcataggtgaggcctctagaaggaagaaacaggcctctagaaggaagcacaaaagcaccagcagggctgcagcactggcaaaagaagtctgaggctcaaggcctctggactgtagaccatagtatctgccactttgttagataatgccagagtgattgtatccatttatacttctaccaatcgggggtgagtgttcccagtgctctgtatgctcaccaaaggtttatattctcagtgtggtaatcattagaactgttaactaaatatttacagttctttccccttcgagaaacatggtaaaattatactaatatgccttcctgaagttaggtgtagccatgtgacttgctttagctaatgaagtgtgagtggaagtgccatgtgtcacttctaggcaaaacttaggagccagtgctaatatatataataatggaatatatatatatattccatttgtggaagcatggacacacagccttccagggcctgggtccctaactgaggatgaggtagagcagtgctccccagtggacgcacagtggatgtgtgcatagtatgagagaaataaacttgttactttaagccatgaaatgttaaaattgttactgtgacttaaccaagcctgtcctgactgatggatatagaacttaatttttatccagctagtaggtatgtactggcatttcattgtcattccaattgcatttcttatgaagatgagcatcttttcttgtttattgcctattaggaggtcctctctagtgaaatgtttattcagggcctttgttctttcttctgtgaggttgtctgcctgtgatttaaaaacgtatttgtaaggaccgggcacagtggctaatgcctataatcccagcactttgggaggctgaggcgagtgggtcaacttaggtcaggagtttgagaacagcctggacaacatggtgaaaccttgtctctactaaaaatacaaaaattagctgggcgtggtggtgtgcctgtagtcccagctacttgagaggctgaggcaggagaatcacttgaacccggcagccgagatcacaccactgccctccaacctgggtgacagagcgagactccgtctcaaaaaaaaaaaatgtgttggtagaagttgtattgaatagaagtagtgacagtgggcatctgctctgattcctggtttcaaagggaagctttcatcctgtcaccatgaagtagagtatttgctataggtttttttggtaaagattgtcaggttaaggatgtttcttcctttctcttcctactaaggatttttaatcataaaaggatgttaaaatttatcaaaagctttttttccagttcctgaggtaatcatgatttttttgcatcatcattctaatactgttttgtaaacatctgtaaggatgcctgctaaagcagtaaagtaattccagttccagccattttattggatgtggcttttagaaggaaataaaaggccataaaaatgttgttcttcctcatatgtcttatcttcagataagttccataaagtattttgctgccactgcaaattttttttacagtttatgaaactatgtatttttgttgttcatgcagtattaggaaataactgttcatatctcctgagatttttgaaaacaagtgatgcaaggaatcagaatcctaccctattcagctttagaatgtctgaggcttccaataggtggcttccttttcataggatttcaagcttatctttgccctcatagagagcagttgctaattcaagtatagcttcttctgttgataatagaaaatgatctttttactaagataggcaaaagccttgtcctaagacaataggaacatcaccttgaactctgttctttttaactaaagaatctcttcaccttgaggtcagaaactctcatcagttcctaggtctttaagatcttcattagatagtcatggatagatgccccatcaccttaagcagatgtggccggagtagtaggcctgtgtaaagaccagctatgactgaattccttggctctgccaagttgtttattcctaatcttgtgatttcttgtttaacctcctaagttgtttttgtatactctttttatcactgcttctctctttttcacctcctctctctccttttcttcctgtgttaaaggagggtttatttcattccatttctagagccaagttatctttctgtctctccccgacacacaccataatgtcacttcttgcactggtctctaaggtgtccttagtgtttgttcttctgtgtctacacagaatgccctggtctcggagtgaatacagcccttcccatggctctactgccccactaactgtagttccatttccattgttctcatgcaaggtgaacttgaattcgtgggtgatttacgcccagtctttaattctactttctctgttctctttctagagtcccatagcctggttttcagtcctacccagaattcactgatgatttcccaattttcaaatcctgtggccgtttcctagtcatcaccttttttattgtttctgtggtatctgatactgttaacccttcagtggagcactctcttaatctttttccacctttctttctgtcatatagaaccctgctgatttctttcctattcttttcccactctatcaggaagttatgttgtcagtcatctctcacctctctcttctccctctcatatttctagcataaatctcatccatatttcatgttctaggtcttgaagcaaaacttgggtatttaaaaaaaaattttcatgctcacactattatctatgtaggtaattcccaaatgggtaattctagtcttgatgtatggctcgagtcctattcctgtatttccaacagcctgaaggcatttctccctaatgtcattctcacatctaaatttcttcttgccacgtatccagagccagcttcagcatatgtcttctgaaaaccatttctccctgcagcttcccttttccaggagtgttactaccatcctctgtcatctacattcaaaaccttttctccctcttcctcgctcccaaggtccagtcaatcactaaatctgttgcttttttctgtaatgtccttctttatatcttgttcttagattcaccaactattaacatttggcatacttgcttttatgtctatatacatatatactttttttcctgaacgattttgagaattagttgcagacatcataacttttcatccctaaatatgtcaataaatatctcctaagagcaaggatattcttatataatacattgtatgtaattctctaatgatgcacaacacaattaacatagttgggaaatttaacattaataaatattgttttccaatatatagttcatatttaagtttcccaattgtcccagaaatgtcctttagatctttttttaaatctcagtttcagttatgagtcaaacattgtctttagttgtcatgtctcttgattgtttctggcaggttttctaaccttattctctcttccttcttgttgatcccacatactgaaattagtttttctaatgtacttcttagactagccttgactccttggccggacacattcaaggctctccacaatttgtgcccatcctatcctggctttacttccgtaactactggccagacactttctgctctagccacagtggaccactcctacttattttgtagttcctgcctcaactctctgcctgaattgtcttttcatgtactaaatactgcctgtcattcaagtgctgctcaaatcctaccaccctaaagcttgccctcatggtctagcctattgtgatctctttgaaccaggtatagtattatttttatccttctgtgaccttaatttatgtacctttctatgttttccctgcttggttagactgccttatctttgtattcctcactgaatctagtgtggtaccttttactgactggggtaatcttcaggtgactgtcactaaagagttcccaggactctagtctcataaggttgctcatgatttaaactgttggaggctggagtaaggtctgatttcatagtctctggggtaaccatcagctctcctggctgtgccatttagagcctagggtacttggttcccttttgctttcagaaatccctaaacacagctcaacattatgactgagctgggtgttggtgttaattatggtgaattgaattttgttcaaagaaaactgtgtgggtgacctaacattctgatctaccagtatctaatagcaaagctggatttagaattcaattgggctttcaagatttggtcatcagagtcacaattcaatggctatgtcaagggaatttatccagcgctttatttttttttaaatagatttcaatttgcagtgggccctctcaagagaattgaaacatatgcttctgaatggtgctgaacccaagaaaacctcatagtatggaattttaaatctctgctaagcataggctgctaaaatggaaaaatgctgagagttcaaaattaactcgtgagcactaagatgaaaggatcataaacagtaatattgggttttgtttgccagatgtcccttctgtgaacagagcttgtgataacaaagctcattaatacctgccacaccctgtgacgttgaagcagatgtcctgactgcaggtctccaggaatggagggacaagtgagggacagacagtttgtgtttttgatgatgaaagaggagctatttggtctggaagaataaggtattctgtttgagttttagttcttgtaaaaggtgcgagttaacatacctgactatccctggctgcctctgtttctctatctggatgtgcctaagagaagaagagagctgagaccagccttgtgttccattgcatctataaagcccttctttactgatgcttgataggtaagaattttgtggcagaatttttttttttggcttaagtaataaggaaatttattatcttacatacagaaaggccagttgtagggcagagttaaagcgtggttaagacagacagttttatctgcagtttcactttctgtagttccagttatgcacagtcaaccatggtccaaaaatattaaatggaaaattctagaaataaacaatacgttttaaattgcatgccattctgagcagcatgatgaaatgttgctctgtcctgctccaggatgggaatcatcccctcatccattgtatccgtgctgtgtacactagctgcccactgcttacttagtagccatcttgactgtcacagtgtcacggtgcttgtgttcaggtaacctttattttacttcataatggccccaaagtgcaagagtaatgatgctggcatattgtcataattgtttttattattagttatcgttgttaatctcttactgtgcctaatttacaaattagactttatcctaggtatgtgtgtataggaaaaaataacgcatccactgggggtcttaggacatattctaggcaggtaaggggggactactgtactttctgtatgttatcttcaattcttagtgttggctgtagaatatttttttcagaggccaaaatcttattccctcagggtaacataaagacagagatcggctggtcatgatggctcatgcctgtaatcccagcactttgggagggccaaggcggacagatcacgaggtcaggagatcgagaccaacctggctaacacggtgaaaccctgtctctactaaaaaatacaaaaaattagctgggcatggtggcaggtgcctgtagtcctagctactctggaggctgaggcaggagaatggcatgaaccctggaggcggagcttgcagtgagccgagatcgcgccactgcactccagcctgggtgacagagcgagactccatctcagaaaaaaaaaaaaaaaaagatcagcaataatgatttcttaaatttctaaaatccctgtaatttgtttagaaaaaaaaagaaagaagggctgggcgcggtggctcgagcctgtaatcttagcactttgggaggtcaaggcgggtggctcacctgaggtcaggagttcgagaccagcctggccaacgtggtgaaactccgtctctactaaaaatacaaaaattacccaggcgtggtggcgtgcacctttaatcccagctacacgggagacgtgaggcaggagaattgcttgaacctgggaagtgtaggttgcagtgagccgaggtcgcgccactgcacaccagcctgggcgacagagcaggactccatctcaaaaaaaaaaaagaaagaaagaaaaggaaggaaggaaggaaggaaggaaaggaaggaaagaaggaaggaaggaaaggaaggaaaaaggaaggaaggaaaggaaggaaggaagaaaaagaaaagaaaaaaggaaagaaagaaaagaaaaaaaggaaggaaggagggaaaaagaaagaaagaaggaaagaaagaaagagaaaggaagcaaggagagagggaaggaaggaagaaaggaaggaaggaaggaaggacacttgggctggttgtggaggctcacgacgataatccccagcactttgggaggctgaggcgagaggatcacttgagcccaggagtttgagaacagcctgagcaataagtgagaccccatctctttaagtaaaaaagaaaaaaaaaaagaaaaaaacaaaagcaaggattgttccagactatactgaatatctgctgccatatacacactcgctttccttacttgaactttggattgcctcagtgcacaatctcattgattacctgctgcttcaagtttggtgtgttagtcattccttattactggttagtagaataacagtgtacacaaaacagcacaatttgacctttagagatattcatttgatatgcagccgttttcagtaaaacctagtgtttgtcaaggttgtagtcagtaaacaaagcttattacccatggtattacttggatatgttgcagataaaacgaattgtattttgctttggttgctgatttataggcaccctgaaaggctggaattgagattcaattttattgttcttgctattattccttatattgcagaagaggattagcctactctaagataagaagtagagtttctctttctttctttctttctttctttctttctttctttctctctctctctctctctctctctctctctctttctttctttctttctttctttctttctttctttctttttctttctttttttgagatggagtttcgctcttgttgcccaggttggagtgcaatgacgtgatctcggctcactgcaacctccacctcctgggttcaagcaattctcctgcatcagcctcctgcctagctgggattataggcgtgcgccaccacacccggctagttttgtatttttttttagtagagacggagtttctctatgttgatcaggctggtctcaaactcccaacctcaggtgatccgcctgtctcagcctcccaaagtgctgggattgcaggtgtgagccaccacacccagcaaagcagaatctcttgattcctaactaagaacccttttccaggcttgatttttgtatcaatcaaggtaggctaggtaatgcattactccaaaatcccaatggcttatgagagcaaggtttattttttcactcgtgctatgtggccattgtggtgtgtctgctgactgtagttcctctgaggtccaggctgatggaaatctcctcaacatatgcttctacctgggcatgtgtgtgttccggctcttgaagtgacacatcctcgtacactcacatttcagtgatcaaaatcagtcacatgctcccacccaagggatggggaaatgatcctattatgtgcccaagagggaggagaacctgaactagttgaatattaccaatgatgaccatggttttttcatggattttcttagaggaaaagttaatgtttgatttttattatcactttgtagaagggaagctagaaattttagtaacagaaaaatagaggagtgctctaataagaagaaaacatggttgaatcttaggaaaggtatcccacatggcagcttttcagtttctctgattattgggcatttatatcttctatacttcccaaatgaatttaagatgacttaaaataaaatttcttaacagaataaatggtttttatatgtgggaggcgagtgcctccctccttagaggctttctgcaaatcatttgtctttaccttggctctctgaccttgatgaagtactgatgtctgagagtgtttttgtcttttctctgattaccaaacaacaatcatttattaagcattcattaggaaaaagacactgcgctaaatatagagatacaaagatataaaactcaaattttctacctgtaagaagctcataaactaggcacggtggctcacacctgtaatcccagcactttgggaggccgaggtggatggatcacttgaggtcaggagttcaagaccagcctgaccaacatgttgaaaccctgtctctcctccaccgtgcccagccccagcccagtttttacttttgatgaagctttctctaaacttcggtattgtagttctccaaactgtttgtcttcttgctcatgctctcaagtttttaattctaactgtttctagtagattgtaaacgcctttggaatagtgtcagtatgtaatactttgttggttatccaaacaatacaggacagtcagagttgattagttgatgtgaaatagatatgtgtcccaattttgtgggtttctttttcttttcttttcttttctttttttttttttttaagacagagtcttactctgttgcccaggctggagtgcagtggcatgatcttggctcactgtaacctctgcctcccgggtttaagcaattctcatgcctcagcctcctgagtagctgggactacaggtgcgcaccaccacgcccagcgaatattttttttttttttttttttgagatggagtctcactctgtcatccaggctggagtgcagtggtgtgatcttggctcactgcaatctctgcctcctggattcaagcaattctcctgcctcagccttccgagtagctgggattacaggtgcgcaccaccatgcctggctaattttttgtatttttttagtagagacggggttgcaccatcttggccaggctagtcttgaacttctgacctcatgctctgtccacctcggcctcccaaagtgctgggattacaggcgtgagccaccacgcccagccctaatttttgtattttttagtagagacagggtttcgccatgttggccaacctggtctcaaattcctgacctcgagtgatccatcctcctcagcctcccaaagtgctaggattacaggcgtgagccactgcacccagccaaggcccattttttaaaaccaaattctaattagaccttgcctttgaaggttatgacttgtgcatactggctagtttcggggtgggctcacttttcactttgcctttgctcccttgggagaaacctctgggtgcactcaggaggaactaggaaccctgtgttcctcaagtgggattctgcatgaattgcctttgtgggcttctgactctaccagaattctaactgtgtaatttatgcaaccctcttaaagacctctttgtgcctcagttttcttcagttgtaaaacagggatgatatcacatttcattgattcttttttttttttttttttttttaaaggacatatcatatttattcatacacatgctggaattattggtgcagacatttaaatacattttctttgagaaagtcctttttttttttttttctgatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaatttttttttatttttagtagagacggggtttctccgtgttggtcaggctggtcttgaactcctgatctcaggtgatctgcccgccttggcctgccacagtgctgggattacagtcgtgagccaccacagctggcctgggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcagcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccctcattgattctttagactcactttttgggtaccatttataattttaacatctcaaatcaagatttttcttataatcaatggtatgtcatttttcttttgtagtagcacataaaaatagtatgttttacaatcagtgaagtcttagatttgatataatacagtaatatccaccattcaattatttgaggatcggaattagtgaataattgcttagttcaataaatggtgaatttgtctttatttttacttttttcctactagtctctctgcctcctatattgtgccttaagactatcctttacacaccttcctaatgatatatttaaaaatgtattttttactaactcccttgctgatgtatacccccagctgcagtgattcttaaggagaaggacatgcctcactcccctccaccaccttcctcaaaaccttatgatagttcagtgacactgagtgattgagggaagtgtgttatttaagtgaattttcatgaatttttttttaagttggggaccactgccaaaagggtgaagctgcagccccttcttatgtacaaagacctccatgagcatgcccagcctgcctgtctagcctcacctcttgctttgaactttacactccagtgatactgaactatttttgtaacttgtgtttagggatgttacagctttggaagtctttgagccagcatgtaaagggcgagcaggtggactggggcacagggctgttccatgggcagtgatttagaaggagcaggaactgtggggatggagatggtctccttagaaacagttttatgggatctaggtgtggcatttggactttttttctttttttgttttatggccaaattgtgcttcacttatctgcctgcctatgtggttgccttaggcagagtgatagaatcccagggtagagggcagggacttactctgtgttgctccagaagacacaggtaggatcgggggtggaaattatttgatgcttgttgtagctcagtacagttaaaaactctctgacagttgttgctgctcaacagcccactgagcagcttggaaacagtagtgagctctcttcatggaggcgaaggatctgtcaccagagtgaaggatctatactgttgcaggagccaaagaacagaatcctgcactgggaaagaggttggtcaagatgactttgattataactaccaaattaaccaacatccgagtacttactaagaactaggcacgtaatagatagctaagtgctttatatacagtgtctcatttatttcctacatcatcttttttaatctttagaataagcctggcagctaagaactctggttctccccattttacagatgaagaaactgaggtttattggtaggaagcctcagtttctctaaggtcacacagctggtaagtgatagagccacattcagatcctggactctgattatggacccgctccctctacactctgcaatgctgcctgtagtattcccgcctgctttgacatcctaaatgtggggaaatgtgtttgtgtcatgttttcttagcagataagcaaccaaggaaggatgaaattcaaaaggacaaggtctggatctttttctgtacttagcactgtgcttggcatttgggatcagcagtgcaaacaggtagtagccaaaggaggatgaaacactgggttagaaagaaaaagtcctgctagaacattaaaaaaaaaaaaaatgatttcacggagaaccctgactcataataggaactggtttttttaaaaaaggaagtaataatatgtagtgagtatactttactgcagtcaactatatatattcaaagagcataaaatatgaagccagtgagtgagtgatccttttattaattaaaaaagaagttgagttgggcgcggtggctcatgcctgtaatcccagcactttgggaggccgagttgggcagatcacaaggtcaggagttcaagatcagcctggccaacatagtgaaaccctatctctactaaaaatagaaaaattagccaggcgtggtggcacatgcctgtaatcatagttactcaggaggctgaggcaggagaattgcttgaacgcaggaggcggaggttgcagtgagctgagatcgcaccactgcactccagcctgggggacagagcaagactctgtctcaaaaaaaaaaaaagaagatgaattagtagagcatgaagaataatgaatgagttgctaggtaatttgccattccctctgcctggatgccttttcctccaattgccagttagttttaaggccacccttctctgaaataacatagtactttgtacttgggtcatggtatttatcacagacttccttttattatagttaattctgtacatgtttaatctttcttacttgattctaagctctttaaggacagggtccacatcttatcttcatttccttcttccagctcttaacaatctgtgatgttaagcatatttgaaaatagacattgttagagattatgttcttttagtgaaaaatcggccaggtgctgtaatcccagcactctgggaggttgaaacagaaggattgcttgagcccaggagtttgagatcagcctgggtaacatggtgaaaccctgtctctacaaaaaatacaaaaattagctgggtgtggtgatgcaggtctgtggtcccagctactctggaggctgaggtgggatcacttgagcctgggaggccatggctgcagtgagccatgatcacgcctctgctctgcagcttgagtgatagtgacagagcaagaccctgtctcaaaaaaaaaaaagaaaaaaatcagtgaatgccttgaacctaacacactgccttttatgtggtaggtacagtgggctcactgaaacattcaacttgttcaactctatccatttgtccaaaaacaaaaaggaaatgaaaaattctaaatacagtacgaatatgccctcaattctacttaattagtatatgtctggaatgagtgtgacatggaagatttgaatctgctcttctttgcctctgctctcatgtgcctgtgctcatgtgtatcgtagagtgcttagagtgattctaatgcttaaaacaaattttcaatctctgtggcccctaaaccagccagccgtttcatctgatgtgtaagacaaggctccactggattcattcattgcccactgaaacaatgtatgatcctgtgagtgaaagagagaaagaaatcaatggctagggattgaatgtcttgtggaattttatgacaagaagacatctagggaaaaccatggaaatgtccagtctgaagatcaaacagttcataaaagtgattcagaagacactaagagcaggtgaaagggaaaaacagaactttacaaagcaaagttgctttcttggcttgctttcttcagagctgcttaggaccagacagctctatgtgcctgagagttcctgaaggaatcttagcattaaaatacaatttaccatgaaatactatgcagccataaaaaaaggatgagttcatgtcctttgcagggacatggataaagctggaaaccaccattctcagcaaactaacacaagaacagaaaaccaaacacgacatgttttcactcataaatggcagttgaacaatgagaacacatgggcacagggaggggaccatcacacaacagcacctctcgggggtagggggctaggagaagggtagcattaggagaaatacctaatgtagatgaccagttgatgggtgcaacaaaccaccatggcacgtgtatagctatgtaaaaacctgcatgttctgcacatgtaccccagaacttaaagtataatttttttttaaaaaagtacaattcataggctgggcgcagtggctcatgcctgtaatcccagcactttgggaggccaaggtgggcagatcactaggtcaggagatcgagaccatcctggctaacatagtgaaacccccgtctctactaaaaatacaaaaaattagccgggcgtggtggtgggcgcctgtagttccagctacccaggaatctgaggcaagagaatcacttggacctgggaggtggaggttgcagtaagcctagatcgtgccactgcactccagcctgagcgacagagtgagactccatctaaagaaaaaaaaatacaattcattacttagatattaacaatgagctgcaaaaaaagcactccccccaaaaaaagcccaattacatttagaatattcttttttagaagtcatgggagtgtgtaatacgcttttaaagttttctgttaaaatgatttaatggtgatttaatgtctctttcatgcatattgttttgtctccctagctagaagtcaacttttcaatgaagtcaagtatgcctggtacttgttaatgtgttccatgttgttcactgtagttacacctacatagacatccagccaacagtcattgagtctaattaccatatgttcatttttaggtaaaagagatgcaagggaatgaggatagtcagtcctttgcttgtcttaaaacaccgataaaacattggactttggaatgaaagtacgagtaagagagaaaaaggcatatgtaccaggtcctcaatactactcataaagatatcttcttcctcttttcatttctttctaaaatgtataatatgggaactagagtctgactctgggccaagatgactctcagatgattttctcttcccgtcagtgctgagtcacctcagagcgtcgttaccctttggctcattaatagccaccatgcccccaagtatagacaagaaaatgatgcatttcccatctctcaacaatctcttccctacttattttctgaagccctttcctaggaattaatgaaaccagctatgccacgaaggagtagaaaaagctatcagcctgggaggccaaggcaggcggatcacaaggtcaggagatcgagaccatcctggctaacacggtgaaaccctgtctctactaaaaatacaaaaaattagccaggtgtggtggcgggtgcctgtagtcccagctactccggaggttgaggcaggagaatggcatgaacctgggaggcggagcctgcagtgagccaagatcacgccactgcactccagcctgggcgacagagcgagactctgtatcaaataaaaagaaaaagctatcagcactcagctttttatatagtagactagagtcttgtcagtgattaacaattctttttcaaaacttgagtgttgcagtattggcatcctcatgttttaatacaagcactgtgaccatgctcttttatatttgattagtgtttttgtcttctatgtataacacagttattttgagaaagactccacagtaggaatgtgagcctctgtcttttgtagcacaacaggcatttgccctacagtgcaagggacctggagagggattgatctagattagaggtttctatggattcgattaagcttgggatgtggcatgcattaacatgctgctagtgtctcaaaagattttacttatcctctctgcctgtgaaattttcggttagatggaatcctgccatcccaatacagaactgcattttattatagaaacagtattgttcatattaggtgtagtggcaggggtgctctctggtaccacattttgggtagctttatggatttaagtctgctttcatgagctgctagccttgaaaatcttacttattacctttatagaaaaatgcattgtaaatttaaatacttaaacatttggaacatgaccaatttaaggtttggagactgtgtttttactagagtaaaaggtaatttaaataccttgcttatgccttcttgtttattatcttcaggtaccagatcagtctgtttttaagtgatctctgttgacatgggattagattcagaactttctttgatttcagtgagaaacaaccagggatggaacccttgaagagcatggaatcctctgtccttccggagggttgttgcaactgacttgtccccacccctagtagttctagagctaggttcctgaggcacatctgtatccttgaagaaacacttttatttttcttcttagattcaattctgatatgaaactagcagactcattttaatctacttttttttttttttttttttttttttttgtaacagggtctcgccctgtctcccaggctggagtgcagtggtgcaatcactgaagtcttgacttccaggctcaagtgatcctcttacctcagcctaccgagtagctggaactacaggcttgtgccactatgcccagctagtttttaaactttttttttttagagagacagaggtctcactatgttgcccaggctggtcttgaactcctgggctcaagcaatcctccttcctaggcctcccaaaatgctgggaatacaggcatgagctgctatgcctggtcttaatctacttttgtctgcagaggttaactttgtgttgcagacagtaagtaggtccagttatagaagcaagtaccttcaagggatggaggatgaggtgatagcatcctagaaaagaaaaaatgaggccaggcgaggtggctcacacctgtaatcccagcactttgggaggctgaggtgggcggatcacctgagatcaggagtttgagaccagcctggccaacatggtgagaccccatttctaccaaaaaatacaaaaattagccaggtgtgctgggcgcagttgctcatacctgtaatcccagcactttgggaggccgaggcaggcggatcacaaggtcaggagatcgagaccatcctggctaacacagtgaaaccctgtctctactaaaaatacaaaaaattagctgggtgtggtggcacacgcctgtagtcccagctactcgggaggctgaggcaggagaattgcttgaacccgggaggcggatgttgcagtgagccgagatcgcaccactgcactccagcctgggccacagagcgagactccgtctcaaaaaaaaaagaaaaaaaattagccgggtgtggtggcatgtggcctgtagtcccagctactggggaggttaaggctgtaggatcgcttgaatctgggaggtggaggttgcaatgagccgagatcatgccactgtattccatcctgggcgacagagtgagaccatgtctcaagaaaaaaaaaaaataaagagacacagatgtccagaggtgttgggggagagtggagagactcgataacaggttagattgtctttagaggaattgacattttgactacagtactcattcctactcttgactattttcaggggttccaagagaaaaatttaaataggacagagctaaaaacaccgactttcactcactaaaatgttgtcataaatttatgtatcttgatcttggaaaacatcagtatctatgcctcattttaccttttaagatttcagatttatcacccgaagcattttctctattgccttccccttatatcaagatatcctgttggtttattggggttatcctaatctttatgtcagatgaaactcatcctggttgtaattatttttaggttgaattaccattggatttgccaagtactgaaaaatcagtagcacttttgtttaaactctgttaataaacacttctgagtgaattttgctagtgtcattatttcccatgcttgctgagtagaaggttgaattattattacttcataattcatatttgttcaatgcacactgtgtgaagctgagtttaggcctctcgaagacttagcctctttctttctgttcctgtggttttgaataccatttacatgactcacgtctcagattttctttccctaccagcctccctgtgttggtttgtgactttatctgtcagtgttctctcaggtatttacttagatttctgcaggcatcctcaaggtcagcgcatcagccaacttctgttgtttaacagaacccttctttgtgccctgactctatctccagttctttaggtacatgagttcagtgttgattcttgactgcttgctcccacacccatgcttggcagcctccaactttcttaagtcccatctatctccaatcagagaaatgttagccatctttcatggtcaacttcatattcagtggacaaggtctgaactgactagcaggactaacacgggcagctgttcgctcatccattgctcacttacacttgagtcattttgcttaccaaaggtcagttgtgatgtttccagatctctttatgccagtaaactggtactgtaattatgtaatttgattaaataatatacagattaaattatgagggagaaaagaaaattattctggctgtgcatggtggctcacgcctgtaatcctaggactttgggaggccggggtaggcagattgcctgagctcaggagttcaagaccagcctgggcaacatggtaaaacctcgtctctactaaaaatacaaaaaataagctgggcgtggtggcgggcgcctgtagtcccagctactcaggaggctgaggcaagagaatcgcttgagcctgggagacagaggctgcagtgagccgagatcgtgccactgcactccagctgggcaacagagtgagactgtttccaaaaaaaaaaagaaaagaaaattactctgtgaaaagtaagaggaatgctttggaaggacaagtactttaaaaaggaaatgaagctgaattaggtttgggcaagataactatggaagagtagaggtggaaggatcttaaaaatctaggattctgtacttactgtttcacagcagtttgagttctaactttaagaaactggaaattgtagatgatgcattctgggtgagttttttgcaataatggcaaaaaactctaatcagcagaagagatccttctaggttgggcacattggctcacacctgtaatcccaatgctttggaaggctgaggcgggaggatcccttgagctcaggagttcaagaccagcctgagcaatatagcaagacctcatctctacttagaaattaaaaaaaaaaagaaaaaaagctgggcatggtggcacatgcctataggcccagctactcatgagactgaggcaggaggattgctggagcccaggagttcaaggctgcagtgagctattatcatggcactgcactccagcctgggtgacagagcaagaccctgtctctaaaaaaagaaagaaagaaagaaggaaggaaggaaagaaggaaggaaggaaagaaaaaagtaaagaaagaaagagagagagagagaaagaaagaaagaaagaaagaaagaaagaaagaaagaaagaaagaaagaaagagaaagaaagaaagagggttttttggccctagccaaaagttcagtggctctcaaagttttgttgtttataacaatgatggtaggcttgaacattcacgggaaaagtcacagtaaaagtcagattaaccatatctttattactttagttttaaatgctatccatggactctcagttactgagggtgaggaaatcagtgttcgtattctacctccctcctttttcccctcttctcttcctagtttttgctagctggagttttatacatcatcaaagcatatagtattgacgatctgttgttaccctaatcctattttagtcttagacctacagttaagtagttttcagtgctcaccgtaagtttttgccgtagtttttttgtttttgtttttgtttttgtttctgagacggagtttcactcttgttgcccaggctggagtgcagtggcacgatcttggctcactgtaacctcctcctcctgggttcaggcgattctcctgccccagcctcccaagtagctagaattacaggcacatgccacttctgcccagctaacttttgtttgtttgtttttttctgagatagagtctcgctccatcacccaggctggagtacaatggtgcgatctcagctcactgcagcctccacctcccgggttcaagcaattctgcctcagcctcctgagtagctgggattacaggtgcatgccaccacaccaggttaattgtttgtatttttagtagagacagggtttcatcatgttggccaggctggtttcgaactcctgacctcaagtgatccccctgcctcgccctcccaaagtgctaggattactggcttgatcccatggtgcccagcctcattactgtattttatatgtgattcaagaaaattctttgtctttcaatgtggccaggaggcggaggttgcagtgacccaagattgcgccacagcactccagcctgagcgacagagccagaccctgtctcaaaaaaaaaaaaaaaaaaaaaaatcagacatctggcactgaaagaaaccattccgcttgaaaacaggtaaannnnnnnnnnnnnnnnnnnntccttttgtagattccttaagaaatacttggctgggtgtagtggctcatgcttgtaatcccagcactttgggaggccaaggcggacggatcacctgagtttgggagtttgagaccagcctgaccaacatggagaaaccccatctctacgaaaaatacaaaattagtcaggcgtggtggcacatgcctgtaatcccagctactcaggaggctgaagcaagagaatcgcttgaaccggggaggcagaggttgtggtgagcggagatcgcgccattgcactccagtctggataacaagagtgaaactctgtctcaaaaaaaaagaaaaaaagaaatacctgggaataatggtccccattctgttacccttgctggacagttgactgggtataaagtccttgagtcttctgggcacagtggcttacgcctgtaatcccagcactttgggaggccaaggtgggcggatcacaaggtcaagagatgcagaccatcctggccaacatggtaaaaccccgtctctactaaaaatacaaaaattagctgggcatggtggcgcatgcctatagtcccagctacttgggaggctgaggcaggagaatcgcttgaacccaggaggtggaggttgcactgagccgagatcgcgccactgcactccagcctggcaacagagcgagactccgtctcaaaaataaaaataaaaataaataaagtccttgagtcacactttctgtccttgagaattttgtaggtgttgttccattttctgttagcattaaatattaatgtggaaattttcattattttgtttctcttttaagtgatttgatctttttgcctggttgcaggaacccagaaaccttacctaaaggtgtatcttggtactgcctattctgaatttgtttcccctgggatacagtgtgacctttcagtgtgtagaccccaatcctcttatagttcagaaacaccttagattctatctttatgaacatatctttacatatttttcccattcatgttaaagttttcttttatgcaaatattacatctcctttgctgtcttttgtaactgtttcttctctatttcttttagccctttttggtttcattttttttttccatttctctccttttgttcctagtgtgtttttagcagtttcttctccctttgcttcttccagtttcaccttcatttctgtaacagtatttttcctttcacttctttcctcagttctgccagtatgcagcttgtcttctcttctcgtctccctacctctgctaaagttcttgtatttctgctttgagctctcatttcatagagacaactattttatcaagttttctttttttctttgtgtaaaatattttattaccattgtatctagtccatggaggcccttttccagtctgtggtcttagtctgccatttggttttcctatttctttcctaattttttctcgttgtatatttatatagatcctgtttagattttttgtatacttatctttaaataggcaagtttttcagggaccagctgttttgcaggatgtttgttggaggagctaccaaaactctgttctgggctagctacagttgttcccttgatttagggttctgggtgagtccgtttacccttagtctctagccagccaatcgagataggcaaggcgtctcttagcatctccacaatgcaaaggatgtcttctctactaccacagacaccacctctgtgaggcaaatgtagcttgcgtgatttctcatttagcctcaacttcaggtccaaggaagttcctgccttccaaaaacaaggaattaatttggtgctggagtgtgtcctttacccacaggaagtacatatttttgcagatctttctgagatcaccagcttccctgtcctctccctgtagcatcctttcttctttttcttctgtgaagcaaaggagtccctgcctgagctccctgcttttgacagctttttcacctgtttgggggtttggaattttggatatcctgtagttataacaaaaatggagtttgcatttttatttcttctttttgcatttggaacatattttgaacagcatttgaaaatgctgactttatgatgcagtgttaaataagaagttttaactgactttttctgttaaccagccactagtctccacgacatcatgtgttaggccttttactataccttctccagaaagcccccaccaccacactgttgtctatcttcgaagtccctaaagcccaaggaatatgctacttagatatatggaaagcctttcattcatttagcatgcctactctgagcgttgttctaggccttggagataaagcatggaagaattaatacaagatattgacacaccaaagacaagtcttaaatgatttcatgtggactaggggtcagggatgaatagagtggaagacatagtttgggattctgaggaagtatgatataaagggtagaacatgagctccggaatcagcaccattctgctgctaatatacatgacattgggatcattttattgccttttcctcatatataaaatgtatcaatttcttcatatataaagtgaagtcaggccaggcgtggtggctcacgcctgtaatctcagcactttgggaggccaaggcagggggatcatctgaggtcaggagttccagaccagcctggccaacatgaggaaaccccgactctactaaaaatataaaaattagctgggcatggtggcgggtgcctgtaatcccagctactcaggaggctgagttgggagaatcgcttgaacccaggaggcggaggttgcagtgagccaagttcacaccactgtactccagcctgggtgacagagtgagactcagcctcaaataataatagtaataataataataaagtgaagattatattacctaccttagatgaatgttgtaaaattaaggtaagttacataaagtacttggttcataatagatactcaacaagtactactttctacccacacagggattggctaaataaaaggaataaatactgaaagtgcaggtatagaggactatttctctccttttttgttaaattgtggtaaaatatgtaacatatagtttcctgtcttcaccatttttaagcttacagttctgtggcattaagtatatccacattgttgtgcagtcgccaccaccatccgtctccagagctcttcatcttgcaaaacagcacctctgtacacattaaacaatagccaccactgtcctcttccccctgcctcatggcagcccccgttccagtttctgtctctgaatttgactactctgggtacctcacaggagtggaatcacacagtcctcatccttttgtgtgtgggttgtttcacttatagtatcttcaaggttcatccgtgttacattgtgtctcagaattcccttcccttttacagcatctcaattcagatgaaaaaaaaaaaaagaattcttttcctttttaaggctgaataatattctgttgtatttctatggcacattttgttgatccagtcgtctgttcatggacacttgggctgcttccaccttttggctgttgtgaataatactgctatgaacatgggtgtacacattctcttcaagtctttactttcagttcttttgagtgtatatccaaaagtggaattgctgggccatatggtaattctgtttttaatctttttgaggaaccaccatactgttttcagaggcctatttcttgatggggaagtataaacagtggaattcccccagggaataattttaaaaccagtcttgtttaacattttgtaaattatctaaatatgagacttttaccattaaatcttcatttgcatatagctaatgaataattcatattgtataaaatgtaagaacacctcgtgagagtgtgtgtgtgcgtgtgtgtagacagaacagtggttaataaagctcaatgtgggcacacacgcaagggaatacatttgatttattatactctgtcctcaagatcagaagttccctgcacttactgagggcaaaatacagggagccaatgccagagaacttcagatgtcagaagtgcacagtgcccagatatgcagacacatctttcttcttgactctgcattgctgacagagtaaactggtggttgactctagactctggaccagtggttctcagctggggtgaatttgccccctggaacacatatgacaattctggagacatttttgattgtcaagctggaggagtagagaccagggatgctagagaacaggccacagtgacaggacagccccacagcagaggattatctggtcccagatgtcactagtacctaggctgagaagccctgctccagacccaaattaccttctcagccttgtcttagcctctctcctgcataaagaaagttgccatcccagccagacccaggagctccccatacctgcccatacaccagctgaattgctccttccaacatcttctacctgaaattctttcccctacctctctaatgtcagagcccagcttccatcctcccactgtctctgtgaagctctctgatctctctagccactgtaccctttcttctctgacttccccaggactatcccagtcatttggcacttagttaacaatagaaggttgtacttgctgtcttcccaacttgaccgaaagcaccttgagggccatttgatgtgatttggtttgaaatatggagtaccattccttatgaaccacagtgggcatctctgctttgacccacccagggctttctgtgacagctttcctaccacaaaggggtacagtagttgagtcacctccgtcccatcacagcagttaggtacactgagattcagctttgtttagatgactgctagctagatggaacctaagcccaaatgtgacccttatgcttagaaaggtgtttatgctgaatctgctttctaatctaagcagtaagaaatgaggtgaggagaggtgcaaaggaattgggctctatcttgctctgatcacgtcccttcagtggagcacaggctggaggatctgccttatagaaggtggaagacattcatttcagttgcttggacagggattattctgtcatagctggacctacttaatgacagtcagtgttgatgatggtaatattaataatgaaagccaccattccttacttagaacccagtgtgtcctgggcaccaggctaggtgctttacacacatttatctcatccagtcctcactgcaatcctggaaggaggctgaagcactttaaaggtcatttgcccagggccacccagctagcaagtagcagagccagaatttaaacaagagctgtcagactttgaagcctgtgctcatagctaccacctcgctgctgaggggagagattcgtgttgccatgtgccaagacctgggagagacccctcgttgtgtcactgggcaggggggtttgagtgtctgagttgtgagtcaggacaggtcatatctgaccactctgctgctgcaggaaaaggaaacctcgtgggttacactctgaccaccacagagtattctgactcctgatttttgcttcccttttaggtgcactacatcctccaggaggtggtgatgggtgggatggtgttggaaacaaacatgaatgaaatcgtggctcagattgaggctcaaaacaggctggagaaatccgaggtgagtaagcagctgtgctctagccctggctgggtagagaaaacctgggcagaggcaggagtgtgtacatgtgttggtttgtgttgctgtgaaacctcgggaaatgatactcatcttctttcttccttgagtccattgaaactcatggatttgaaggtcagccagccctgaaaattaaacaggtaacaagtttgaaatctcagattttcagggtagaagagcaaatagaaaagccagatggcagaggaaggcaaacagcttctggcttgggggttatggcccatgtttgtggtttgtaattcctcctttgaaagccactcgttccctggagggacccagaaccctcttccctagtccagtgtggtttcctagtttgtgtgctctaagagtctgatctcccagcagccatttctcgtggtgtctttcagacctcagagttgccaatttccttatttccagttagctttataaaaaactacagtagagtttgggctaggcttgaaaataacataccccagtccacccccacatggtgctgggcttgatagagatgttcacataaattctgtcctatccctctgaggtctcgccgtccccttcctcagccttcccagagcacagaggttacagacgtatactttcacatgcagaaatagcagaacaaattacctctttaattatctgagtgtcttaaagagcttctttgccttgtatacggaacttgatcttgcgaaaccaggaattcttctttctgtgaggactggcagtcctgtggaagaagcttttccagaccacagctattggtggcagctatagttcttttagaaatgtaggctgggaagattccaggaatagtaagtgagtcagaggcaagggggttggaaatgagaagaaatggagacttgctgggtgagggcagaagcagagttggtatccggaaagaaggcaataggggaaaaatgattgtgagagagttttcatccacttttgccgttccctccacgtgggggtgagcctgccaggtgggggttcactgtagatgtgcatactctttgcgttttgtcaccagctcttctttatctgtgataccccccaccttctcccagcttgttgccacatgacacttccaaagccagctcttttcatctcacattattagttggcaagcagttgccctagagctgtgactgtccttttccttttaagaacttcccggtgactttgcacgtttcaataagagtctttggtctcttgaggaaagggttttgttttgttttgtaaccagaaaagtgcccctgacaaatcaccttagattatttcagcatttattgggtacccaccatgtgccaggtactgtgagaggctggggctgtgaaactgtataggccacactccgcctctgaggagctggtagtctagtaggactgcaggctttggatccctgtgccaaaccccatctaacctcaagattgttttgttggctacttttgaggaataaggggggaaagttaaaacttcagttgtgtgtgctcagtttggaatttttctaggcatccttcacctgttattttgtttgtttgtttgtttgagacagagtctcactctgttgcccaggttggagtgcagtggcgtgatctcagctcaccgcaacctccgccttctgagttcaagcgattttcctgcctcagcctccctagtagctgggactacaggggcccgccaccactcctggccaatttttgtatttttggtagagatggggtttcaccatgttggccaggcctatctcgaactcctgacctcaggtgatccacccacctcggcctcccaaagtgctgggattacaggcgtgagccaccacacccatcctgcttgtttgtttttgtttttgctttttttttttttttttttttagcattaagcagataacagtgagaatttgtctcatactcgcctctcatttcttcttagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtcacaaatccagagccacatccctcttcttgagttcgtttgttacgtggtttaatgcattactgcaggacagcccttatgctagatttcctgggatagcctagattttgaatgttttgcctgccagaaaccaatggttttaaaaaatcattgagtggtcctacagattcaaagcgagcatccaaacatccctcacatggcctcttacaatgacataaaactgaagcccacttttttatttggaaaactcaatccctttggacaagccacaataatttttcattaactacttgaggttgcctgcaaattcagctagctttccagcctgctatcagcaaagccataaacatcttttttaaaaataggttaaggttggccaggtgcggtggctcacgcctgtaatcccagcactttgggaggccgaggcgggcagatcacgaggtcaggagatcgagaccatcctagctaacacagtgaaaacccatctctactaaaaatacaaaaaattggccagccgtggtagtggacacctgtagtcccagctactcaggaggctgcggcaggagaatggcatgaacccgggaggcagagcttgcagtgagccaagatcgcaccactacactccagcctgggcaacacagcaagactccgtctcaaaaaaaaaaaaaaaaaaaataggttaaggttgtatagaatactaggctttcctttttttgtgagatgggggtctcacactgtggctcaggctggagtgcagtggtgtgatcatggctcactgcagcctcgaagccccggggtcaagtgatcctctcacctcagcctcctaggtagctggaaccacaggcacgcaaccaccactcctgg

SEQ ID NO: 15201 - DNA, 33411 bp, Human
ttaagttcagtgtcattcttgttcacaactataaccccagagtctagaacagtgcatggtacgtaaaaaagcactcatatagtttttttttaatcttttaaaattattttaacagccttattttgagagagataacttttaaagaaaataaatgttccattatttttcattttcccataattaaataccaaggtaagtaatacatcactcctagacttatgggacccacactattacagccttcagagccttatactacagatttaaattaattaaacttaacctaatatcttcaaatacctccacaaatattatgaaaattaagtacaaacaagttgaaaatagctaagatttgtggaaaaaaattatttggttcaatctataggttcttcatggaattcactaacatttaaactatgccatctcctttatgtatatatttatacatatatgttcttcatttgtgtgattttaaagcactgtggaacattacacatggtagactactgatattatttcccacgatcaaagagtcacaggacttggagaaacctcagaaatcatctggttcccctactgatttttatataaatagaaattgatagccaaagtggttaatatcacaaaaaatagtggactcggatctaccaactctcagcttagggcaattttaaatatattatactgataaatggaagtgagaaaacggatacactatggaagacctttccatacactatagatgtttatatatactggagacttactgacctttcctaatttctaaacacactagtgattggtatgtaaaaaaggtatatacacattagcatggggccaacttgtattccttcttctagttctcagaaaaagaacacaggaagtagcttccatgttaccaatttatcactctctttccactaagaaagcccctcttggtaactcgtgttgcacactgatggtctatgatgttgatcgcatgctaacaatgctggatgtcactctggagctccatgagagcctcatgaaatatctgatcattttggtgtttcccacagcttctcagcttcataagaaatgtttttgcatgaagaatgggaaattaaaacaaaaaaatagttctcccaatattaagaggttttttgtttgttttttgtttctttttagctgctccattcttagctgtctggtctgccactccagaggcactctgaacactttgctacaagggaaaagaggtttagcctactcatgctatgtgtaaggctttctctcaactgcagagctcaacacgagaaaagaccacgagcatccctttatagttccagatgccattggttaaacttaacaaaacaaagagccaaatacagggtcactgttacctagggccattttacatagttaggagacagcattaccattggctcacaccaaaagtcaggaagttgggagaatcttagaagataaggtacagaatattattggagtttatgctatttctttgactgtagaagtttcccagaaactccttttcacaatacttttacttttcgtatactttgcctctgcccaaagaatgtcaatggcaacttacactaaagggaatacatacaacatggacaaagtagaaacaaaatatagaaaactagcaggatggtgattttattggaatataaaccacttcctcaaatataattcctttaaaaaatgagtgaaagtgttgaaatgtaccttattttatttctctttttataacagttatcattccacatatatttagtgagcaagatgaagaatataagactcggcctagttggcatgatggaagcagcatggattcttcaaattatggttcaagttcatagtaaagttctctatagtaaggtttcagattacgctatctaaacttttagtttcttcatcctgaaaatggggctaaggcctacttcctaaggttgctttgaacagcaaacaaaataaccacgtaagtgtaacaggatatggattcatctctcaagaagtttgtaagcaaggtaagaaggtgaaacatacaacagataagtataatccagaggtggagagtgattagtgtcctaagtgttaccaataacatgttttgggaattcaggagaaaaggagaaaatatttttcatctaggtggcagcatggagaaagatttcctagaggagtgtgcagtgtgaagggttggtccttgaaggatggaaaaaatttagaactgtagatggagtatgggcatgcacaagcaaagtcatagggtgagttgatgggacataggtaatagccagtagcaatataaattcctatttctacttcataggacagcataaaggaacagaatcaatagaaaacctactatagtttttttctccaaccaatattcaggacaattaagagaaagggacttttcatattctaccaatgtaatgaatcacaccatgggttagaatagttttataaaagcctggccgaggaccactcattttcttctgcacttgttcagagaggcagaacacctctaaagcaaagccctggatgtgccttgccctacctttacccttagtcttgccaatggttcttgcagcaagaatggcttcaagcctggaatgcaattgtagatttgagcatccaggtcaccatatattgccttttccacttcaaccaggggctacctaaggcaaataactcattctaatttccaatggaaataatctttgtagtttagtcctttttccaatagtattcatttggtttcactatgcttttttggctaatgacaaaggttttgaaaacaagtttggatacagagaaaggggatttttagtaacatgtaatctttaaaatgcatcatatttttaaaaagtaaaattaaagaaataagagtcttaagaaaagtatgcaaaatattaggattaatcaaaataaaggggttagaggagagaaaaaatgaacacggtaaaatgaaaaagccctgcagcaattccaggcagtaaaagggaaattattgtagttctctttctctgttggtatgttcttaattgaaaaaaaatatttctcatgggagagtaacacagaaaggaaagaggaaaacagctggctgttggccatgatttaccattcaccgcaaaatgagactgtttctgcttctcaaagtccactgtttttcccaagcagacatggaccatactgacacaaagccaattaagatgagacttaaaaaataagaaagaggtctagatgtgtaactcagaagacagggcaaggacatagaatcaattctgttctaaagtattattaaaacaaaaactttgtataaccaaactagctcccacatcctagcaacagctcgctttcttcaaacaaaacaaaatatagcaaaatctaattataaaaaccccttgtctttgtgatggtgggttttaactggtaattaatcccaatttgtacaactgatgtggacgagctttccttttacaaaccaagaattttataatagtatcatctatctcaatcactgtttaataaagacagtcctccttaattctttttacatgaaatgttaatgtggaacaatgatgcttttcatctgtctggaagaaattcctcatgaaatcaacaatgtaaaagttttagaaggaaaaaatgtcatacatcttaaaacagaagtcatattagttgtatttaaatggttgtatctttgttccaacttttaatcttccttttctcaaggtacattcaaactataaattttcttgaataactgagtcaaaaagaaaggagacttgaaaactaggtaccaaaatagggtgaggactctgctggtaaatcagatagtcttgtaatatttccttctttggacgtgttagaaaacaattgctaaaaggaacataaatttctttttgagagtatggctaagattgtgaaatacattcctgagatttccaaattttgtactgggaaactttttgttagactatcaagcctattaagggactcacaaattggagtcatacgggacatctctgcggttttttaatagcttccaatttaccagttgaggattctaagaatcatcagtgaagacaacgtagtgaaacagggatttgttatatcatgggattctctctaaaacctttaatttatggaattctttctggggtggtagaggcggagaagaggaggattagagaaagttaagattcttggttgaaaatataacttttaaaagtaaagtgggggataaacgaggaaaattacaccatatgtcaagggcattatttatcataatccacattttcaaactctaaggaaattgtttataaacaacgtctggatttttcctttgcaagcatatacaatttttaagtttgaacttcttccctcagaattactccttgtctcaaaaagtttcaaaaatgtctttgatttttctccccctattaaacagactttatttttaaagcattttttagcttcacagcaaaattgagcagaaaattcgaagttcccatgtacctcccccatgccttcctgtctccagcagcctcccggactaccaacaacccgtatcagtgcagtacatttgttacaagtgatgaaacacattgacacatcattatccccaacatacatagtttacattagggtttactcttggtgttctacattctatggattttgattaatgtataattacatgtatcagccattttatagtatcatacagaatagtgtcattaccctaaaaatcctgtgcttcacctgttcatcctcggcagcccaaaatatgtttacttttgcaaagttgtcttcaaataaatacttaaaagcaaggacaagaccccccaagttttagacaagtactaaattaagtagctcttacctacttgaaaactaaatgagagtagtattcatcaacagaaagctaagcgggcaaaatgctttccccgcttttcccccatgacaagcaagattaaccaaaaatattacagttatttaaaagaaaaaaagaaagaaaccaaatgggaagagaatagaatgcaatcacgctaccattaacaatttatgtttttctgttcttggatacctttttgagtgcctgagaattttagtcgcaaggaatgaaaaaaactgttttctcatttcgagtttttattggtcaatagcttcctaaccgaaaactctgcagtcctaacacaatattttgtatccattttcaaaaatccagttctgggcataaaatagaattaatgctcaagtcaaaaactttgtgtttagaagataaaatattaggaaccatgagtatgagaaaaacaaaaactgttttctgtatttttcccttcctctctctgcaaaacttctctatttgataagggacagctagcttaaatttaccacaaagtaaaacatgagcaaatcccctggaacgaggagaactttcgcacagggcaattcactcgaatgtgacatcagcattccttctgagtcatagtctggtccccacccttttctcccaggcgacaccaggctccgcataacccgggagtggctcaggtagggccgtcggttccagtgcctgcgaggcagcagccaagctgaaaatgtctccctgcgctgagacgctggtgacaaccgccctttgggactacctgccaaacaaggagaatgcgctctttgacagataattccctaagagggaggcactgcctcggtcggtagacaagtaatgaatgaccgaaaaaaaaatcacattagaagttatcaccagcacgggtgcgaaggcagtgcattaaatcaacactcattttagagcgccccagacagcccagccggaagggaggagatcagagctgtcaaagcacagcagagccccaaaccacaaaggcttaatgaaattcaacttcctgagccaggaagtgtcacggtctcgcccgcactcgccctaagctcgtcctttccttttgaggaggcacaggcagagctgaaacatcttaagtaaagtttccaacacctacaaccactgggattccgtgagactggagagaagagtcccgcgcccgccctcgctcgcgcttccaattctgtcgctcccgagtgtggggagctggcggggccgccgagcacctcctctacccagggggccaggtccctgggcccggggcaccgcagacccagagccgggctcacaccggggggcccgcgagccccacccacctcggcacctccggccgccgcgcgccgcgcgacccgcgcaggtgaagcagccgccgcccgccacgagcgcccccctaccttcttcactttgttttccaggtccatgttaacgcgtcctatgggtcccctcctcctcctatccgggatcccacggccgggttcagctggcctccggctccgctgcgaacacgggaaacctgcggaactcccgcggcgccgctcaacagccactcgcccggcgccgtcgaacttccgccgcccagtccgccgcagcgggcctgcggcccggacccgggaacaaagggggccgggcagccaatggcagccgggcagctccgggccgccgccaatcaccgagcgccgcacgcaccttcgcggcccgagcgcggcgctggcaaggtgagaggcggggcggcgtccgaggcggcgccctgctgggcaagctcagtgaccctgacctggtctccgaagggattctctgggcgtccacgggccggcttctaaagagctgggatccccagcctccctctagctgaagatggagaagaactttttccatttggcaatttgtacctgtgtttgcccaggactttttatttgggtcaaggggaatagttatcccaatactaacttctcagtttattttcagggtaaagagagaaaaaaaagagagagagagagattgtagggatcgttagggattcctgtgatggaccttgggcactaaattcaatattgcgttgtggagatgccctttcctcaattgcttttttccacaatcccaaatactgtcaagaaaccgtatcttacatccctaaagtcagcgaagattcttagattgttttctgagcattgggttgttcaaaagtaaagatgatgtgaatcacttcagaaacaggttgtgtcattcctttggaagcagagggttgccctttgtctctgtgtgagatggtgctaggcctatcgcgtgctcaggctttgatgaagcagagtcatcacattggtgcaccaaagctgaattcatttcatgccctaattcaggagcaattgcatctaataccatcagattggtcggtctggaagggagcctaacgattacttagtctagcttcctcactttgcagggaactgaggactccagaggtgcagggacctgcctaatgtcttagcctgttggggacagaggcattgctcatgaatctaaacaacttctcaaagatgtttggggctggaagcacagcatgttgactaaggaaaaagagcagtcaattttcttcaatttgtggttatggcaaaaaataacattgcccagacagcaggtgacctaatttggcacctacttttaaaaataacaaaacaatataaaacaaacaaacaaaaattccctaataatgcagatattcaggtccagatgtatgtctgccttgcctcgagaaatttggtagctaaaaatatccaaaattcattttagccaatacttgcaactctgcttacttgattatttgttaacacagagcattgatttataatgtgcatgtttcctttatcctattaagaattaaaactgaaattaccaaaatgagttatgcatttttcttttcagctgatgtaaaacttttctgtgtcattttcccaaaccaccttgaaaggtgtgggcccctgcaaagtctgcccgttgtaagtgtataggatcatgaggtctagctatgacaaggcaattttgtttctttcagagagcttaacagatggaaaatgtccagtaaagcaatttaaataaggcatcaaacaaatgttgtaacataaattttggacccttatttgatgaggttgcagagatgacactaagaaaaccatctggaaactttttttttttaactgtcaacttctgcctttctcccattcttccttcccaaccctctcagcattacattgtgtgtgtgtatcattggcaaggatggaaatagaaattcagtgagttttatctggaattatcactgtgccaattatataaaaataattatagattatgtataaattataaaaataaaattgaggtagataagtgttaagagagttaaattgtaagtttttgttcagttattcaggtgttaagctacagttattaaggaggtagaactggcatggtttgatgagtacatgtagttgatgacagtggaatgaatagaagatggcacacatttctatcttgatcacctctatggatagctcagaaagagagaaaatataggatgatggtcagggttttgttcagttgtgcattctttggggctggtggtggacataaaggatacaacttttaatatattgagtttgagactgagacattgaaatgagtatccaaatatacatcttgaatgctgatttaggagttcacatcctacataaataaataattaaaggccaagaagtgagatgagcctcggagacagtaaaataaaagagaagaatatcaaagacaccaagtgagcaaggctgagcaagagaaacacataaaagagataagggctagattaagggtaagaaaaaaattaggagtcaaatccctaaaagcaagaaaggaaattgaagaagaaattagttaacaatgtcaaattgtagaaaagggtcaaatgcccttcggatttaacaaaaaggagatcattggtgactttggaaagtgcatttttggtgcagttgtggggaaagatattactttataattttatctccctttgtttctaccagagtgctttagtcaatgttggacttgacttttccacaaaacttatggacacatcagccaaataaatgcccaactctgctgtttcaatcaagtagagaggaaatcaatatactatactggataatactaaggaatggtcttaagatctttatctttagagaagtaaatgaaaatactagattttacacatgtgtgcaggcacacacagagagagagagacagacagagacagagacagaggagagagagagagagagactgaagttctctgtataggccaaacaaaatatttattcaggttaaattcagtttctatgctatcaaattacaatatccgatgagggaaatgtgttaaacttttatgtacccttcatcactggagagatgtaaaaatacataagacattccctttgttcttaagcagtttacagattagtatgggagtagcaggtgtgtaagagtaatgaaatgttacaggtagagggaagcacacgtgagagtcagggagaaggtggtattgggatttgtaaaatctttagaaaagagtaaccttggcttagtcttggaagatgaataagtgtcttagttaaaactcttgattgcaagttatattaggccgttcttgcactactataaagaaatacctgagactgggtaatttataaagaaaagaggtttaattagctcacagttctacaggctgtacaggaagcataccttctgcattggcttctggggaggcctcaggaagcttacaatcatggcagaaggcaaagtgggagaaagcacttcacatggtaaaagcaggagcaagagagacagaatgtgttggtgggggaggatgaggtgtgccacacaattttaaatgaccagctcccctgtgaactcagagagaatgctcatttattgccaaagggatggcccaagccactcatgatccaaacacctcccattgggccctacctccagcattacggattacaattcaacatgagatttgggtggggacaaatatacaaaccatatcacaagtaatagtaaccctcgagctagtttacttttaaaaagatggcattttattttaaggatacagaggcttgttgcaaaactcaagggccagatgcatctgcgactagaccaggcacttgccaacatctggaacaaggaatctactccttcactggggttatgtggtctctcatcttgctgcttggcctccatcagctttagttctttctctttgaagactctgttttcctgcacacatgggcaaccaataaaggcagtctcagctcgttaattgacatcaccctagttcaagcaaaatacccagtttgggatttcaacccctctaacaaaaagactttaaatagcccagcttggataagcttaaacttctgattcaattagctgaagctggtgccagttgagagacacaaaggacaacacatagactaaagcccaaacttataggtaggacaaatctcacagagagggagtaataagagttttccaaatgcctccaaagatatctatctctgtttcagatgttacaaggaaattagcaaaggaagaggcttagtaagtacaagcagaagatttttctttctgtcgatattggagaactttttcccttgacttttattataggtttgggagtacatctgcaggtttgttacatgattaaattgcatgttgctggggtttggtttacaaatgatttcatcagccaggtagtgagcatagtacacaactggtacctttttgaacctcaccctcctcccaccctctaccctcaagtaggtaccattgtctattgttcccctctgtgtgttctggtgtactcaatgtttctgaacatttcaaaaactatttaaattacagaaaccccacttgggcaaaaagttgtagatgtttattttattgctaggaatgggggtagataatgaataggacaagtctaaagaatggaagattaatcaggagattctagctatagcccacaagaaatatgatgagggccaaagtaaagcagtagcaatgactgtggagagttagaaggatttatcaatgatattaaacaggtagaaaatattggacttgactgattcttgaaaagagagaggataaggaatccattaggattctattttctatctcttaggaatctattttgggtgaccagtttggtggatataacacacaccttaaggcaggaaacaaaagtggagaagaaaatttgattgagaaagataatgggttttgttttgtgtgtattgatttggcaaggccaataggatatgagtctggtggacaaaagaaacatcagggctgaagatacagatgatgctacatacacaagtacacatacataaacatatatacatatacacacataaatacacatacggagtaaacactacatatgccagggaaaataattattgaaaacttttctatactagatgaggtaaacatttcaagatgaaaatgatacacctgtctcatcaattattaatgtggtcccaggaggcctctttagagatgttaatcatttattaacacctgtcataggaactcctttgtgagcctgacacagctattattcctcattagcaggttgtataagattacaggttgttctctagggatattttttaaagaaaataggtgccaatgtagcttagagcaaactaatatcccataacttttttaattgaccaaaaattggggattgactaagtaaataatggatgagccacatgacagatttagcatagttactgatcaatgatacttaggaatgtttgtaatggaaaacaattataatgttataagaacagaatataatatggaattgtatatacagtatgctcacagctatacaaaaataccatgaatagaaaaagaacatgagggaaatacactaaaatgtcacccgcagtttgcctttgattggtgggtccatggggatttctttcctccttttaaaaatattccatgattagtatgactattttaaatggaaaaaccttatttaaaaatacattatttcaagcattttagggggacagaggagtgtctgtgtaattttcaatctctacaaaaatctacattaagaaataaacaaacaaacaaaaaccagatccactaattagcaaaaccaaatgcccagggataaactttacaataaaacttggtaataaggtaccttcataaaccccagaacacaagaggtgagggcaaaccaccgaaagccacaagacatatatgcataaaagattatgttttgaggagggaagaaaataatggaatggtgtctgatggatggaagaactagaatgctctcctccagttatttattgtaaagcgtttcaggccaattttataatagcagctggaaaagtaaaaaggatcaaagggagggaatgaagccatctagcccttgtgctatgtcaaagctgaccctccaggactctcttctaggacaagtttccacaatcagaagttgcttagagagaaatcaaagttgagcaggatggggcagtagaggcaatggaaataagtctagaagggcaccatccaatttggtagccactaactgcacgtggttatttcaattttaattaattttatttaagttttaattagttaaaattaattaaaatttaaaatttggcttctcagtcacactggccatgcttcaaatgttcaacagccagagaggggagcagtatcaggaaatctcaaaagtactgctgtattttttatttatttttatttttagcactttataaaaacaaggaggccaggtgtggtggctcacgcctgtaatccgaacactttgggaggccgaggcgggaggataacctgaggtcaggagttcaagaccagcctgaccaacgcggtgaaaccctgtctctactcaaaatacaaaattagccaggcgtggtggtgcatgcctgtaatcccagctactcaaaaggctgagacaggagaatcgtttgaacccaggaggcagagattgcagtgagccaaaatcacaccattatactccagcccgaacaacaagagcaaaactccgtctcaaaaaaattaaataaataaataaataaataaaataaaaacaaagaaagatggagctaagttgggcaagattttctgaaccttgcattattataaaagttcaggaaaactaataccacatgaaaatgagcaacagcaaattatcaagatcaaattccataaaagttgtcataacaaaaaaagagaaaaaaggagcagcataacatcactacagatagtgaaagagcatcagaaaaatgtgtccacaaaacaaaactataggctattattttagaacaagctaaaaggcattaacaagataatatatgtaaaggatcacacaaatcagaattagaaaaactaagaagtgagttgagagaacttaggaaaaaattagaaatgaagaaaacaatattaacaaaatgaagactaaagtaaaagaataaaagagcaaaaaactgataatggctaagaccaatacaaggcaaaacagaagaagaatatttaaaaaagatacagtctagagaaagtaacaagtattgaaaatagactaaaaagatgaaacacaaggatgataggaatccctgaagaagaaaaccaaaccaaaggaaaaaaacaaatactaagagctataattaaagaagtatttcttgaattaaaaaaagatttaaaactagatattgaaagattgctctacatacctgacactatcaactcagaaaaatcaacaccaaagcataatctagtaaaattactggactttgaagaatggggggaaaaatcctttgggtatttagattttttaaagtgtatataacttagaaagaaaattatattatcatctgacatagtaatccctttaggtcagaaaaaaatggacaaacaagatatttaggaaagatactgtgagccaaggattttatttgaagtgactttcaagtgtaaaggacacagacaaacttttatcaacatacgagaactcaagaaatattggtcccatcagccctttatgaggaatctatagagaatgagcttcagacaaccaaagttactggagagatattggaataaggaggtgagtgttaactatatagacaactcttatagaacaaaaactaaatgaggaacaaggagagagtgtaatgtatattaaccatatgatctgacaatgtagatataataaaaataaaatgagaggaaagcatatacaaattttaacagactttcaatattcatattggtggtaatattagcattagtaatctgctgctatgcatataataggaagtaagacaaatgagtaatcaggggatagtctaattttatcatcccctgtcatcttgacaaccaggatttgaggtgtagaagaaagaagttaatctaaattcctaaaactataatagttttgaatttgactttctctctctttactagctctttccacagagaagggctacaatgactaacttagtagcaaagagtatctctagaacccagattgtgatcttgaaataaaatttatcactaaaaggaacctagaacttcatggaaaaattactgattccagctctaaagcagaaaatgtgtaagttaagcctgaaacatgttgtcatagaagagagcaaggagggtatgaaaaactactgggttcatgtcaaaagaagttagaagccagcttgaagagtctcttgctggccaaaaattggtcaacttgagcttcaataataataacaattacagtaaactaaaacccatcaaatatctataaattcataataatatttttaaaacgagccatctttggagaataatagggaagcatttaacaatctaaagaattagtaagtaaagagaaagaatcaaggatttattgtatcttttcaatatgaactgtaccactggataaccaaatattagaatgtgtctctttatagaagtattccaactaatacattaaaaatgatagaattagaatatcaccatttcaaaacaatgagtaaaatcagtatcgctgactgctgccatcataaaacgagacacaatctgacattacgtgtcaaacacctcccatagggctaccaaaggggtaacacctgaatctggtccaatctttgtatccagctgccaattggcaggaaatgccatggacagaagaacatattgaactactccaagaacaccaaatcagcaaaatccagactgcaggaaactctacagatcaaatgatcttggttcttcaatataaaattctaaggaaaagaaagggatgaaaggagtacctatagattaggagacttaaaaagacatatcaattatttaaaaataggcgaggataaaattaaaccatagtgtctagggatacgagtttgaataatgaaattctttaaaaatgcaggaagtaattggcatttaaaaaataaggaaaatggttactaatggggacaggaggggcttatgattgagatggagcaaatagacaaggtttcttgtgtactcaccaaacttcacagaataaggaatcccagaaagctaatggggcatctctgttctaaacagaaaataataattcccagttacatctattccttgtgttcttgatacaccaacatgcctttttttcattcatacccccccagctttgccaaaatacatctgtttcatgtataaacacaaatttaactcttcccagctcaaatataacaattgcatctaactctaaatctaggatatctggatgatacaaattagtctcaatcaggtctatacgtggtttatcatgattctgttcaaatgagctaaatgataaacataaccaacagccaacttaaacaatgtaaagtgggtgtatcaagttacaagggctgccataacaaattactacaaactggatggcttaaaataacagaaatttattatctcatggctcaggaagctggaagtctgaaatcaaggtatcagaagggccatgctccctctgagggttctaggaaagaattctctttgcctcttcctagcttctagtgtttgctggcaatccttggcattccttggcttgcctttcctgattggacattttcttttgaaacccagtcacccactttcctgcttggacattttcttttgaaacccagtctagaagcctagctagagaggaactgatgccccagctgacagcccgcaccaacttgccaaggaagtgccccagctgggccatttcagctgatgtatgcagcagaggcaaggtatccttgctgtctttcctgcctaaactgcagatttacgagcaaaattaatagtttgggttgtttaaatctactaagttttgaggtattttgttatacaacaacagacaatccatttctggcatcatgcaaagcagtggttctcaactagggtagctgcaatactccaattttgccttgttcttcacatgaccatcttctctttatgtttgtctgtgtctgaatctccctctcctttctcttataaaaatgctagtcattggatttagggctcaccctagttcaatatgacctcttaactaattatatctgcaaagatcctatttgcaaataaagtcgcattctgaagttctgggcatatatgaattttgggggaacattatttaacccactacaaataaacattatttaacccacttctgtttggggaaacgaaagcaaggtagcaacagtaaaacttcttggtaaaaaacaaaagcaatctgttctgttccaaactgtttcatagcaaatattatatcatgcagaactgagaacataagagctaactttcctaagggtggagttaggttcttggtcttccattgtgtatgcactgaattcttactaccgagatgcccttccttatccattgtcccctgtgatgaccttccagagaggcattgtttgaaatttttgttctggagagtagtcctatcccaacaactgtcctatcctgtcctgtcctttgggtatttgggatttgggggatgccataatacaacgagatataggctacttttgccaggcttgggatttacttaacatttgactgtcatttttatttcaagggaacctttaaataagtattcctcagccatgatactaatgataatttggatcagataatctttgttgtagggagctctcctgtgtattgcagaatgtataatagcattctgggcctcgactcactaaaggccactagcatcccactccagttatgacaaccaaaaatacctccagacattgccaaatgtcttctggagagcaaacccatcctcagttgagaaccactgctatacatgataccagaaatggatcatctgttgttgtgttaaaaaaaaatacctcaaaagttagttgattaaaaaaaaaaccctaatcattaattttgctcaaaaatctgcagtttgggcaggaaaggtaaggatatcttttctctgctgaatacaacatcagctgagatagcccaaatgggacaattcattggcaagttagtgctggctgtcacctggggcatcagttcctctccagctaggcttctatgagttgctttggtgtctttatgaacggtgactgggtttcaaaagaaaatgttccaaaagagtaaagtggagtccatgaaatttttatgaactggctttcaaagtcatgtagtatttgttatttaagaagagtatgtggaatgggaggtatacttgcaatcttcagaaaatataatgttttgccatttgccctgtggacatgaaagctcacattctttccatctgcctaatagaatgatttcatcctttaagatcttcaagtctccacagcttagtctggtacttgtcatctgaatcaagtctaggtgtggacgatgctcctcaggtgtggttaattagtatagctgcttgagtactattcctcttgatctgaaaagctctgaactaaagggacaagttatctgttcttcacacacgctcagcatatattgagatagtcctagaatatctgctatacaaaatcccttcagatactggtaaaacaggaagcacgtaacagtcactgttccacagcagttccgaaatccagccagggatgtgttgtcactttcttgactagggcttattcttgctctttaaagattgtttttcatggatcttgctttcaccttctgggctattcattccggtttccaagtcaatcatcttctttttccaccaaaaatactccatgtttgcacctaagtcattcttttaaccagcttccagcttgcaaacttgggaattcaaaggaactgcctgttcgatggagctgtactgactctgtctgttgagtctgtgctgttacaattacttaaagaaatcttgtgagtttcttatgtatcaacatataatacattctattaggtcaaagctacacctacaaatatctttgagattattctttccctatcttgagctcaaactgtgaaactttcattggataacacatttattattcttataaatcttttctttttaatgtgtaatatctatgtggtgcactctaagatacctagggggccttctgtctctctgaaaggttatatatcagtcactatgttatgtgtttctgaagtcttcacaaagactcttaatcaccatcctggacttgatctttgcccagaagtcatttcttaatttaaaaaaattattttccatatggaaatcctgggtatgagacacaggtttactttagaacccaggaattgacagtcttttttgtctaatattgcattctttagttcttctctcctctcacattttatcataggtgcccttttaatattctgcaatcatcaaattttaggtacattttctattttctacgttatcgcagaaaacaatcttggcaaactttctgccagtacatagcaattgcttcccttcctccagttcctagtaacattcaccatacctttctgttaaaccctcattgacagcctccttcaggccttttagctttagctaactgtcgcttagaaacaatttaagaggcaggggtgaccaatcttttggcttccctgggccacttaggaagaagaagaatcgtcttgggccacacataaaacacactaacactaatgatagttgaagagccaaaacttaaaaaaaaaaagcaaaaaaaaagtcataatgttttaagaaagtttacaaatttgtgttgggctgcattcaaagctgtcctgggctgcatgtggcccacgggctgtgggttggacaagcttgataaactttcaaatagtatcgcaaggcactttgagtttctgctctcttctgcctataaccaatgccacatgcttcagattttctttttggcagcactccactactagtacccaaaagctgttgtagtatttattgctttgtgacaaaccattccaatgttagtggcgtaacacagccattttagtaggcttagaaattgtatgggccaggaattagaacagagcacagtaagaccgcctttttccatggtgtatggggcttcagctggaagtgttgaaggctggtgatgactcagtcatctagctgggggccagaatcatctagagttgtctttatatatctggttgatactggctgttgactaggactatcagtgagagtctctctacatggcctcagcatgtgttttttctatatgggccagttgctcacagtctgatagctgggttccaggactgcatattccaggagagcaggctggaagtatatggcatttttctgaactagcctcataagtcctatggtattgctttcactaaactctcttggttgaggcagtcataaaggtccattcaggattcaggggacatagaccatattatgcaatagttagagtatccgtattacatagtaagaatatggtatggaaaatatttttgtgtctaactttagaagacacaatctgctacacttaccgagtaaaatatttgtatctagcctgtaaccctagttttaaatctctcagcaacaggtttaagtctccgtctatttcttctatcctcaatttaaaggcctgtttaaattgaggtcactgtcttagatagtcagagataatagaaagttttatcttgtatggggattgattccaggtttctgtgctttgaaatcagagttttagaggatttaggcaggaagtgcatagaagacacattcatgcaccaaatgatgatgtttcagtcaatgaccgcacataaggtggtggtcccgtaagactgtaatggaactaaaaattcgtacagccaggtgacactgtagccattagaatgttatagtacaacacataattcatgtgtttgtagttatgctgccaaaacacacccattgtgtggccagttatataaaattatagcaatataattatgcacagtatataatacttgacaatgataataactatgttactggtttaggtatttataatactaacaatttattattttggtgtgtactcctacttatggaaaaagttaactgtaaaacaacctcaggcaggtgcttcaggaggtattccagaggaaggcattgctatcacaggagatagaactccatgcatgttattgcctctgaaaaccttccagtgggacaagatgtggagaaggaagatggtgatattgatgaaattgaccctgtgaatgcctaggctaatgtgtgtgtttgcatcttagattttaattaaaaagggtcaaaaagtaaaaaaaaaaagaagaaatccaaaaagcttatagaatcaagatataagaaagaaaatatttttgtacagctgcacaatgtatttgcgttttaagctaagtgctattacgaaagagttaaaaagtatctttaaaagtttaaaaaatgtatgaagtaaaaaagtcacagtaagccaaggctaatttattattgaagaaataaagctactttaaatttattgtagcctaagtgtacagtgtttataaagtctacagtggtgtgcagtattgtcctaggccctcatcttcattcactactcactcactcactcactcacccagagcaacttccagtcctgcaagctccattcatagtaagtgccctacacagacataccattttaaatcttttatatatatattttactgtaccttttctatgttgagatatgtttagatacacaaataccatcatgtcacaattgcctacagtattcattacagtaacatgctgtactggttagtagcctaggaacaataggctctgccatattgcctaggcgtgcagtggctatctcatttgggtttgtgtaagtacactctatgatgttcacacaaagatgaaatcacctaacaatacatttctcaaaatatccctgttgttaagagatgcatgactgtaacttgatgaatcatgggagattaaacctcccccattactctgactcctgaaaaacactactccaagctaatacactctggttgatataggacaacatgttcagtttttgtacctcagtaggacccatgattttttgacttttgctaacttgtatttctggccacagccagagtttctcttaaaaaattgctgatccatactaatggactttttattctgtctgataaatcagaaaaaagatcctagcttgtttctttcctgtaatttattgaaggtggcaagaattcgccaacaccctccaataccctgacatttgctatgaaatcctcttaagtaacagcttttgtgtatatggcctatgtcctaacagaaaactggaaacagatttaaccaactcccttgatatcattttcaaaggattgctatctcctcatggtctcccacctcaaacagaactacattttatggtctttactttgtaaaaccccacttttaggtataatgcctaaatgtcttgctgttatctagttgcatatgacaggcacataattcgaactagtttaagccagttggggttttattggctttatgtaacagtgagagaagggtggttggaactacctttaaggatcactaaaaagagatttgaacaccattagaatactctctttctctgtttcttgcagcactccagattcattctcttagaagagtttttccatgtcatggggaacatagctacagagagttccaggtcacatcttccataaccagacaaaagaggcctcgtctttacaaattgagttttgaaaaaccctgggaatgatctgtgatcaactgagttttctcttctcattaaactaaagagtcatgaggtatcattatccgctgctgccctttataatcttaaggcaaatactggtacaaaatactcattttctactctagaaatattttttttgattgaaaaaaactccatactattccaccaaattacagtaagatttattttaagcagaaatccaaagcggagaataatcccttttaaattgttgaataaatttagaaatgatgtaaaaagcagaaaggaaagatatagattgtttttctcatgagtgaatgttaagtattaacaataatgttagacatatgcctactcttttcctcagcaaacccagaaaatgtgaataaaagatgggattgtaaaatagaaatgtgaggcatcatagcattggagtttattgaggtaattggctaggaattcctatgtgtctcagaatggagaatttcacatcatttttaaaacaaataattccttgtgggcaaacacagtgagtaccgagtggtatttgtggaatgattctctatggcagcacgctccctaggtagaatgattagaatgataccttttaggaataagcagtaagggcttttcaaagtgttacacagtaatcaaaatagcaggggaaatgttctgtgatcaaagcaccatgcaaatttaaacaaattctgtataaattacaacacaatatgttgtcttaatgggttattactactaagtaattttacttaataataaaaaattcttctattaaattatcatttaatacattttcttactccaaacatttacacaagatctcatttttaaaactgctttcccttgggtataccatttcctgagagctcagtgtgttatggttaatggaaatgttgtcattgtcagattgcctcttaactgtaatataaatatgagtctctggtaagcctcagtgtgaacaaaagctactcatttatttttcataagttgaatcatccctaaaaagggatagcacaagtctattggtgactattttagtatagcacttgctgtgatagccgggtaaggaggaaaatcaattatagttctgaaagacatgtagattttgttcacttaaaactcaggcttttaatccctggataaaaacctagcctggaatgcattctgaaagacataacatttgcttctaccgtaagaggatgtagtaacttcaagacgcctatcatttgaacaaatagattagtcaaaataacgatgtgaaaaatatgccaaataagggcaacatgttctttttggatcggtgaaaagtaaattgtgcaacaaattttccaccatatttcatctgcttttgatagatcacagaaactgcatcagtgttcctatgcacatgagaaattataggtatcaaaggcagatgaattaattaattggtttctttggtactggttaagatttaatctctctgtaatcttaaaaaataatatggtcaaaatatgtgcacaatttacttcatcccattttttctggttttggtgaattattaggaaatagttaattttatattacatttctctgcccacagcaggctactaattctattcaagttaattcacctcaattcaattcatttcccactgagagcttattcctctcctagtcaatatggcacatagtccaaagatgtaagatgacctttcattaaattctagtaaaaaaaagaatgagtaaatggtaggaaacagttaaatagcaattcagttattcaattaatgtgaggtataagtgatagacagtaagtgctgtagacttaaaaaataagacatgtataagtatgtttacagcagatctattcataatagcaaaacactggaagcaatcgaaatgctcattatcagtggagaagataaagacattatttatattcgcactttggaattcaacatttaaaatgaattaactacagttatatgcattgacattgaaccttatatacaatattggtttggggcaatcaggcaactccacttagaaaagacacagatgtatttattataccataaagcaatataaactcaaaggtttaaatgaaattattaagtaccagaaaagagaacagaagagaacttctttataaaattatgttaggagagtcctttctaactttgattcaaaatgcagaagctgttttaaaactgacaaaactgattacattaaacaatcttttttgtgacaaaaccatctgccatttgtcagaagacaaatggcaaaccagaggggaaaataatattcagaattaatatgctgggaatttattttttaaagtatcaataatctaagagaaaaatgtgcaaaggacagaaaaaccagttcacagaaaagtcaaataaattattataaacataagaaaaaaatacccaacttctttcataataagagaatttaaattaaaccacaatcagatgcattttttcagttattaaattagcaaaaattaagtttagtgatgctgaagggaaagaggcacccatatatcattggtatgagtacaaatagtatattctttatgaagtataatttggcaatatctatcacattacaaatgtatctcacctttgacccaggagtcccactcacagggatttatcctacagaaatacatgcacacataagagatgacatatgttatgatctgcacattgtattagtaaaatgttagagaatagtcatgtccattaatagaggactggtatagaaaccatagtagatgtacattatggaatattatgtagttataaaaaagaatgagaaaatgctttgtgttaaggatgtggaaagatctatatgtgataagatgtttgttttttttttttttgagacagagttcgctgtgtcgcccaggctggagtgcaatggcgtgatctcggcttactgcaacctctgtttcctgggttcaagtgattctcctgcctcagcctcctgagtagctggaattacaggtgctcgccaccacacacagctaatttttgcatttttagtagagacggggtttcattgtgttggccaggctggtctcaaactcctgacttcataatctgcccacctcggcctctcaaagtgctgggattacaagcgtaagccaccgcgcccagccaagatgtttatttttaaaaatcaaaaatctagaaacataaaaatataattgtatttgctcatattggaaagattcaaaataaattaatgagtgattatctatggggagaagatggaggggtccatagagtggcagcaataggggaggaagcagggatttttagtctattgtgtattgttttgtattgttttgatttttttgcagcatgtgtataatacctactgaaattaactaacagacccctggtgaaaagaagaaagaaaaaagtacagaagcatgaatatgttatgactgcttttatgtgaagttaaaaaacaggcaaaataaaacagtttataataaatactgtgacaaaaacaagaaatgattaacacaaaattcagaatggttgaaggaagataagcaggcagaaaacatagaaaagaaaaagtcaatcactgaaggctataggggtttagtaagttttcctggaaggagggggacaaaaactagttcttgcagggtgtggattccagtaaatatagttcatatttatatattattttatagtttataaaacattacatgcatatgatatcatattgttttgataacagagataaatgagagcaggcactcaaaatgaaaaaataaaaaataataaaaaaaagaaaagcatagccaaggcacagaggatgggaaggcacattctgcattatgagactttgagggatccgcccggctgggcagttgagttaggtagtaatgagtaatggaccaatagattcagaggttggattataatgggattgagaccttatttgggacaccattaaaggtttgtttgtttgtttacaaaaacagatctaagaaatatttgaaaattgaacacagcagcatttcctaggccctgcctaacactggctctagccttcaggctcatcactgataatcatcgacatgactagcactgaccaatcccatgcgtaccaggtggaacccttgattacttagggatgtgttgtaaaatttccacatattttaatttttcaattttccctgtattatcagtttctaatttcatttcattgtagttggagaacacattttgtgtgatttcaatccttttacatttattgagactgttgtatggcttaatgtatggtctatgctagagaatgttccatgcacacttgaaaataacgtgtattttgttgttggggtgagtgtgctatagatgtctgctacatctggttggttcataatgttcaagttttccatttccttgtgaatcttctgtctagttatatccaatattgaaaacagaagactgaaacatccaacaattaccagtgaattgtctgtttctcccttcaattgtgtcattttaaattttgtgtattcttgggctctgttgttaggtgaatatgttttaattgttatatcttctcgataaatcaatccttttaacattgtaaaatgtcctttttgtccctagtaaaaagttttatcttatatcttaaagtatcttttgtctgatattagtctagccactccaagtctcttttggtgacggttggtatagtgtattttggcatccttttacctccaatctacttacattttttaatctaaagtgtctcttgtagccagcatatagttggatcatgttattttaaaaacgcattctgccaatctctaccttttatttggagtgttaaatccatttgtatttaatataattactgataaggtgggctttatgtcttccattttttgatgtttttatatgccttagaccttttttgttgttctattcctccattgctgccttcttttgtattaaatagacatttacaagtgtaccattttaaattccattgttatttcttttactatatggtttttaactactttcttagcccagggattataattaacatcttaatttaggacagtctagcttggattaataccaactgaattacaacaggatatattaataaaaactttgcttctatagagctcaatttcctctcttttccttggtactattatcttacaaattatatgtttgtgtattttgtatctatcaacaaaggtagcaattattgctttatatcagacagaagaaaaaagttacattaaaaaaatttataccagcttttatatttgtgtgttttccttactagtcctctttatttcttcatgtggattcaaattactatatatgtccttccatttgagcctgaaggacttcctttagtatttattttaggctaggtctgctagcagcaagttatcctagtttttctttattttggaatatttgaattactccttcatttttgaaagacagttttacaagatatacagttcttcactaatagtttttctctcagcacgttaagtatatcatcacactgcctcctggcttctacagtttccaatgagaaatcagctctatcttgttgaggatgcctgtgtatgatgaattgctttcctattttgttgctttcaagagtctctctgtctttctagcttacaatgggttaattataatctgtttaggtgtggctttctttgagattatcctacttggagttcattagtctctatgaaagtgtaaatttatgtttttcttaaagtttggatagtttttattcattccttcttcaaatattctttctgccccatttttttctctcctctcctgggatattatgtgtatgcttcatgcatgatgttatcctagaggtcactgcagctctatttatatttcttcattctttttttttttgagatggagtctggctctgttgcccaggctggagtacagtggtgcactcctggctcactgcaacctctgcctcccagattcaagtgattctcctgcttcagcctcctgagtagctgggattagctgggattacaggtgcatgccaccatgcctggctaatttttttgtatttttagtagagacggggtttcaccatgttagtcaggctggtctcgaactcctgacctgatgatccacctgccttggcctcccaaagtgctgggattacaggtgtagccaccacgcctggcctcttcattcttttttctttctgtttttcagactgggtaatttcaatttttttacattcaaattacctgactcttctacctcctcaagtctgctcttcaacccctctagtaaattttgtattttagtcattgtacttgtcaactccaagtctctctttgtctctttctgtttttttttaatcatttctatatccttattgatattttctatttggtgagacactgtctccatgttttcttttacttcttaaaacatagtattccttagttcttttacatatttaaaatatattatttaaagagattccccagtaagctgaacatctgaacttccttaaggcaatttttataaactgctttttctcccctgtggatgggctattcccccttattgctttatatgtctcataatttttggttgaaaactagattttaaataatataatgtgaccaatctgaaaatcagatatctccctcccccaaaacattttgttgttgctgtttgttttcattgtttgtttagtgacttttctgaactaattctgtaaatactgtactctttattatgtgtgaacactgaagactctgcttggttatcttaggggtcagctagtgattggacaaatacttccttaaattcttgaaaccaataagtctcccagtctttgttgaggaattctgtgtgtggtggggcatgccttcaccactcagtcaggcacttaccaactctgcaatagctttcattacctacttgcacagagcctcatgttagccagtagtaaatcttagggccttctcaggttggccctgggcagacacatagcactatgcatatatgtggccttctacattcccagtgacatggcagagcttttcaaagccaactatggatatctaatttccaagcttctccttttaagtttacaggttagcctatcatttgccccaactgttttctatcactgtggacaaccagcatgttcagcaattgtctctgattgttttcaacaaatgtcctaggggaaaggctgtttccagtgattaggctgggtaagatcaaacaaagacagccttgtgagtgagtcttccagagaaccaccagagaggtcaaataataacaactttttgcatcatgtctttgaagaggtccatctccatttactttttcaagagtcgacacactgcagattttcactgtaattatgagctgttgatttttaaggctactgtggagctgggagaaggctgagaataggacaagttaaaatgccacaaatcttgctgttcataacaaaattaaagtttttcttaaataaattatccctttagtgcctcaagcatttggttaattttcagagttctaaaaaagttggttttgataatttttgccaatattcttattgcttttaccaaggaggtaatttttaaagatgtttactccaatatttttactgatataagcataggctacttggagaaagtaaagagagggggcaagaagaataatagcaagcagtgaggctacagtttaggaagaaattgtaaataaaaatattgttggaaatttattatctagaaatggctacatttctgcaaagatgtaacaaacttacatagtattagcaagatgataacaacagctttaaataggatactaaccatggagtgaccactgggaagacactggctgcagtggcggaggcacagtggggctgcatgctgcatggagccagtgggggccagaacaggtggcagccctggcctctactgagtcagctgggcaggagccccatgctcctacagctgcagccacccagctgggcatccctgtgctcttgggggcccagaaagctccttgctcccacaggctggcaagtgcctgctcccattgcctattctctcccaactcccagcacccactccagggtgcagcacagttgtggctgagcctgggtgttgttgcaacccagccaggtgtgcatgcacttggggtggcactgacaggccagccccctgctgcctgggcctcctctggactttgggtgccaacgagcatgggagggaggccaataggggctgagggcagctcagcacaggccttcaggtgctcttcagtaggaactgcctgggtgccatggatgacatgttgatggtggcaggaggcagacaggctcctgggcagaaaggggcaggtccctagtgaagccccaccttcaagccatggatggcctgaaaaccgggggctggactgtcagtttcaggtggagtccacagcctggagtgagaacttatggtgctttttgcaggcccgtccatggctgcccatggaccaatcagcatacatttcctcccttctgagaccacaaaaaacccagccagactcacacagacatcaggattaccagctgtggaaaggagttacacactacgagtcaccacatgttccgacgacctgcctgcgaaaaggagctgcccactgtggatctcttctctgctgagagctggacacacatcaggatgacctgcctgtggaaaggagctacctatttcaggtcccctgagagctgttctgttgctcaatgaagctcctctctgccttgctcaccctccagttgtctatgtacctcattctttctggacgcaggacgggaattctggacccactgaatggcggaactgaaagagctgtaacacaaacagggctgaaacacacccccatgctcaccatgttgtgggtgatgaggacagaagagctgcagaccttcggggagcccagacttaggggctccctgagccagggctgtgacaccctcttttgggctctgtggttcctggcatctccaaattttcaggtgccactgcgtttccctcatccagttgtgggtgcccacagcagaagctgcgtgcagtgcatctggtccagccatagctttgcgtggagctagcacctgtgccggcacctggagctgccagcgtgcctggctgtgtgcagtggctggaccctgcactcactcacacacccttcactggtccatgcctggctcacccttggcaggtgtgaaatctgggctggtagtgtgagccaagtgcagctagccaggctgagtgggcagaatgagcccagcaggtgtgagcaatactcaggtagaaggcaccactggccacagaggtttctggctggtgaagagacaccccaaggatcccatgacaataccatggtttggttacagtggccttaaagtttgaagttgagtagtgtgatgcctccacctttgttctttttgcttaggattgctttggctatgtgaaaaagcccatcatttttctactaggaaaaagtacgggacagaaaggtgtaatctgacatttataaagattccaaagctgtctagacaatgctgaaaaatttccatataagcaacattcttatctgagagtgataatactttccagaaatcagtactttctcggatactctatgttgctgttttcatacagtaaagccataagtttgatagacaacacagagtgcttgaaaaaccagaaaactcccattctgtgacataaaaattagaaaaagataattccatagtataactatttagatgttgacagggcatggattttatttatagttcaatagaagccaaatacctggtttggaatatgaatgatgtacaacacacatacacacacatgctcatacacttaatccttgataaataaataacttatgtagatatattagttttctattgctgctataacagatcagtgcaagtttggtggcttataaaagacaaatgtgttacattacattttggtaggtcagcagttcttcacagaaatagaaaaaacaatcctaaaatttataggaaaccataaaaggccctgaataaccaaagcaatcttgagcaaaaataccaaatcttgaggcatcgtatgatttgatttcaaactatactacaaaatgatagtaaccaaaacagcatggtactggcataaaaatagacacacacaaaccagtgggacagaatagagaagaataaataaatctatgcacttacagctaactgattttcaacaaaagtgtcaagaatacacaatggagaaaagtcagtctcttcaataaattgtactgaaaaaattggatatccacatgcaggagaataaagcgagatccttatctttcactatatattaaaaaaatcaattcagaatggattaaagacttaagtaggggaccaaaagtgatcaaactactaggagaaaacatggggaaacataaggcaaggaattttggggtaagaccacagaagcataggcaacaaaaaccaaaatagacaaatgggattacataaaactaaaaggcttttgcacagcaaaggaaaaaaaagattgaaaagacaatcaacaaaatgagatgaaatatgtgcaaactatgcatctgacaaaaggttaatatcaatatagaaggaactcaaaaaactcaacagcaaaacaaaacaataaaaaaatccaattaagaaatgggcaaaatacctgaatagatatttctcacaagaagacatacaaaggccaacacgtatatgaaaaaaatgattaacattagtaatcatcagggaaaagcacatcaaaaccacaatgaggtaccacctcactcctattagaatagctattatcaaaaagacaaaaagtaacaaatgctgttgtggatgtggtgaaagggtgactcctacacattgttgggaacagtgcatccactgcagaaaacagtatgaagatttctttaaaaattaaaaatagaactaccatatgatccagcaatcccactacatggtgtatattcaaaggaaatgaaatcaacatgtcaaagagattacctacattcccatgtatattgcagtactattctcaacagcgaagatatggaatcaacctaaatg

SEQ ID NO: 15202 - DNA, 27916 bp, Human
  misc_feature (1)...(27916): n = A,T,C or G
gacttgaggggtgacaggatgacccagtgagctggcccagcagtaagaagggaggaattgatgatggaaaggctggcgtcccctggtctggcctctgcaggactcgtagttgagtctccccaccccttagagtgggggtattcctggccccaaccacttcacacctttgacgcttgggggagggatgcatatacaggtggaggctgctgggagtctggggtgccatgtgggataccccagacatctggcagagctgcagtggtgccctatgggtgcagactggtttgggaccacacgtgagccaccccaggggcttccagaagggcgcagtgccaaggcagctgaggatcacgagtaaggagcctaagggggccagagaacttgggggcgtgttacttgtgtctaaaaattggcagatcgagggtcagggcatctggactgctccagtgaataagggagaatgcacactggccaccatcagctgctgggtacagccgggagagctggtggacttggaacaggaacagtctgcatggcgtgacagcgccctctgctgtccaggctgggctggcatcgatggtacaggaggagggtgatcctcacacctggcatgagcagaacctccacttcaagcagccagggctcaggagcaggagggaccccggtagatgggaaactcattcccattttacaaatgagaagacaggctaggaggagtgtagaaagttgctcagggtcccgtagctattaaatggcagagccagactcatcctgcaatgcccttccttctaccccagactgaatcattttatgcaaaatataacaggactcagggatgctggaaacagtacccttctttattctattaaaatcaaattagatctgactccgcctctggctgggctgcagaaaacttcattctgacttgcttttggagatgggagtgggtgctgctcctccctaggcctgtgcaagagccagggagtctaaggtgatgccagaaaatgggtgtgagggagtagtgtttaaatcttcagtgcgtcagcaccactgtgagagcttcgtgtccaagcctcagggggtctgtgctgcctccttgcccagtttggcagcctgggcctgaggccatgccactcgctcccctgaggccccctacagcttggctatgccatctgaggtcttgctcccccgcccccacctcagcaggtactgctgctcccagccatggagttctctcaaaacctttctcaaaccttttcctcccctccccaacccgcagcctaatccccttaaattgctccagatcctagaaaataaaagcaggaaaggaaaggttggctgaacagggaaggaaaatatgtcaagaacaaaagacaaatgattatctcaggaaaagttcctgcccctctaaactctgtgctgggcagccacacgtgcccgtgggaaagtgctgtgtccttggagtgccctgcacgctgcaactgaagccaacaagacacggcccagacagggagcaggttggttgaatccatttgcagaaacttggggcaaggagttggttgtgacgaatgtggcatgccactccccatctaaagcagtgaaagttaaaaggaggttatggaaaattggggaaggggctaaatgcccaggagcctgggttgcaaagccaatcctatctgagaagaatgaacttggggaccccttattgtcatcacaactataaaaatggcctggcaggtccaactgtggccctctggactctgcaacagccagatctgcagtcctcagttttaaatctgtaaccaagagatttggttagagatccaaattagagacctagttatccttagctgttatgttcagtccacaaatcatgttattctgtttataaatagggcaaaataaaaagtgatctttaattttctttgattaatgagctattaactcaacttgaagacactaagctctcttaaaaaaaaaaaaaaaaagcactcgtggcaatgaaactgccagcccagtgtcaccagttacccaagggtgacaccctcgtcctgctggagatggtgcatctgctgcttcgagagcccttttctaacctgggaaagcttgagtttaaacatgaagatagtgaaataaggtaagcctttagaagcaaaactttcatgctaagtttaggagtaatcttcgtatgtttgtttctttaaaatactgtaatagtctaaagaatctaacattaaagaccgacagattagcctgatgcctccagttttaaatatgtactagaatttagacttgtcatggaaccaatctaagtgtccaccaactgttgattgtataaagaaaatgtggtttgtataccccacgaaatactatgcacccataaaaaagaatgaaatcatgtcctttgcagcaacatggatggagcaggaggcccttatcctaagtgaactaactcagaagcaggaaatcaaaaacctcatgttctcacttataagtaggagctaaacgatgcgtacacatgggcgtaaagatggagataatagacactggggaccccaaaactggggaggaggctgggagggaggaggagaagggttgaagcagggagaagggttgaagaatctcctattgcatataatgttcaatatttggatgatgggtacactagaaacccagtctccactattacacatataatacccatgtaacacacgagtacatgtactccctgaatctaaaatttaaaaaaaatttaaaagaatttagacttgtgattttaagttgcaaagggaaaaaaatgaccttatttttctgaataattattggaatttcaaggaaaactgatgcttcactattttaataacattttatttcttagatttataagaatttattatttgaagatattttgcttgttaaggcaatacaattgctttgttaggcaactgaagtgcttacaaaagaaatgtaatatattacatttataatgcagttcagagtttaagagaatttaattaattaaatttacaaataattattaaggaaacagagtcttcaagttgagttaatagctcattaatcaaagaaaattgaaggtcactgtttttattttgccccatttataaacagaataacaagatttgtagactgaacataacagctaaggataactagtttatttcattttaatggaacattaatttaaaacccaagcaactgtgagtagccctttctggactgccctcagacattaaaataaaaaacaaaacaattcacaatgacagatattaatacgaatagctaacgtttgtatggtgttttacactaatgctctcttccattactaatgagaagcactgggaggttagtaacttgctcgaggccctgcgtctaggaagttggactggagcttggctctttgactccagaggctgcactcttttttttttttgagatggagtctcgctctgtcccccaggctggagtgcagtggcaggatctcggctcactgcaagctccgcctcccgggttcacgccattctcccacctcagcctcccgagtagctgggactacagacgtccgccaccactcccggctaattttttgtatttttagtagaaactgggtttcaccatgttagccaggatggtctccatctcctgacctcgtgatccgcccgcctcggcctcccaaagtgctggcattacaggcgtgagccaccgcacccggcccggaggctgctctcttaaccacggtgtcggaggatgtttgggtcttggtttctagggtctgcaactgaggtccctggagaagggctaacacttccctaacatactctagtgaatgctgtctagtcagcactcccacctgctcaaccactttggtgctcaacagaagacgtgggcagatcctggctgcctagatttgaaccccaaagtacggccacaggtgtgtgtccttacaaacatggaaattctgatatccacgtgtgaccgtttacagatgtgaactgtgagagctatgcattattttcttccttgtgaaatacattcaccattttcccacactgtctttctcccaatcgtttacattttaaaagttggtggcatttagcattacaatatagtttttaggtaacagaaagttccggtgggactggtgactgaactagatgaggaattaacgtagcccagagatggaagcagtggacttcgtgtcgaatttttcgtggagaggatgagtgtgtcttcatctaggcgagtagcggctgtgtcctgctaggcagaagcgtgggttgtagtcagtgttgtcatatggaggtttaaacatgggtgacatgggaactgtttggcggagtgcgctgggtcgtgtctattgtctctcactcaccgtctctgccatcctctctactgctgggattgggaatctgaaaattatattccaactccgttgtctttctacctgttaggttctgctaacagtggggaggggacatctggcagcatctctcccaagcagcaacggtagcagtggtggcagcaacagcagcagcagctggtgagtatgggcccctgggtaacaccattttcccttttgcttcctgtaggtagaaatctgtaggtagtcttcttacagcaattctgacacctctgtcactcactaatgctttgtgttgaatccttctgtttaaaatgtttgccgtcgtttccactctgctgattggacgctgactgatacagatctcattctctgtttgcttgttgcgctcagctctttgattttaagataggtccatcttgcactgtagacaccaggttggttgcttctgactgccacatagtaccatggagcatgcgtcggccacattgtacctccccctccctgggggattgctcattcagattgccgcccaacatgctgtgataattttttttttttttttttttttgagacagagtctcactctgacgcccaggctggagtgcaatggcacaatctcagctcaccgcaacctctgcctcctgggttcaagcagttctcctgcttcaccctcgcaagtagctgggattacaggtgcacgccaccacacctggctaatttttgtatttttagtagagacggggtttcaccatgttggtctggctggtctcaaattcctgatctcgtgatctgcccaccttggcctcctaaagtgctgggattacaggtgtgagccactgcgcccggctgataaatattcttaaacgtgttgtctttttagacctgtgtgagaattccccaggataaaagtatatacccaggagtgaaattgcttggtcatagatcatagctatgtcatatgctacgtactataagattacactccaaactagccatgctccccacccagataatactacatatattattctataactggatttctttcacttcatatatgacaaaattttaaacggttccaactggggaaatttaagaaaaaaattaaggtgcaaactctaatcaactgtggaaacaactgaaactgtgtataggataacagcttctacagtcagcctgcaaagcctgtctaccactcattaactgtgtgaccctggggtaatagcctaacctccctgtgcctgcctcagttttctcattggtaaaatggatataataatagtacctaccttattttaggatgttattaaataatgtacataaagtatttagactattccctggcacatagcaagaacccaatgactgttggctattattgttgaacatttaggtaatttccagtttttttgctatttctcaacaatgctccaatgacattcaggatttttttttttatggtggtaaaaaacatataacatcacatttaccatgcaaggtcagattctagagtgaccacctgagtactcacactagagctctggcagcaaacacgagcctgggtctaacaaccttttggcttgggactcttggatctctttagagtaacagggtctcttcagactgcctgttccagttgctgcatggtcaagacctgtggctggaagtccccttccgatggtttcctgatttctgcattgccaatcccctggccagggccagcttgagcttctggtgtgggtgagactccacagtcctaatctcaggtcaggtaggagaatgtctgtgcacagttgcatgacatgaagggacagcattgattcaaatccctgctccgtggcttagcatctgtgtgatcttaggcaagtgatgccacctgtctgagcctctgttgcctcatctgtaagatgggaatgatacctatttcactgtgttgctgggaggatttgagaattgcaatgtgtcttagtctgttcagattgctataacaaaataccatagactaggtggcttataaacagcagatatttatttcttacagttttggaggctgtgaagtccgagatcaaggcactgcagattcagtgtctggcgagggccttcttggctggttcagagacaatgccttcttgctatgttctcatctggtagaaggaataagtcagctctctggggcatcttttaaaagggcatgaaccccaatcagcagagctccaccgttaggacctaatcacctcccaaagggagtgcagttatttgcatgcctgtaactgaagaacggtcctcctctatcagggaaagttgtcctcttcgactgagcacacagcttcaagagggacgcatgtgaagtggtgagggaggaaggggatacccacctagccagcctcacatcctaccagacttttgatttctatcatttccttctgattctttcctagatttctcatctctctgcttatattatccatctgttcttgtatgttgtttactttttccattagagcctgtaatgattaattttatgtgtcagttttgaggttccaagatgcttgttgaaagtgaagatatttaaagtgttgaaagaaacaaacaaccattaaattctgtagctaatgaaattattcttcaaaagtgaaggagaaataagatttgctctcagtcaaagggtatttgtagccgttagacctaccttccaagaaatgttaaaataaaattttcagagaaaaggaaaatgatatagggccaggaatttggaactaaagaaataaagaatgccagaaaaggaataagtttagattggctgactgtagaccaaaaaaaaaaaaaaaaaaaggaataaatgaggtaaaataaaatattttaattttcctatttttaattactttgatagattattactttgttcaaagtaataatagcaacaatgtgttgggtgattatagaatacggataagtgaaatgaaagctagttgtcttataagtatagtagggaggaattgggaacagtcttgttataaatggacttctattagttgtaaatgtatatggaaaactctagggcaacttttaaaaaatgtaaagacatataattgatatgctaggagaagaaagaaaacagagtcatataaaatgcttaattaaaaccagacaaggcagaaaaagagagaaaattttttaaaggaaataagaacaagtgcaacaaataaaaaacagctatcaacctgttagaatatcaatctaactatatcaacaatcactaaatgtgaatggtctacatataccaattaaaagagactgtcagagtggataaaacaaagcaagaccccaactatatgttaagagcaatcttctttaaatataaagacccagataaattcaaagtaaaggaatggagaaagataaactatgctgtcactaatcaaaagagacctaggaccgctatgttaatttcaggcaaagcagattcagaacaaggaaagctgtcagggataaagaatacataacgatgaaggcatcaattctctaagaaaacatagcaatctttaacatgcaggcacctcacaacactgtcaaactatctgaggcaaaaactgatagaactgcaaggagaaatagacaaatccactattatatttggagaggccaatacccctctatcagtaattgacagccccagaaggtggaaaatcagtaattacatagtttacctgaatagccccatcaattgtctggattaaattgacatttatggaatacttcatttaacaacagcaagaatacacagtctacacaagctcacatgaaacattcagcaagtgtttgatatttaatgtttgtgtccctccaaaattcataggttgaagccctaacccccacgtgactgtatttggagatggggtcttgaaggatgtaattaaagttaaatgaggtcctatggggggtgaccccatccaatatgattgatgtcttttatgtctttttttttttttttttcttttgagacaggatctcactcaggcgaccaggctggagtgcagtggtgagatctcagctcactgcaacctcagcctccagagctcaagagattctcctacctcagcctcccaggaagctgggactataggcgggcaccactgcacccagctaatttttgtgttttttgtagagacagggttttgccatgttatccaggctgatcttgaatgcctgggatcagatgatccacctgtctaggcttcccaaagtgctgggattataggtgtgagccacggctctcggttggattaatgtccttataagaggagacactggagcgcttgcattctcccgtgcttctctctgtcccttcctccctctctctccacattggtcgtgtgaccacaaagccagaaagtggctgtctgcaacccaagggaagagccctcaccagacgccaacctggctggcaccttgatcttggacttccaatctccagaactgtgagaaaatacatttttgttatttaagccacctggtgtatggtattttgttttagcagcctgagcagacgaagacatcaagaaagaacacttctgggcaataaaacacactttaacaaatgtagaagaatagaaatcatacaaagtatggtgtcaaatcacaatagaattgaaaagggcacgtacacgtgagtgccctggagtttaagctccattggcttcaggcaaatctgcttctgctggtgatccccttccaggcagggcgggtcagcctctctgtgcacagctgtccactgcaaacttgtctccctctctctgtggctgggcaccaggacatgtgaagaaggaagttctcaggttatagggactcagcctccagggcacagccagctagcctcggtgaccatttggaggcctggtgtgttagtcagggttgtcttagagggacagaactaattatatatataatttattattattatatataaaatatattataattattattataaaaatatataatatatataattatatatacttaatatactttatataataaactcataataaataataattatatataattaatatatataataaactcataataaataataattatatataattaatatatataataaactcataataaatatatataatatataataaattcatatatgtttatatatgagtttattaagtatttatatatatatgagtttattaaatattaactcacaggattacaacatcccacaatagcctgtctgcaagctgaggagcaaggagagccagtccaagtcccaaaactgaagaacttggagtctgatgtttgagggcaggaagcatccagcatgggagaaagatgtgggctgggaggctaggcccgtctcacctttccacatttttctgcctgctttatattcgctggcagctgattagattgcggccaccagattaagggtgggtctgcctttcccagcccactgactcaaatgttaatctcctttggcaacaccctcacagacacacccaggatcaatactttatatccctcaatccaatcaagttgacactcagtattaaccctcacacttgataacaggagatttctgtagacaggaaagtgaggaagtggaaggtatctcacaagatggtcctgaagagacatcagagtcttccctctggccttgcaggggcctatgcaggtagctgcatggagcccttcttcgggtcaaggagatgatgtccccttcactgacttttgcacttccttgaatctgcaggggagtgtccctccaacttcagagtgagcagcagcagctgaccagattggaggacatttccactgtcttccctggcagctgtgatgtgttgtgcggtggcagctgaggattgcctgcgtgtaatctttgaggttccaagatgcttgttggaagtggagcctggtcaagcagcagaaaggacagctggatccatgctgggtggggtgaggtggggtgcttgtcagggaagttggcttcagctggaactggaggttggctccagcaaaggaggttgaacatcactgattcctgacctgcagcacccaaatggccacaaagagatgtcatgggttttgaggaggccacagagccaacagctttagtgtcttcagaaggatgaagaaaacttgaacaacattttaaaatagcttgagatataattcacatcccagagagtgcatccatctaaagggtacaattcaatggattttagtatatttacggagctgtgcattcatcactacaattaattatagaacttcttcatttactcaaaataccccagcaccccttagctatcaccctgattcctctatctcccccagccctaggcaaccattaatcttttttgtatccatagatttgtctatcctagacatttcatataaatggaatcatgcaatatacgacccttctttcactttgtgtaatgctgtcaaggtacatccacgtgatatcagttcctcattctttttatggccaaatcacattccattgtatggatatattacattttatttatctgttcatcagttggtggacatttgggttggtttccatgtttttggctgttaggaatgatgtccccatgaacattcatgtacaagtttttgtgtggacatgtgttttcatttctcttggacatatgcctaggagtggaattgagtcacatggtaactttataaccatttgaggaacttccagactgtttttcaaagtggctacaccattgtacatccccaccagcaatgtacaagggttccagtttctccacatttttttcaactttttttttaatcatttgacttttttttgagacagagtctcactctgtcgccaggctggagtgcagtggcgtgatctcagctcactgcaacctccgcctcctgggttcaagcgattctcctgcctcagcctcccaagtagctgagactccaggtatatgccaccatgaccagctaatgtttgtatttttagtagagacggggtttcaccatgttggtcaggatggtcttgatctcttgacctcatgatccacctgcctcagcctcccaaagtgctgggattacaggcatgagccaccgtgcccggcctcatctgactttttaattaaagctaccctagcagacatgaagtgatatctcattatggttttgatttgtatttctcccatggctaataatattcaggacctctttatgtgcttattggccatttgtatatcttttttaaagaaatatctattcagatcctttgcttatttttgaattgggctatttgtctttttattcttgagttgtaattgttctttatatattctagatacaagcaacttattatgtttatagtttgcaaacaattttttcccattctttgggttgtcttttcactgttttgatagtgtcttttgaagccccaaagttttttattctgatggctggtttatctgtttttttctttagttgctcatgcttttggtgtcaatctaagaatgcagtgccaaatccagggtcataaggatttatcactatgttttcttctgtgacttttatgattttagttcttctttataggtcattgatccattttgagttagtttttttatacagtgtgaaatatggatccaacttcattcttttgcatgtggaaattcaggtgtccccacatcatttgctgaggggactattctttttccattgaaagaagttggcactcttgctcaaaatcaactggccatagatatgtgggttaatttctgggctctcagttccattctgttgatgtatagatctgtccttatgcccataccacactgttttgattactgtcattttatagcaggttttaaaattgggtagcataaattatccaactttttcaagatttctttagctatttgtgttttcttgcattttcatatgcattttaaaagcaacttgtccattgctgaagtcgaaattttgatagggattgcattgaatttggaatctgggagtattgctatcttaataatgttaagtttttcaatctataaacatgggatgtctttccactcatttagatcttctttagttttcaacaatattttgtagttttcagagcataagttttgtacttcttttgttaaatatgttcataagtatctttctgatgctaatataaatgagtttttttttaagacaaagttttgctctgtcaccaaggctggagtgcagcggtgtgatctcagctcattgcaacctctgcctaacgggttcaagtgattcccctgcctcagtctactgcgtagctgggattacaggtgcccacgaccacacccagctaattttttgtatttttagtagagacaaggtttcaccatatcggccaggctggtcttgaactcctgacctcaagtggtccacctgcctcggcctcccaaagtgctgagattacaggcttgaaccactgtacccagactggaattgttttcttaacttcattttttatttgctcataactactgtatagaaataaactgatttttgtacactgatcacatatccttgtaaacttgctaaactcatttattagtttaatcattttcagtgaattccttaggattttcaacgtacaagatcatgttatctgcaaatgaagacaattgtacttcttcctttccaatatggatggcttttactttatttccttgcctcattgccctggctggcctctttagtacaatgttgaacagaagctgtgtgaacagacatccttgtcttgttcctgatcttctggggaaagcattttgtgtttcagcattgagtgaaagccctttagctgtggccttttctagatgtcctttaacaggttgaggagaccgagttcttcagaggaggagctgtgtcagctctgaggtgacgcacagcattgtcagctttctgagtctgaggtcccggctggctgggaggagatgatgtcctgaaggatgtggacatgatgggctggggctctggggacttgaggggagtccccgctgcagacctgggtatgggaataaaaaggcaatatcaaaggcagtaattggacccgtgggagtggaccatctcgggaagagaaaagagcatcggggcagagatgtgggagaggggaggggagcccgagaaatggtcagagaaggaggagaaaatccagactgtgcagggaggagagaagtgccccagcagctgaagacggtgccagagcctactggctggggggaccttgcagaagaatgggccagacccactgggggccacctggtagcccggcgctgagagctgtgcacgcggcctcacaacaccaggtggcgcggtggaccattgtaacagccactcctcttagccctggtggtttcttttcattaacgacaaatgaaagagctggggcctcgccaagcccctgttcaaccgatggaacctctgagaggggctgtgaccttcctgaaagcattacaggggcattgtggcaaaggtggggctgcctcctggcctcctggctcctgtcccaggatctctctccagtcaccccttacctaccccaaagggatctagaaaagtggctggcggaatacccggtcagaaggcagcctggaaggacttgaggtccaccaaacccgtctaggtccccagcaccacctgcttttcagtgttgcctgcggtgagatcaccttcctcagctttcccatcgattctctgctcccagttccccactccccattctctttccactcagagccacatgattttcagtttaagccgaattgagtcactctccgcgccccccccgcccctgtaacatccctcaggggctccaaattgctccttacccctacattcatctccctcatcgcagccacaccctgagcctatgctcactttgtgatttggttgttaaagcatgtcctgctttaacaacccttctcgaaagctgctagttttgcctggaacgctcctcctgccctcctgccggccccctaattagcattttggtctcagtttagactcacctggttttcctggtgcgctcccgtggtgcgcctcccctttgctttgacaccgcctttgtcatgttgacttgtttagcatcttttccctctagactgaggatccagaacagtaggcagggtccatgttaggtgcagcctgtcatcagcgcccagccatggctctctgcaggccatgggaactaaaggtggcggtgctggcagggcaggataggaggtggcgccaggagccacagggcagtatttcgaggacagccctgctgggtactaagatacagccaagagtgtctggaatgatgggcagagcatcaactggtttcagagtttgaacaaatggtgttcagaacagcatgttctgccagaatggtcagccagactgccaggactgagggtcctacagaaggaccccctttgtcattctcacttccgtattccagaaccgggggtattttagtgtgtgggaaaataaagcaatcgttgagttcgatttcagtcccaagttttggaaaacgtgtgggtgcatctgcagtagataggtctcagcacggcctttgttccaacccagtcagaactcaaccagaattggggccagtagatccttgagccagacaatgacaacatggaggtacccataaagcctaggggtgacaagcacccagccatgccattcctgtggatacgagggttgttggcccataggacaaactcttcacaacatttccctctcccttccctcttgcagctagttgcatcagtgggtggtaatagaggttctgaattttcccagtgcatgggcgggacggctgaggggctccatgaatgcaagtttattacacaaaggaagtcacctatctctttatgtacatagagacttccagaaggctaaagaaataaaaaatgatctaaatgagcttttctcctttgtatttcatatttcagtgttacaaatatataaaatctttttttgggggagtattcaaacttggacaatacaaattaggcagtccaggggctgggcatggtggctcacacctgtaatcccagcattttgggaggccaaggtgggtggatcacttgaggtcaggagttcaagaccagcctggccaacatggtgaaaccctatctctactaaaaaaatacaaaaattagctgggcgtggtggtgggcacctgtaatctcagatactcagaaggctgaggcaggagaatcacttgaacctgggaggtggagcttgcagtgagccgagatggtgccattgcactccagcctgggcaacagagcgagactccatctcaaaataaataaataaataaataaataaataaataaataaaaattaggcagttctttgtttctgcaggaagctttgactctgacaaacaggaacaagactgtggtctttgaatctggctctttacctccagccagaatctcctcaaaatcgttatcccaaacttgcccacttcctgaagacagatgattctttcttgtggggaagtacaatgcaggaagtgggcaagtttgggataacgattctctgctaaatggattgaaatttaacattggaaattagtccaatgtagtcatccagataatgaaaattaaactatatacatctctatttgtagtagagatggggtttcaccatgttggtcaggctggtcttgaactcctggcaggaagtgagcgagggagaggggtgggcagagagatgggagagggaaagaaaatcaggactgcctctgtatggagggggactgaggaaaattctggagacactttgaagtagcttcaggctgagacagatgtcatcaggagagccccttctgaaagtgactccaaacatcttgggataaaggtgttaaaaacataaactaggtcactaggaataagtatataaagcagtgagtgtgctggtcatattgtccaaagacaacctcaggatatttgacttgctgactgggcagtgtaggaagtgaggttgcacaccccagtgtgcatgaacctgaaaggagctgctcctctgtgaagcaggaggttgaatgaggtggtttttctatgccttgtcagtcttctgtgggactaatagtggtcatgttgggagagctggagagtttagcaagaagacaggaggcctgtccctctgacctctccttagctgcccccctggcatcacagtgcacaccatgttcttaaatttaggccaagtttgccgacaaaagtgatataggtgagccatcggcaaaagatggagaagggaaggccattgacatgctattccactcaaccttttgttcgaggacaagatgcttggtttaggctggaatctatagtttcatttgtttggaatcaatgtgtgctatggtctgaatgtttgtgacccccaaattcatatattgaaatcaaacacccaatatgacggtgttttgaggtggtacatttgggagatgattaggtcatgatggtagagcctcatgagtgagattaacaccctcacaaaagaggcccagagagctcctacaccccttccaccatgagaggacacagcagaaagatagccatctatgaaccagcaggtggcacctcaccagacactgcaccttgatcttgaacttcccagccaccagaacagggagaaatacatttctgttgtttatacaccacccactgtatgttattttgttgtagcagcctgaacacatgaagactgtgtgtgtgtgtgtgtgtgtgtgtgtgtgtgtgaaggttttgaaagtgacccccttttcagcttatcacaatggaagctcacgcagctctagaacaaaaccccataatcaaaaggtcttttgtccaccattattttaaatacaaggttgtatttaaatgatcagatctgtagtaattaccatcttttaaaaataatctttgagtatataatgatggccaaaaatttttaaaaagcaaatatgcaatacaatagagttatattatattggtttccaaattccatgtaataaactcatgacaactgccttgaacgcaaatcacagagcctctgactcaggaatttccctattagagtctgaagctccagcccacactttgatataccttggcaggtctctgaaaaggtagggtacacatgtattttgtaaacttcagcagtaagctggttttctaaaatgtatggatatgtacacagacattaaatgggcctatctggcttttgacactttttaaaatacgatttaaatcactaggacaattacatataaaaaaaagcaactgttcatttattgcttcagttacctatattccattcctcttagcataagactcccttatcccagattctagactcaagagctcttcattgtattcaatcttagaccatcaactgcccatcttcatgttccaccaaagatatgaaatcaaataaaatcaaaacatatttatttaatgcctacgacaggcgaggccttgttataggttcttgagatggaataataaaattctttcactgcagagtttataacttagttacagatgtacacttgaattactcattgctttagggctgatggtcaatttcttcccacttcaaatgagccagtctgatgggacatcttgatatattatgagtaacagtcaatgcgaaactactttttcatttgactactgttcttgtttttttttgagacagagtctcactgtgtcacccaggctagagtgcagtggagggatctcccctcactgcaacctctgcctcccaggtcccaaagtgatagggttagaatgtagccaaaacgaagtgatccatggttttagaaatctttaacaggctgggcatggtggctgacacctgtaaccccaacactttgggaggctgaagcaggaggattgcttgagtccaggagttcaagacctgcctgagcaacatagtgatacccccatttctacaaaaaactaaaaattagctgggtgtggtggtgcacacctgtagtcctagctacacaggaggctgtggtgggaggattgcttgagcccaggagtttgaggccagcctgcacagcatggtgagactctgtctctacacaaaataatttgctgggcacagcagtgcctgtagtcccagctacttgggaggctgagggaggaggattgcttgagcccaagcattcgagcctgcagtgagctatgatagttttcaagatactagaaaagtaaaagaaaagaaactaaaaaaaggaaaagaagaaaaaactcactaatgtgcaaaaagaaaatatttgaaggtttaaaacccactggtaaaattaaatacatggataaacccagtattactttaatactgtaattgtggtatataatccacatcataactatggtatacaaatctatctatctagtataaagccccaaatacaaatctatcaaaaacaataatagttatagcaacctattaagagatagggaatatcggccaggtgtggtggctcacgcctgtaatcgcagcactttgggaggccgaggtgggcagattacgagatcaggagatcgagaccatcctggctaacatggtgaaaccccatctctactaaaaatcccaaaaattagctgggcgtggtggcaggcacctgtagtcccagctacttaggaggctgagccagaagaatggtgagaacccaggagttggagcttgcagtgagccaagattgcaccactgcactctggcctgggtgacagagcaagactctgtctcaaaaaaaaaaattaaaaaaaaaaagggagatagggaatataaagatatataaattgagataatataaagccaaaatgtggggaggatgaagttaaagtgtagaggttttttcagttttttgtttttacatttttctttgtttctattttctgtgtgatctatgctgccatctctttaaaataacttgttgtatctgtaagatttttttggtaagcctgatggtaaccacaatgcaaaaatctataatagattcactaaaaataaaaagcaatgcgttaaaacatactatcagagaaaatcacttaccacaaaggaagacagtaagaaaggaagagaggagttacaaaacaaccagaaaacaagcaacaaaatggcagtagtaagtccttacctatcaacaaaaacactgaatgtaaatggactcagttctccaattaaaagacatagaatggctaaatggataaagaaataagacctgactatatgctgcctacaagaagatcatttcacttctaacgtgaagggatggaaaaagatattctatgtaattggaaaccaaaaaagagcaggagtaagtagctgatataagtaagtacttacatcagataaaacagactacagatcaaagactgtaaaaagagacaaagaagatcactaatgataaagggaataattcagcaggaggaaatatgtatcaatatctatgtactgaacaacagagctctcaagtatataatgcgaacattaacaaatctaaagggagagatagactgcaatacaataatagtaggggacttcaacatgctactatatgtgatggacaggtcatccagacagaaaatcaagaaacactggagttaaactacacaccagatcaaattaggcctgacacttacagaacattttacccaactgctgcagaatacacattttcttcatcagcacatggaacattctccaaaacagactgtatattaggccacaaaacaagtctcaacaaatgcaaaaaagtagaaatcatatcaagtatattttctgatcacaatggaataaaactagaaataacaaggggggccttgggaaatacacaaacacatggaaattaacacactcctgaatgacctagggccaataaggaaattaagaaaattttaaaaatttctggaaacaaatgaaaatggaaaatgacatatcaaaatgtgtagaatacaacaaaaatagtactaagagggaattttatagcaataaatgcctgtaacaaaaaagtagaaagacttcaaataaacaacctaatgatgtacctcaaaaaactagaaaagaacaaactaaactcaaaattagaagaaaagatataaaattcagagcagcaataaatggagactaaaaaataaagaaaatcaatgaaatgaaaaggttttttttttttggcaaaaactaaattgacaaacctttagctagattaactaagagagaagactcaaataaataaaattgtaaatgaaacaggagacataacaactgatgccacagacatacaaaaaatcattagaagctgttatgaacaactacatgccaacaagttggaaaacctagaacaaatgggcaaattcctggacacatacaacctaccaagattgaaaccatgaagaaatagaaaatttcaacaaaccactaatgagtcatgagattgaagccataataaaatgtctcccatcaaagaaaagtctaggacctgattgcattattgctgaattctaccaaacatttaaagaagaatgatgaccaattccattcaaatgcttcataaaaattgaagagaagggaatatttccaaactcattctataaggcttgcattaccctgataccaaaccagacaaagacacaaccaaaaaagagaactataggccaatatcactgatgaacatagatgcaaaaatcctcaaaaaaatactagcaaatggaattcaacaacacattaaaaagataattcatcatgatcaaataggattcatcctagggatgcaaggatggttcaacatacaaatcaataaacacaatatatcgcattaagagaaccaagaacaagaacgatatgattatttcaatagatgctgaaaaagcattcaataaattaaacatgcctttataagaaaaaaaccttcaacaaactaggtatagaagaaacatacttcaaaataataaaggtcattagctatgaaaaactcctagctaatataatactgatagggaaaaactgaaacccttttctttaaaatccggaaccagacaaagatgcccactttcaccacttttatttgacctactactcgaagtttcagggcaataaggcaagagaaagaaataaagggcatcaaagaaagaagtttaaattagtcttgtttgcagatgacatgatattatacttagaaaaacctaaagactccaccaaacaactgttggaactgataagtgaattcagtaaagttgcagcattcaaaatcaacatacaaaaatcaatagcatttacatatcccaagaacaacaatctgaaaaagaaatcaagaaatcaatttcatttatggtagctacaaagaatacaaaatacctaggaatcaatttaaccaaagatgtgaaagatctatccaaagacaactataaaacactaatgaaagaaactgaagagggcaccccaaaatggaaagatatttcacgctcatggacccgatgacattcttcacagaaatagaaaaaataattccaaaatttacatggaaccacaaaagaccccaaatagccaaagcaatcctgagcaaaaagaacaaagctataggaatcacactacctgacttcaaaatatactacaaagctatagtaaccaaaacatcatggtactggcatgcaaagacatcagaccaatggaacagaatagagaacccagacccagatataaatccatgcgtttatagccaactcatttttgacaaaggcaccaagaacatacaatggggaaaggagagagtctcttcaataaatgatgctgggaaaactggatagttatatgcaaaagaataaaactgaacctctatctctcaccatatacaaaaaccaaagcaaatggattaaagatttaaatctaagacctaaaactatgaaacactccaggacattggtctgggcaaaaatattttgtgtaagagctcaaaagcacaggcaaccaaagcaaaaacagacaaatagaattacatcaagctaaaaacattctgtgcagtaaaggaaacaatcaacaagtcaagagacaatccatggaatgggagaagatacttgtgaactatccatctgacaaggggttaataaccaaaatatataaagagttcaaacaactcaaaagtaaaaaacaaactgattttaaaatgggcaaaagatctaaagagacatttctcaaaaaaagacagagggccaagaggtatatgaaaaaaatgcttaatattactaatcatcaagaaatacaaatcaaaaccacaatataatctcaccccagttaaaatggatcttattaaaaagacagggaatgtaaatgctggcaaggacgtagagaaaggaaacccttgcgcattgttggtgggaatgtaaattagtacagccactatggagtattgcatggaggttcctcaaaaaactaaaaatagaattaccatctgatccagccattccactactgattatatatccataatagtctgttttcacgctgctgataaagacatacccatgactgtgaacaaaaagagatttaattggacttacatttccacatggctggggaggcctcagaatcaaggtgggaggcaaaaggcacttcttacatggcagtggcaagagaggaggatgcaaaagtggaaacccctgataaaaccatcagatcttgtgagatttatgcactaccatgggaacagtatgagggaaaccacctccatgattcaaatgatctcccacagggtccctcccacaatacatgggaattatgggagtaaaattcaagatgaaatttgggtggggacacagagccaaaccatatcaatatccaaaacaaaagacatattgaagatatatctatactcccatatttattgcagcgctattcacatagccaaaacatgaaatcaacctaagtgtccatcaatgggtgaatgaataaagaaaatgtggtatatatacacaatggaatattattctgccataaaaaggttgaaatcatgttatctgcagcaagatggatggaactggaggtgatgttaagtgaaataagccaaacacagaaagacaaatatcacatgttctcattcctatgtaggagctaaaaaagtggatctcatgaagatagagagtagattggtagttaccagaggccaagaagggtagggggaaatgaagagaggttgattaatgggtacaaacatacagtttgataaaagaaacaagacctagtgtttgataggtcagtagaatgcctatagtttacaataatttactgtgtatttcaaaatcactagaataattcaaatgtttctaccataaagacaaatatttaatgtgacagatatcccagttacacagatttgctccttataattacacaaatgtattacattatcacatggaccctcaaaatatgcacatcactatgtatcaatcaaaaattaaaattaaaaaaccctaaaactgaaattttctgcagctcaaagttctagaagcatgttaaaatacagaacatgtgtaagtcttcctaagttgcctcagaaccagtgatttcatttatgtcggagggtgtgtgtgcgggtctagaatgcaatacaaagctgttagtgtggcagtgaattctcagttactggagatcaactttagaacacccagaggcacctagcaaaggtctgttttcagaagagtgtgtgtggggtgggggagtaatgggggcacagctctgaagtgaagatgcaacttccaacaaatgaatgccaaagtgtgaaaagttcttgagaatgatctccagccaactcctattggctggtggactctataaaaggtctacaaaaatatacctttttagggtatctacttaccacctgagtaagtaaaagttgagagacatgagcaaagcaacctaaggatgcaagaagggccttacagggaggagggatggggatgggagcaggcctgagaatggctgcaagctgaccaagtggaagctttgagcaccacacatcccagcagccttgagaagcaggtaggcaagtctcctcataccagcaaggaggcgctcgtagcattaagaacgttgtctgaggaagttccggcttctccaataaccccctgagggatgtaggggtggagctgtgtggtgtaagcccagcaccacctgagccacaagggagctgtggaccatcttccagagtctcaattttctaaactcatttgatgggtgataatcttaaaacattttctcttaaacaagcagtagcttatagagtaggaaataaaattcatacaaaattatctgtaaagacacaaaacgagagaaatatgacttttgctctcctggccactctgagctggatcccagaccccaggagacagaagggactctgctttgaatgctatgacctgactcctggccctgcatatggtgaggaggagggagatgggaagacgttcgaatgggctggggccaaggctgcactggggctgcacaagcagttgcaggaagggaaagtggaggcaggtagcattagtgacaagagcagccacagagtggagaacagcgatggcggcagccgagtctggggcaggctgggaacagagtagcagatcttctgatatcagaggctagagccattaagagacagaagctaggggcagcctgtctttggggaggaagccaccgacacccagcatctcttcagaagggttcacagttgtctggactcaagcagcttgcaggaccaggtgccttaattctctgtccctcactactggcatccacagagaggtctccgcctagcagcagcatccaagaaggaggttttgggtagattcatagacataagcacccaaattaaccagactacgagagttcctcaaaagtttttattctttttcatctttttaaactggcacactgcctggtatacaccgccaggtaggcattcagaaaagtttcttttttttaaatacacaatttataatactgggaagatttcatttcagtgtttcccaaaacattattcctggaaagggtgtactctcccatgactctggataatagaagttttgttctgattttttaagtcacctcagacagacactggaacacgttagatctaacacttaagtgctttgaaagggcagtaaaaaatccccaaggaattcaagaattgtaataattgctgggaagactgtggtttctgtagcccagggtggcttcacagttgtcagaggtcacagattctatgtccctctccgaccagggacctccaggacagcttccctggttggttctcgagtctttcagcagaaggcagaccaacagagaagggttgtgaccttctccaaccagcccaggcctcacgccgctgcatcgcagacccagtatcagcagcagagctacggagcacgtcatcctgggagtggatcctccgtgggtcacaccaagcagcgcagcagggaaccagaatgaggttcagggccaccatcaaaagagtgacctcccctctccttccaattagttacctgtattcaatgtgcagtgtaaacgagcagaagttttacaaattaaattactttcttaaaaatcaatacaacatcgttacatacaattctctttgagaagtctttccaattcaattcttaagtttcatttacaaaatggtgtgcaaaaacaaacactgacctcaaataaataggaaaaaaaaagtgggaagagctaaaattttttttgtgtttttaaattaaaagttaaaaacatgagctgcacttcaaagtatctgcaggatggagaaatacatcaagaaggctgtcaaaaacagctctcagagttagagttgcattttcaactgaggttttctgtgttcaaaattcacgatcaatgcctccactgagatctttcaccactccctctttgaccagctttaagaggaacttggtttccgttgtcacattatgcatggtctgaaagttcatagcagccatgcattgactgtcgaagtagtgcaaaggtgttctgggttgattgaggtcatatccaaaacccgccaaactgacttcatcgcacagatgtgtggctaagacaacggcaatgacaccgattgtggggacgttctgagaaagggaaaagaagaccaaaaagtaaaaaaaaattttggcacaagtcaccattttgctggtattacacatgctacgcagagtcatgaaagctacattgggggctgcaatttcatacatcacataattttatacatcatgaactttagagtccaactctccatttaagtcaggaatctaggctctaaaacatggtctgtgatgttcacacactttcaaggggcagcctgacaattcttacaccaagttaaaaggtattccccttctaggccaggtgcggtggctcacgcctgtaatcccagcactctgggaggccgaggtgggcggatcacgaggtcaagagtttgagaccagcctggccaatatggtgaaaccctgtctctactaaaaatacaaaatttagccaggtgtggtggcacacgcctgtagtcccagctactcaggaggctgaggcaggagaatcacttgaacccaggaggcggaggctgcagtgagccgagatcgagccactgcactccaccctggcgacagagcaagactctgtctcaagggaaaaaaaaaaaaaaaaaaaataaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagagctgctaagccagtttcttcccaccgtctgtttgggcaagtaaattttgtttttttttttgagacagcatcggtctcactctgttgcccaggttggggtacagtggcgcgatcacggctcactgcagccttgaccttcacaggctcaggtgatcctcccacctcagcttcctgagtagctgggactacaggcatgtgccaccatgcccagctactttttgtatttttttgtagaaatagggtttcaccatgttgcccaggctggtctcgaactcctgggctcaagcaatcctcccgtcttggcttcccaaagtgttgggattacagccatgggccaccatgtccagcctcaagtacatttttagtcctgaattaaatatttccacatttgttcctttaaaaatgtatcctactgaccttggcctagaatctccattgtctaaacctttctagattctgatggtgtccccactccctcctcatgtctggcatcttgtcttgcttcctggaatgtgcaaatct

SEQ ID NO: 15203 - DNA, 11280 bp, Human
cccatgaatcggtggttcccccttacctatgggggatgctttccaagacccccagcggatgcctgaaaccagagatacgactgaaccttacatacatgatagttttcctatatgcgaataactatgataaagtttattttataaattagacacagtaagatattaacaacaatgaataatgaagtaaaacaattgtaacaacgtactctataaaagttatatgaactagtctctctctctctctcagtatcttactgtactgtaccttaggtaactgaaagctcagatcagggcaagagattgtatctcaaagtcaccctcttccccatagagattcttcctacatccttcctcttgatcttgttcctacaattctacaatgaacatgaattgcttctgcaataatgaaatagggcaaagacaacttatttttaaacttgtaagtgaagagtagcctattcttctgacttaaaaggccaaaagagtaagagaaagatagagacagaaaatgagagagacacagagagagagagagagagagagagagaaagacagcaagtagtgcatgacctgagcctccctagcatctactccagctgtgttagtgaagtcccacagggagaggtagaggctgcccctgcagatgcccagcccagggagtcctcccgtgacagacagaactgctaaggaaccaggactgccaacgtagaggaggatcagagccctgggagcaaggggcagattcaggcagggagagcagaggcagtgggcttcagcccctcaacctccaatgggctgagctcaggtcacagggtgacttccatgggccaaggtgctttaccttatgggtcccttctcctcccaaatattagaaatcatattgtatagctgcactggtataaaggcaaatgtactatttgatcttagaggttcatttccttccttctgattttaaaagaagctctaatactgttgtgggcctctagaagcactgtggtctctgagcactgcgtctggggtcaggccctggctgagctttcaatgtagagggggaagagaaggaggtgtgaggggctggtaggttctctggaagtcacatccacttgctagtttcggtatcatcacatgcaaaatggagataaaaatacctccctggggctgccagagggctaaatgagatggcgtctgtggagtggagcctcatctctactctctgagacagggctactgtcaccagatgaggaggatggctcaggatagtgtaaagaatcagtgacaaagaaaaaaaaaagactatgaaaattttttaaaaagggaatactcaggattttcaaccataactgaaattaatttcgctaaaatgagaagttttgctgaagttgaaggaaagggattaatatgacaaatccatccagggcatgatcaagcaaggcctggctcccctcccaggagtttgggacctggaaaagctggaaaaggctgagaaggagctttctccaagagagagagagagagagagagagagagagagagagagagagagaccagaaccttagagagacccagctccaagcccattcaaaggggagcatgaaggaaaaaggagaaatgactgcctaaagaagacattgaaaggtagagcgcatgagggccaggtgagccgagggaaggaggcccccggcttcacactcaggggaggggcactggcagacaggggagaggtcaggggctgagctgagaggagcttagagtgcaccagggtcagggccttgcccagggcagggagagggtgcagtgaatgctggggcccagggcactctttgcagaccttgtttgcctacatggatggaccttcacatccctccatccgtttgctgactcattcactcattccttcactcatacggtgctttcaaagagcctactcttctccatggagaaccagatggcccaggtatgagtggttgaggggctggtgccccgatgaggtgggggcaaagatgacctctctccagggtgatgtgaggaaatggagctccggaaggtaagaggcttgctccccatcacacagctggcgtgcgtggccaagagcagggcctgcgtgtgttttctgggctgtctccaccgcagtgctgactcctggataaaaacatgaaggaggctgggcgtggtggctcatgcctataatcccagcactttgggaggccaaggtgggcagatcaggaggtcaggagattgagacaatcctggccaacaaggtgaaaccacatctctactaaaaatacaaaaattagctgggcgtggtggcacatgtctgtaatcccagcaactcgggaggctgaggcaggagaattgcttgaaccagggagtcggaggttgcagtgagccaagatcatgtcactgcactccagcctggggacagaacaagattccatctcaaaagaaaaacaaaaacaataaaaaccatgaaggagcagcatcgggagcgagagggcctttccctggtctctgtgggaccacacagatgcagatggccccctgtcattgggtatgactttcagtggcaaaggggcaaacatctgaggagtctggagagcaaggagggagcagggcagtggggaggaagctggcgtttaagcacacacgcacacactcagtgagcggaagcaattaagcacaattatgagcacataccaggcactacactaggatgtttatctgtgagaatgcactgaatcctccgaacaaagccctgaggtagagactgttattagctccattgacaggttcaggactagccgtagaatttgcagagcccagtgcaaaataaaaacatgaggcctcttattcaaaagagaagaatttgaagatagcagtgacagagcattaaacctaggaagtgcgggaccctgctgggcaggtcccatccctgtgaagccatccctgtgccagacgatggaccagcaacttgtcccaggtcacagccagctcatagtggatccagacccaaaacctcatcctcagatttcaaagctaaccctttatcactagcaaattgacacaaagtctatttgagctaaaggtttaagaaaaaatacagaaggggaacctgaacttgaagcttcaagcattgctaaggcctgtgtgtaggtttcagcaagagcactggatgagtttctcaagcgaaagtggatttcatatccaatgggcccctgttgcccggtgaatacaggagaagggcttggctgggccccacaccagaggcatcattgttttatcaggttttgatctggcaacccataatttccccccttttaagactgtgctgagaatacatgtgctcatcggctgctgacaaaatgtgaagattctccatgccagagttcaaggaggaagagtggcagtgctgggctgggtcagctggagaccctgtgcctgagcccctcgtaaaaatgcccactgcgtgtgggagcagcgggtgtgaggcgccctggcagtggctctctgcgaggatgtgtcagtcaagaccatcatgtgcaaagtgcagataaacagagccatcagggtgtgccaggggtgcagggagataaccaaggccaccctgcccagggctggctctacatgccccgaagcggagcttcctcccctgagccctggaaagaggtcactgttgtgcctgctgggccccaagcagtgtgtgaccacagtgttttggcaataagagaaggggcatctggtaggctgggcacagtggctcatgcctgtaatcaatcccagcactttgggaggccaaggagggtggatcacctgaggtcaggagttcgagaccagcctgaccaacatggagaaaccctgtctatactaaaaatacaaaattagccaggcatggtggtgcacgcctgtaatcccagctactcggcaggctgaggcaggagaattgcatgaacccaggagacgcaggttgcagtgagccaagattgcgccattgcactccagcctgggcaacaagagcaaaactccgtatcaaaaaaaaaaaaaagagagagagagaaggggcatctggctttcacatgcataagcagaagcaggagagactagaatgcaattccatagagagttctgaaggaggggtggtgacgccagcagaacgggagagggagcagggaccacagagccaggcaggttggcagcaagtcttgctctgcccccatctacagctgggggatgccaggcgaggcaggcacccctcaccaagcccagggctcacttgtgaaggggtcagaactgcagaggctctccaggggctggagaagtcatgccagggtccacccaaccctcgccttgcctaagaaggaacccagtgtcgccggcctggctctgcctgcacatgggaaatgggctcttgccagtttctgccatgggttaagattttgtataggaacattgttctggaagaatgtagaaaaatgaaaatgtatagtctaaggagaggagccagcattctgtcagaagttccgattatgtaaggatctgaagaaaaccccaggccaagatgagagggaggtggggtaggggaagggagtggatatgaaaatgaaccccagctgggtgagaaggtgggaaggactaggtgggattcctggggcccaacaactgtgcctttagaatttgtttggggttgactcctgtccatttcaacttagtatttactggcctccaagtccatgccaagttctggaccaggagctcctgagtgaaggctttttaaaggctcttttggtattggaatggtggcagtcctgggagcgtgggccttgggtcatccctgcaatcatccacctgcctcaaagtggctcagcaaacccctgtctgtgacaggccctgagtgggggacaggcggggtcacagagcccctggagaggtcagaattctgggaaaaggcagactcaggaatctgtcagggctgcaaactgtgcccaaggctgtggtgggtcgttttctaggcttgggaaactgggtcctagcagaccagcaggtgagtgtgtgccaggcccgcggcgtgttgaggggcctgtcgtgaacagttgtgagaggtgcagctggaaaggcagcaagcctgggacggtgcgtgagggagggctcgagggccaccccgagccagctgctaaggcgggcaagggcagcagcagcccagagcatgccaggcctgaccacagaaagcacagcatggacacaacggtggactggggtgggacacaggcccggctgaggagctgggggaggcaggcgggtcctgagtgtctgtgcatgcagttcctcagtgtgcagagccacagcagcaggccctgcctggcacatacaagctgtgggcccacataccctgcaactctctccttgggttggcctcagttgcctgtggggtctggcagtttgtaactacagcctggctgcgccctcagtgtctgggtgccctatggcggcttatctcccccgagcctctggtgtttcatccgaaagtctctacaaaaaatacaaaaattagctgggtgtggtggcgtatgccggtagtcctagctacttgggaggttgaggcagagaatctcttcaacgcaggaggtggaggaggtggagggtgcaatgacctgagatcacaccactgcactccagccagagtgacagagcacgagactctgtctcaaaaaaaaaaaaaaaaagaaaagaaagaaaaagaaaagaaaatgcctatcatagcaggtgtgcaggggagacccaggaaagccccttaccagggctcggcatctaagtttgttgttattttatcaaaagcgaaaaacaacagctgtctggagggtgactcctgaaattaccagcatcctcaggccaggtttgctccaataaatttcgctaacaaaagccacctcccaagcctctgccactgggagcaggtccaggcccttctgctgttgctcttcgggtgactctggggaagtggctgttatcattcccactcacagatgggaaaactgaggtgctgaggtatttcctctctctcccaaagctggtgaacattggagggcagtcaaacccagggctgactccacagcacggatgttgctctggcctctgctctgcccctcactcgtcatgtgatgaggacacgtcctttcacttctggggcacgtttcctcacgggggtggggtgctgacaggaaatggacaaaagcatcaaccgacacttccccgaaaagtaatacaacctcttatggaagtaagaaaacatgctcagtctcacttaattacagaggctcattccaaagtgacagcgtttgttttgttgttttacctctcagtttggccaagataaaaaatgcagtgtgagtgaggacgcagggaaatagtgactttcataggctatttgtgagcatgagaaaccggtgtgacctttaggagggtagtttcttaagatctactaacattttaaatgaatacacactttgtcccagaaatcaaatgctgaggtgggagaatttatcctaacagtttacagacacatgcatgtaaaatcctccttactcattgtcacaggactgctgtgtgtggtttaaaaaaattaaatgaagtctgcatacagcctaaatgcccatcagcagaggaactgattaaagaaaataacaaggtataacctttaagagatattctgatggaaaaaaaacaagatgaagtaaaatatataaaatgcatttttattatgtaaaataagaaatatttgtatcagcaaatttacttctagaaggattatcctcaataaataaagtaattgccattgaggtagggagaaggtgtctttctcctatttttaactcttcattcactgttaactttactgtttgtttggttttgtatttagagcgtgcttgttggcccactgggtatgctcagttactggaagatgttttggctgtggcctcagacaggcacttgaggcatagatgtacatacaggtctgccacctgaagaggcaaactgacttgacttggcccaacctctcacctctgttgaggggacctcttcctactcactgcagatgggttcacttgttcccaccacaagcgcagaatgccttgtacttcacaaccctttgctccccagggagctctgcaagtccccagaaatacttgcccaaccacgggcacccttggaagggtccagctgctgaccaccagcatcatgtgactcccagtgccagtgacatctggaggaattgagcaatggctgaggtggaatttcatttggcacttaatgcaatcctctgcttctgccagaggcggtgaattctatataaagctgccaaacctggccgtcttctcactgagccttgaccccttccatccaagggcaaggcaatggattgctgtgcatgactcacgcgcagtaactgtggcattggggcctagcccagctgagctgagcagagcaggccggcctggcggaagtgggtcctctccgctctaacctctggctctgatgagcagctacataaactgagacaggatatagacacatcctgcctgagttagcagcaagaaatagccgccccccaccccccctgcagttctcgcacagcagggatcctgccataaatcaatccgaagtctaatgtggaatggcttgcaagcaagggctgcaccgctgtttgtctcccaaggcaagtgttgaaggtctgaaacctgagtcctggagaactgcttgggctgctgggctgggctgggcacgggggcgggggtcaggcaagcccatcctcttcagacatgagaatgcctctcagcctcacctcctcagtgactgaattggaataatgacagtggctcctgtccctttaacccaggacctgccgtatacacacacataaacatatgctcaagttacgtgctccgggaaccacagtctcatgtgcaattatataaacatgcccagcacggatccagcacttaggatgtgtcagactccgtgccgggacatttatacgcacttcgtgctgctggatgagttatctcctgttattattcctactttcctactttgcagatgaggaaactggagctaagagaggctgccttgtttataggcagtgcagatgatcccagtgcagactgaggggcctcgctcccaagcaccactgatgcctgcgcactcccaggctgacgcaagcacaaccacaggcacatggagtgccgtgtacacacgtagaccgaagcagcactcctccacgccaagctccaagctcaggcggggtgaggggtgaggcctcacaaccccctggatttcaaagacttataaaagagttggtgtctccaatacccatatcattatcatatcaataaggtatcattgtcacatgataggctcaggatatctcctctctgacagactctaagaatcagaccgcggcagggtgggggtaagagggatgtacattaggttttttggtaaaatcaaatggtagtttttattgcaaaagtccaacggcagaggaagagggcagagagaggcccagcaatgtttccaagcatctacaaagactttcatcacagatgatttcctctcagcaagaaaacgtgatggtttaaaagagaaaaccagcagcgaggaattacaaatccccaaaggatccaggccgcaggattccctcgcatctgtgtgcctttgcggcgcccagcggagcgagcaagtccctgggcaaggctggagttgcctggagttcaccggagcctggccggtcggaccctggctggggagcagcacagaagcaacttgtgatgtgaactctcacctaactgttctttagggagacaattctggccccacacatttcacatgccccgcacaaagaaacagaaagcgggcgacacgccctgggagggcgggctggcggcttctccagctcggagcgcgtggaggctgcgcgtaggggtccgggacgcgggacagggactccgcgcagcccaggcgccggggaaccggggctggagtcggggatctgagcccagcggacgcctcctccgcctggaggcccggcacggaccgggacaccagggcgtccgtggccgtggctcggcccctggctgctgcgggccgcggcctccagtgggtccccaggacccttccccacggcgggtactcaccgaggctgagaggccacgccgtgctgttggggcttctcgtcgaccacattcctgggcgtcagcccgggcagagaccgcggggactggccaggccgggccaggccgggccgggggagggtcgcgctcccgggctcctgaccctcggcggcgagaggaagcggcacctgggtcacactcctcccgcgcgggccgaggggaggggctctggcccggagataggcagacttcatttattttttttctgcagacttggctggtggggtttccacccccttttttttttttaaacacacacccgcccacttctgaactcttctttgctccaactttcctgcgcaagaaccacgcttttctaaccgtttctctttccatctgccactaccggatacagaggttgtggttgagaattccccctggagtgcagggaaaactccccaatgtgacatgatggcctggcccagcactgtcggggatggtgaccaaatagggcagacctgtgttgaaatcttggctggctgcgcggccgctggatagctgggcggcctctctcagctgcggggcatttgtccctggagagagtccctgtcttgttggcctttgggggccctgtactcatggatgggctgttgagcaaagatcattccaaaacaggaagaattgctggacaagagtcgtgatttgttcccattgcttttgtctgaagctgccagacacagtgcagtttgtgaattcgctctacttttgccatgaaaacctccacgtggatttcgatacatacctttgttggttaaatgcagtcaaatggcaccacctacaaaaaatgtatcatagcattatctgccccttctgcccagagacaagggcagggaacttgaggcccttgttttaaatccccacccaggggaacaccctgtgcttctcctgtgtgatgtctgaaccttcctgtgctgcttttcattgtttactttatagttccccaagcacttttgtgacgcccacctctcccctaccttctgccattaaggcctatcctgcacaatccggagagccaggccagctgtctgtacaatgtatgggcggtgcctttgggactgtcatctgcattgaatacaatgagaggctgcgccctggagatttgcaacacagaggctttgctcacctctagccgggctgcacaaactccaggccttcttgacgcagtgggaaagcactcatgattcactttagttagatcatgaagaacccccgatgctgatagatctttactccaactgccatgtgcagcacagccatgttgaattgaaataaactactcacagaatgcctttggcctggtggggaagccctgagtcttgatttcctcatctataaaatggaggcaagaacacctgcattccggggttttacagaggcagtgattgtagaatcacagtgggaacagaaaaggcatttaataaacagcaatgagtaatgattaatttatttttatttatttatttatttatttttctgagacggagtttttgctcttgttgcccaggctggagtccaacggcgtgatctcggctcaccacaacctccgcctcctgggttcaagcaattctcctgcctcaacctctcgagtagctgggattaccagcatgtgcctccacgcctggctaattttgtatttttagtagagacggggtttctccatgttggtcaggctggtctcgaactcccgacctcaggtgatccacccaccttggccttccaaagtgctgggattacaggcgtgagccactgcacccgtgattactttaacagtttaacttttttttttggtaatacatacacatacgtctacgtggaacagtagtcccgctcctctgtcctgagagaaaataactttaattatctgaaatgcagctggaaagttggaaagaagcagaaagttctgccaggtaacaacggacaagtcattaggtcattgcagcacacttagagaagtcacttttacagactcatttagaacctactggccttagacgtaatcataagagatttccttaatttcttagggtaagacaggttgaaggcatcaaaatgttgcagagaa

SEQ ID NO: 15204 - DNA, 11280 bp, Human; identical to SEQ ID NO: 15203

SEQ ID NO: 15205 - DNA, 18197 bp, Human; identical to SEQ ID NO: 12597

SEQ ID NO: 15206 - DNA, 9173 bp, Human
ctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagacactgctctgccatgttttgtattttggcgagaagcctgaaactagcaggtagggtgcagtggagcagtggacgtaaagctgccctctgtggcggggccaggtaggagcaagcaaaagaacagggtctgatgatttcctagagactggagggaaatgggggaacacactttaaaaaatgaaacaatatgaagccaacggtgctaacttaataatgtgcattgatcaaatgtccaatttgttgagtcactgggcacctggcatggagttgaaaagcacaaggcccagtcaggaagcggttgccaggccaggtgcgatggctcacgctgtaatcccttcactttgggaggccgaggcgggtggatcacctgaggtcaggagttcgggaccagcctgaccaatatggtgaaaccctgtctctactaaaaatacaaaaattagctgggtgtggtggcgtgtgcctatagtcccagctactcaggaggctgagacatgagaattgcttaaacccgggaggtggaggttgcagtgagcccagatcgtgccactgcactccagcctgggctacagagcaagactccatctcagggaaaaaaaaaggtttcccagtgggactttacctgcagaggctgtggctgggggagcggtctgggaagcagagaaggcggaacactaaccttggaggagaacctgactgaagttctctggtctagcctggttgggggagactcgagccacactcctacgccctgactctgagaaccatggctcccaatcagtgctgctgctgggcctcctcaccatgaggccagggcaggctcaagggcaggaaatcgaacagtggactagatggatggggcaggagaggaccggacactctgtcccttaaggggagagttgaaggatcaggattgccccagcctaggaaagagaaggccaaaaggcaacaagagagatgaagtgtgagcaccaaggtgtgacatcctctggggaggtatattctagatgatcagtgtggggaatgggggtactttctacagaggggcccccggatggcatggcttcctcaagagctgtgaggtcccaggcagtgggggcatcaggccaagctgcacagctgcttgtcaggttgggggtgggggctggaccagcaacaccatcctctcccctctggaccacgcccccccatcccagatctcttctgactcttgggactgtgtaattttcaattcttcgggaagtttgagaatacatttataagagaggatgtccggagagcagtggacatttcacaagcccaggtcagcagctgccgctgggcagcaactttatggttcccccaggtgctgaagtgcacctgcaggttgacttgatctactgttaacagagggtgatcagtttgactcatgcttaagggagagacgacaccaacacacacacagaggtttgcaagagtaaggcagggtggatccaaacattcttaattcaatactaggcacgcgttctcgcagtggacatggcccaggtcctctggctgtgttggtgcatcagacagctcggcccttccatgaggcaggtgccctctcgtggcaggcctgggaaacttctccactacaagacgtcccttccttccaccaccacccaaatcagtcttccacttgccttaagtttctgctgcacgggaaacagagtcagaggtgtcaaagtgttgcacaggattctattttgctgttgttagaattttgctagtgataaccagagaggatggaggaagaaagttgacagtatgtgtcccagagaacagcaatttcaatttccccagcagagtgaacctgctggggatgccccaaggtgcccgcaaggatgttcctttcagccaaaatgaacatgtgtggtgatcccccaggcctgtcctaactagtcatccagagccgagaggggagtggccccagcggccagaactgggagagagccctggagaccactttgtgtgactccttcctgcacttagaggggccctgagttcaggcaagcaatggaactgcccctccctacccacccctccattcccagccatgacgggcagcgccggcatcacaccctgctctccggcttccgtggcctgccctgtaagtgaggcaggaaaatcgagtctggaggcaggaatgtaaggctgattcacacttcaactctaacagggactatcccctccacagggagtatgccgagtaaatgactttgtaactttactttatcctcttcatttacatagggcccccaaagtaaccaatggaaacctctagagggtatttaaaccccccaaaaactgtaatggggccattgagcccctaggctcgggccgctcccaccctgtggtgtgtactttcattttcaatacatctttgcttttgttgcttcattcttttcttgctttgtttgtgtgttctgcctaattctttgttcaagacaccaagaacctggacactcaccaccagtaacataagcactggctcaatggtccattgacctgtgcagaacagacaggattataatgatgtctgctcagggaccttcactccaggcacatctggggctcaggggaccccataggatggggctgagttaggagcagagcaatgacagggccaggagtgtattgaacaaaccaaagtagaaagccccagttttctggaacccagggtctgtcatgctgcaggtgcttaataaatgctgtggtgccatccatgtgagatgtgacttgctcctccttgccttccaccgtgattgtgaggcctccccagccatgtgagactgcaagtccaataaacctctttcttttgtaaattgcccagtcttgggtatgtctttatcagcagcgcagaaatggactaatacagtaaattggtaccagtagagtggggcactgctgtaaagatacctgaaaatgtggaagcaactttggaactgggtaacaggcagaggctggaacagtctggagggctcagaagaaaacaggaaaacgtgggcaagtttagaactccctagagacttgttgaatgtcttttttttttttttttaattagatagagtctctttctgttgcttaggctggagtgcactggcacaatctcagctcactggaacctccacttccctggttcaagcaattctcctgcctcagcctcctgagtagcttacagtagatcatgggcacctaccatcatgcctggctactttttgtatttttgtagagatggggtttcaccatgttggccaggctggtcttgaacttttgacatcaggtgatctgcctgccttggcctcccaaaatgctgggagtacaggggtgagccaccacgcccagccttttgaatggctttgacaaaaatgctgataatgatatggacaatgaaattcaggctgaggtgctctcagataagagatgaggaacttgttggtaaccggagcaaaggttactcttgttatgttttagcaaagagactggtggcattttgctcctgccttagagatttgtggaactttgaacttgagagagatgatttagggtatttggtgtaagaaatttctaagcagcaaatcattcaagtagagacttgggtgctgttaaaggcattcagtttcaaaagggaaacagcataaaagtttggaaaagttgcagcctgacaatgcaatagaaaagaaaatcccattttctgagtagaaattcaagtcagctgcagaaatttgcataagtaatgaggagctgaatgttaatccccaagacaatggagaaagtgtctccagggcatgtcagaggttttcacagaagcccctcccataacaggcccagaggcctaggaagaaaaagtggtttcatgggccaggcccagggtccttgtgctgtgtgcagcctagagacttgatgccctgcatcctagccactccagccatggctgaaaggggccaaaatagagcttgggctgtggcttcagaggttgcaagccttaagccttggcagcttccatgtgatgttgagcctgccagtgcacagaagtcaaggattgagatttgggaacttctgcctagatttcagaagatgtatggaaacgcatagatgcccaggcagaagtttgctgcagggtggggcccttatggagaacctctgctagggcagtgcagaagggaaatgtggggttggagcccctacacagtccctactggggcactgcctagtggagctgtgagaagagggccaccattctccagaccccagaatggtagatccaccaacagcttgcaccatgtgcctggaaaagctgcagaccctcaacaccagcccatgatgcagccaggaaggaggctataccttgcgaagtcacagaggtggagctgccccagaccatgggaacccacctcttgcatcagtgtgacctggatatgacagatggagtcaaaggaggtcattttggtgctttaagatttgactgccctgctggattttggacttttaaggggcctgcagcccctttattttggccaatttctcccatttggaatggctgtattcacccaatgcctgtacccccgttgtatctaggaagtaattaacttgctcttgatttcacaggctcataggtggaagcaacttgccttgtgttggatgagactttggactgtagacttttgacttaatgctgaaatgagttaagattttgggggactgttgggaagacctgattggttttgaaatgtaaagatacgagatttggggggtgcaggggcagaatgatatggtttggctctgtgtccccacccaaatctcatcttgtagctcccataattcccatgtgttgtgggagggacctgataggagataattgaatcatgggggtgggtctttcctgtgctgtttttgtgatagtgaatgggtctcacaagatctgatggtttaaaaaatgggagtttctgtgcacaaactctctccctgcctgctgccatccatgtaagatgtgatttgctcttccttgctttctgccatgattgtgaggcctccccagccatgtggaattgtaaatccaataaacttctttcttttgtaaattgcagtcttgggtatgtctttattaggagcatggaaacagactaatagaataataagaaggagtcatttgagggacctctccaacaggacaggctgcaggaactgagggcaccaaccacaggagcaccaagtctggccttgcctcacctttggtcctctgaccagcagcctcaacatcacccccttataaggaaatggaggctggtcctactcaccaggcagaacttcaaagatgcagtggttactttgaaaaaaaaatcgcataatttatttgcatgatattcattttcacaattgaactttacagtttaaaaaagatacaaaaaaagacaaacagttgttcacataaataagaaggggcaataaagaaggaagacgttttcaccattacaacaccttttaggatgtgtcttggggagcaagcaccttacagtgccaactgtttccaaggtccctgggaatgctgctctctacagaggcatgtgcacagacggatcctgcaaatgggattgcaagactttccatttcaaggttaagtcctagctgtagaatcattcatttcattcttgcaaaccagcctgcttggccaggaggcagaaccatggtagagtagtgctcatggttatggcacttggcaatgcaaaagggacccttcccctggttggaaacccacagcattggaagggaccacagagagtccaaaacaaaacacatctttctcttcttcgccgccaccatgggcactttgcttcagcacattcatttatagaacgttaagtcaggagccagtcattttgtcaaagcagctgaaataggccaccactcttacttggcaaagatgatacagtttcaaagagttaaatgaaggtggactacttggagacatcaaaagctaagtttccaggagcactgaggtagcaatgtgtagaaacataacatggaaacagtgtaccttaaactgagcatccttgatttcccccatggacctcaatttccagtgactagcaggcctgaagaggccaacatggtgccagacttggcgccctgccaggaccaaggggcatgtgcactctccagggtgctaggagcagggtcagggaggatgaggaggaaggctgagtctccctcccaggagccccacccaatgtgcaggtggagacctgcaccaggagtgctcagggcaagttccttttcaattgcttccctcgcaccaagggcactgtctatattctcaccccataagaacaaaaatgtttctgttccccttacaagtgactaccacgtcaccacccatgaagggctggtccctttatttctggccaccatccagggctgctaaggctctaagaacccatcagcaaaatccccttgtggagaggtaggctggggacactaccaagtggccccagagggcagccgctgcaggtgccacctggctgtctccctttccatgtctctcctttttcatctcaagtcatccagcagctgagaggtgacagctccatgctcatccaaaattggcccctggaaaggactcagcaggaagatctcaatggggcagcctccacccctctcctccacacttgaccgccagtgcccacaaccagccggccatcaccccttgcggacaaggggttagggagagcaggctgggcaggggagccactgcagcctgcacagaatggcagagagtgccaaagccagacaagttcactgtttaataaaaatgaagtgacctctgaatcatctctaagagtaaatcatgcacggggaagcaaaaccagccccattgttttcttgtaaaacgacgtcaaggacgaagaccatgtggattagccgtctgcctgttcaaataggaaaaaaaaaagtgtgttattttcttaagacaaacaaaggtggaaaataattttttcctctaggttcgcatgaagcacttagaaaccaaataagcaagcttaatagcacaaagggatcattcttctctccaacgtgttggtcagagtcaggctgagcatggcggggcaggagctccggaaggagcgggcagcggatgtggaggccggcacaacaggcatctcttcagcagagtctgggcctcccccggctgctctcctgccacgcagcccttccctccctgcacagccatgcggacccacctgcagccgccaaacacacctggatcatttcctagctccatcctggtgcgagtccgcccctcagcctggctgaccatcccagccctgccagcttccctcctgccctgcctcctcctcctggggtcatctgtttctagcactgggccctgggccaggtgacgccccctgggccccatggtcatgggaaggccctgagtcccgcgtgtcatttgaaggagacacaggtcgggcctcagcgggaaaggccccctggttctgctcctccttcaacagactgggcatctgggagatttgggagaagacagaatagactgctttcttccactagtagcccagccccagaaagcacagaaatctgagaaaactatacgtctgaggtcctggagatgagaagatctggttctcaccccctatctggacaatgcccaaagccagggctctgctaagcagagacatccatgaggctcacatggaacccctgagaccttccctcgtgcttgagtctggggcatcagagaaccctggctgctcctgcccttcctaaccttgggggctgcccaggagccactcgatggccccagaaaaggatgggcacagccggctcttccctctgctctctataaatcaaaagtttcatgtgaggccgggcaccgtggttcacacttgtaatcccagcactttgggaggctgaggtgggtgaatcacctgaggtcagggcttcgagaccagcctggccaacatggagaaaccccatctctactaaaaatacaaaaagtagctgggcgtggtggcgcatgcctgtaatcccagctacttgggaggctgaggcaggagaatcacttgaacccaggaggcaaaggttgcagtgagtcgagattgtgccactgcactccagcctgggcgacagagtgagactccatctcaaaaaaaaaaaaaaaaagtttgatgtgaggtggcctgggtggaacagctgagtcagctgagccagaacgaagtgtggttggcagagcaccaaggaatttcacacaagctgagccccagcgcttttcatccaaacaccaggggaaatatgcaagtgaagccagtgagaggcaatgggcaatgggtggacactggggggatggggctgtggctggaggaagcagagtttgcttcatgctgaccagtggtcaccagtcagcttccagcagcagaaccacgcctaacagatgtctggctttggctcgaggaatcggagaacacagtcagaaggaggacaggatagttaccctcatttgtcgataaatccagtccgtgaataccatcacattcccgtacactcctggtctgtaagctttggcacagccagaaccccagcttgtatcccctatcagccaccagatattgttcttcgaagtgaccagaggccctccactgtcaccctgtgggacac

SEQ ID NO: 15207 - DNA, 20093 bp, Human
acacagccaaactatatcagaagggtaagggtaaaccatcactatttgccaatgatagagaaggaaaaccaaagagaatcaatgaaaaactgtcataattaaaataaggtttcaataaggtgaccaaaataaacatacaaaaatcacacagctttttattacaaacagcttgaagaaatagtcttagatgggaagaccacttaccatgaagacaaagattctcctgatgtgaatctaaaagttaaacaaaacctccagacaaactccagagagcattctttaatatgggggtgggagaatgcccagacttgacaaataacaccaaagttcacatacataagacatttttggaaaagatgagaaacgaggctttatttgctccaacagatattaaaagtatgagaaccacaaccatgaaaacaacagaagctgatgtgagaaacaacactaaaattaaacagtgcagacacaggtccagcgacaatgattttagcactcatacaggtggcatttcggtcagtgcatgatgattcagtgggcgaagcatttcagatccttgtctcatatcacacctcgaaatacattcctggtcaattaaacactgaaacgtactcagagaaaaagagatgaaagtgtaaataatctttgtgtgagaaaggactttccaagcatgacctcaaaggctagagcataagagtcttcgttttaaaatgtgcaggcatttctgatttaaaaatgtaaactatagcaggttacatcaaaaaggaaaaaaatacagttaaatggcaaatgatgcatgaggaataatgatttacagtgaatatgttacaggtttgctgtgcttaatatgtacaaatatcttacaagccaacaaaatattttcaaaactaaatgccttcttagatagagaacaagaatgggcagttatcacagcagaacatatatgaacagacttcaagcacgggggaaggtatgttcagccacagtaggggcaataagaaggaaatctatacagaagacaccaattttatgttctcatcaggtcggcaacaggcagagaacaaacaggccactgctggcaagactcctacattctagagggaatgagggcttcctgttgaacatgctgggaagaggagacttaccaagtgctgtctgcaggccgggctttgttgctttcatgcattaacccgttttaacgccaacaacagcaggatgaggaagattctcttattcatttcatcagtgagggaagtcccacatccaatagacagtgtagctggtgtccatccaggagcctgccctagactctgctccctcatccccacttgtggctctacctgccccactgcctcccacactgctggtataagaaatctcccctgtgcagagcatgtctcagcaagccactgggaccaactcacgcacagtgatgcatgtgcacggatggctgccacggagcagaagccttgatctctccatctctcaggaggaagtttgctaaacttgtacattcatgttacttgactgggaaaatggctgtgccatcactttaagtggaaaaagatgtccacagagtatgacccatttctgaaaggaaaaccacacacacgtacacagaggaagaaagtgtgcagaatggtgtacgctaacatgatcccggcaggtgagaggaagaaagtgtgcagaatggggaacactaacctgttcctggcaggtgaggggaagcaagtatgcagaactgtgcacgctaacatgatcccagcaggcgagaggaagaaagtgtgcagaatggtgcacgccaacatgatcccagcaggtgacaggaagaaagtgagcagaatggtgcatgctaagatgatcccagcaggtgagaggaagaaagtgtgcagaacggtgcacactaacatgatcccagcaggggagaggaagaaagtgtgcagaacagtgcacactaacatgatcccagcaggcgagaagaagaaggtgaagtgagcagaatggtgcatgctaagatgaccctggcagatgaggggaaggaagtgtgcagaatggtgcatgctaacgtgatcccggcaggtgagaggaagaaagtgtggagaacggtgcacgcttacatgatcctggcaggtgagaggaagaaagtgagcagaatggtgcatgctaagatgatcccggcaggtgaggggaagaaagtgagcagaacggtgcatgctaacatgaagccagcaggtgagggaaaggagaacagtgcacactaacacgttcccagcagctgagagaaaagtggacaccagggccaggagacgggggccctcgaggggaatgcagggaggactctggggcaggggcaaatcactgtcaatgttcagcttcagtgctgggtgcaggaacactggcatgaaccaaggagtacaatgaatcaaattctgggcccctgtggcccaaaagtaaatcaattaaattggaggggcaactatttctccatgtggagttataagtgatatctattttcatctttaaagttttctacattaccaaaatagtacctaataatcacgttagttttacaatcagaaaacggtggcagcaagcaatgacattaaactgaacatttttattccaattattcaagtttttgctgcacagtattttcaaatgttttattttcaaaatgactattacaaaaaatgtagtttccagaatgtcatggctacacctcaacctactccactcttgcagtgggggcaacagctttaggagcagggaccgtgtgtgggggctgcacccttgcagtgcgtggcctggacacggcccaagccctccgccgcccacagacaacactttcacattgataaatatgcatgcccatcaaatcctgctgtaaaccaaaactaaaattctaagtcccccagccaactgagtgcatccccttgcagccaccgggacccaaagaaacctgaaaaaccagttcaggccatgaatgggaaggagggctcgggatgccccattatacctgccccgctctggaatttagacacaactgaccaacattaaaataaaaacagagatcctagactgacaaaacagactctctgtagcaataagatacccaattcaacgggactccggtatagcatcacatgacacacagtagccccgaaggaatcaaagtattttacctcaaaatatatttccttgacatatgttgaaatggcccttgcaaagctgtctctcatgggggaaatgtgcattctgcagagaatctgcttcccttattaggctttttctggagactctgacaccttttaagggcctataagagacatgcacatctattctctctgaagcctgccatccggaggcttcatcaacataacaaaaaccttggcttccacaaccacccccgcccccaccttaactcaagctgagttcaactttttagacaaagcttaactctttcaacccattgccaatcaggaaatttttgaatctacctgtcagagacgtgtgaaccagagcaactccatcttgaatatgagctgggtaaaatgaggctgagacctactgggctgcattccccgatggttaggtagtctaagtcacaggatgagataggaggtcagcacaagatacaggtcttaaagaccttgctgataaaacaggctgcaataaggaagctggctaaatcccaccaaaaccaagatggccacaagagtgacctctggtcatcctcactgctacactcccaccagcaccatgacagtttgcaggtgccatggcaacgtcaggatgctaccctatatggtctaaaaaggggagacatgaataatccacaccctgattagcatatcatcaagaaataaccataaaaatgggcaaccagcagccctcagggctgctttgtctatgggtagccctttttttattcctttactttcttaataaatttgctttcacttcatgaacttgcactgaattctttcttgcgtgagatccaagaaccctctctcggggtctggattgggacccctttcctgtaacatctttctggtgaccatggaaagaaccatagtgtggaaacccttgactcaaaggtttactttggttaagtgatggggtcctgtaacatctttctggcgaccacagaagtgactatagtgtggaaaccccagacccaaagagtaactttgggtaagtggtagggtctggtaacgtctttctggtgaatcatggaagggacgatactgaggagacccctcaacccaaaagaagtagactgcaccactggttggccgactttgaataagtggtggggtacctgggtaaaggatgggattgggttagaggcccaacgtaggggagttagagtctgtcctaagacacagtgggttagaggcccctcttaaggaaaggtaaggacgcttgctcaaccttgggttagaggcccaactcaggagggttagagtcccttctcagatttagggggttagaggcccctctcagtaaggtccctctcagtaaagtcgcttctggctaagagcaggtttggcactatgggatgttaactgctattctcttgggattaatctgccttgcactctttgctgatggctgtgagtgacagaattagccacgtacaggattgtaggacttggggagttttttcctccttaaacggggaaacttgggagctgacgggactgctggaaaagatcccttcatgactgacaagcagccacctaaacttttcagtgttgctgcaatggatgggtctttctctgacctccctgagcgcctcgccttccccatcctgcctcaggcaatgcttttctctctctgtgcaaactggttgaataaattgtaaaaaataattgtttatctcctgtaaagttttgattaatggaataaaggatttgtgaggctagtcttaagctgtagccaaccaggtctggtgtgctttctgtgtctttctgtattgctctgtcataaagaggagtaccttaggatagagcacggacttaggacacctttaagcctgcttttcaagacagctcagcaaactggtcaattacaaactttgctgcaggtccctcaaaaaactggatgaggtttccttcttgtcttctatgttcttgggagcttgaccttgtaaccatgtggccatgctttctcttttcacaatggtggcccaggttcagggttcaattcctggcttggaaaataagttctttatcttctatgtatttatatgtattatgtgtgtgatgtttatgaatgaaagagctttaactaattggtttaaaaataagtgcttaaatattttgtcagaaaagtaaaaagtgtaatgccttttagttcatgtgactgaagtaatctttgggaaataaggagttttaaagattattggcaaaataaaaatatcttcaaacatgtaaacatttggtctaaattatgcaggtgagatattaagtttgctaaatgctttaaggtcataaactgcttctttgacttttttttttttttttgagacagagttttactctgttgcccaggctggagggcagtggtgcgatctcggctcattgcaagctccgcctcctgggttcatgccattctcctgcctcagcctcccgagtaggtgggactacaggcacccgccaccacgcctggctaatttttttgtatttttagtagatacagggtttcactgtgttagccaggatggtctcaatctcctgaccttgtgatccacctgccttggcctcccaaagtgctgggattacaagggtgagccactgcgcccaacctgacttttaaaaattattcagtttcctactctggagcattagattctagataaggccagggacatgtggagttagccacgcccctagctatgctggagtcagcccccttatctgcacttctgcctggtgtgtcctaggctaaattccacacctggtacacaattagaatccccaacttaccaaggttttcaccaagagtaaaagtcactaacaattaacatcgtcacatgtaattaagactgctaaaaaaaacagttttacatgcaagatgtgtaagaaaagtgaaatgtgtcttttggtaaaagattataagaacacatggaaatgtggatttttcttacctagattaaagagttaaagaattgttttaggccgggcgcggtggctcacgcccgtaatcccagcagtttgggaggccgaggtgggcggatcatgaagtcaggagatcaagaccatcctggctaacacggtgaaacccagtctctactaaaaatgcaaaaaaaaattagccaggcgtggttgtgggcgcctgtagtcccagctactcaggaggctgaggcaggacaaaggcgtgaacccaggaggcggagctcgcagtgagctgagatcatgccactgcactccagcctgggtgacagagggagactctatctcaaaaaaaaaaaaaaaaaaaaaaaaaaaaaaaggattgttttaaattagaatcaagctgaaggtttacgcaagttgtggaaggcttgttataagttaatcttgtaaaaaaattctgggtgtgaacaaatgggctaaagttaaaggggtattattcagtttttctgtaaactgaacatgggaataaaagcataacaggttttttcttcgagcaaaaacctgcctatgacctgctctttaataaaaatgtgtaaagggttatcaaaggcttatgagaaacttaccttatggccaaactgattaagtttgaacacatttgtctataagatttcattaagaattaattggctttgacatcaacagtgcactaatgcaagagtgacgtttggcttatttggtacaaaaattgctcaggaagcattatcaaatgtgaaatggtgtttggttttctttgggctgttatttgtataaatgtgttattggtatatgttccaaaagtatgggaaaatcctctaattctaatgtgacttactgtatgttattaataattataattgttacataaaatcattgcatgccacaaaggtaaccaaatttcatgtttttgattgtggctgccctaaaatattttgttatccacagacaattgttatcttgttttaatcctttttagaaggtggtttataaccaactatggagctctcacaggggttcttaaacgcaggtttttaataactttggaaattgtgatattagaatggaggaaaaactttcagaactctcatagagagctgaaatgttcatgaatatcaagcaaaacaggagttaactaaattaactgaaccaataaaaaactgaagtaatgtttttaactttacttaaaatgttgctgatcctttgtttcgtttttcagagtcaaggaaacttttcttttgagctatgtacagcttttagcaattgagtaaaatatactcctgtgaacaaaatttggagcatatttctctgttttctccagaatttggaaactatttgtgagtattcttaatttaatggcaatatagttatttgcataagtgcaataaacatctgatttcttttgtaacaggagacaattggaaaaactggttattttaccaaggctttaactggaatgggatgctttgcattaaggaatcaaacttgacttgtaaagccaataaaagccccttggcgaaatgcctcataccttgtcttcacagtccctgtatggggttcctgacctgtggtaaatgaagaatgtcactttctgacaggtccagtagccccaagctatcttgaggctcaagaggagaggaatttactcaactcataggtatttgagggtacaaacccatggcagggcctggctctaaaaaagtcttatctgagattccttctatggaacacagttccatcaaagccaatttaaaaagagcttatgtgaaaaataattattcttgctgtactttatacaaacaatcaggccaagtataataaaatcagtcttaccaagatttgtttttagtaaaaatggaaaatgggaaactagagagagaaattatgtttcaagaactatggtacacttcttaaattctagtttcattgttgtttttaagtttgtttctgcaatttaggctaaccctgcttattcctgtgaaccaaccagtgatctctggctgctgctcagaagaaacaagagggatggataatgtaaacatctggatcagtattctaattctgggcacattagaatcagctaacagccccatgtcagcttagttccaacatgcccagttcatggaaagccttctaatttagttcacttgggatagctttgcttattctgttatattgctgttgtactctttgtgtaggaatataggacaagcttactgaatgttttcttaaacacttaataatctttcatatatcaccttttgtgagaactcaagagttatgaatggctctcaccattccaaggctttctggctgagctcttctctaccctgaacagaagagaccttaataggcaggagtatcatggaccctattcaccctgaagaagttacagaagatggatcttcatccctctgcaacccttaggattaaaggttgtcttataaaagggaggggagaaatgtcagaggcatgtgaaccagagcaactccatcttgaataggagctgggtaaaatgaggctgagacctactgggctgcattcccagacacttaaggcattaagtcacaggatgagatgaggtcggcacaggatgcaggtcataaagaccttgctgataaaatgggtggcagtaaggaagtcggctaaaacccaccaaaaccaagatggccatgagagtaacctctcgttgtcctcactgctacactcccaccagcgccatgacagtttacaaacgccatggcaacgtcaggaagttaccctacaaggtctaaaacagggaggcacgaatccaccctttgattattatatcaccaagaaataaccataaaaatgggcaaccagcagcccttggggctgctgtatggagtagccattcttctattcctttactttcttaataaacttgctttcactttactctatggattcaccctgaattctttcttgcatgagatccaagaaccctctcttggggtccagatggggtcccttttcctgtaacacacctatacctagaagcctgttttcagacctttctgggctgaaccaatgtgcactctccatgtactgactgacctctctgcctctaacttctgtccccttaaaatgtataaaatcaggctgtaacccagcaatcttaggcagctattctcaggacctcccagggctgtgtcacaggtcatagtcttcacatttggctcagaataaacctcttcaaatatttcacagagcttggctttttgtcaacactgccagtaaagtgtgccagctcccacagttggcgaatgaggacctttccaacaggtggatatgaaaatgcaaaccacatggtgacattgtggcatcgcaaagctctcctgcatgagaacccgtcgtgtctgacatggtgacatcgtggcatcgcaaagctctcctgcacgagaacccgttgtgtctgacatggtgacatcatggccacaggcatcgcagagctctcctgcacgagaacctgtcgtgtctgacatggtgacatcgtgacatcacaaagctctcctgcatgagaacccgtcatatatgacaccgaagtcaaatgtgtttttttctgtaaaccttgaacatacccttgaccttgaacaacttctgtgacctgctggtagaaaaacaggtagtttcagaccaaaggctggacgagaccacaaaccaaggtcccaagtgataaaaaaggcaaaacatgaaaacccctccggagatgcccaaagctgttacttgggagacaaggacagctggggcctgctctggagggtggtgaggcaggagtgaccgtgactctaactcaggctggccaccacctagaatctagctgcgggcacatcagaggacttgggagcctgttccttctcgcttagaaaagctacaggtctaggtaaaggagccgtccacacacacacggcctgaggcatcctatgagggggacccctggtggaaatctgcatgaccccagttgacagcccacgcaggcccaactgctcttgggctgggacccccaggcagtggggctggggaccccgggcccgtgaggcctgtgggtggcagcctcagtggggaatgagcccctccgacactggcaggcaccactgacgtgttctctgggtttgtactcggaactgctccatctaattcgcaagggcctgagcactctcattcccattctctctgaaagcaggaagagtatcatagacaaaacacatgtaacccacgaagagtttgtttaaacccaaggaagcttctaaaccagagtaagatgaattcaggtggggatgctcctgggttcgagtgacaatggataccagcacctacctattgcgtctcagccctgtgctggggcactcaggcaccagggaggtcccatggcttctggtcccgctcggccacctcctgctgtctgcctgcggcagtgtccagcctattgggaccagtctcctctctgcagatgcagcaaacggcacagctcaccccacgcggttggctgagcgtcccacgagatgatgaatcctgagtgctcagtaaggtgctggcaggcggtaggtgatcatcaaagaagtcactaattacccctcagatgcccctggagccccagacgggtgggatgtggtgggggggtggtgtcctgacccttttctaacatgaaaatggcttcagaagtgatttccagtgctggaaattcagtttttaaaaacattctggaccatgcccttcagacgctcaaaagttctctgggctacctggaaaaataagaactggtcttatttggttcggcaccgtcctgagacatgctgggttacatctgtttgatgggctgtggtgatacgagtgtggccacgggggtcagggggcaccagagtgacccaactccctgctactgaagacgaaggccttccgtgccctgagctgatcagaggttaagaagcaggacccagatgcaaagacagaactgctccgggaacctaacactgggaagggcagccaagcccatggccctgcagggagcaggagtgaccgggggaggcgtgcactgatggccccggtctgctgcagtcaggctgtggccagcgccatggggacaggccacatgtgtgcaaggacttgctgggtagactctgcagggacaaacagatcatacatgttaccaataaagtgatttgtatataactggcggcagggggaggggggcggttggagactgaattgcccattcaaatcattagactttttaaaaaaacatttcctcgatggaaatttccagttccacaaaagaaagtaatcaaacagatgttcctccttaagtcttaaaccacgacattcagatgatctatgtgcaaattaataaggttatgacataattcaattatgtgacaaagccgagggagagttgacaaagaaccagactggcatcattgacttctcaatgaagtggagctcggtaaaaaatctagatgaatcacaggttgtctgaccagaagatccctgacaatgggctgtttactttagagaaaggagctgaaccctgaaaactgaatgtgcgaaattctaattatcaaaaaacccacggcgcatcaggtagacatgatcatctgcatttcttttccacgctgcaaatcaccgcgatcccagattagtccagccggccgggtgcctccctcccgtccgcctgggcagttgaggccaatcagcagtttaggcgcacaggtgcgggctcagaaagcagcagcaatctccggtgtgttctggaatcagaagttgaggtccacgtctgattagttcccttcgtttcattagacttggctgaatgtgtgccagtcccactagagcttcgatttcagacttcctatgacaggtttgttcacagaaaactctggccaccaggatgcccgctccaacaccttgctttcctgcaggacagcgccccagaggtttttgtagagctgcaaacaacacgtacacagcaagtgaagacaaagaaataagaaggaaaagattcctagatggctgagtgtgcaaatgcaactcctcaaagtttttgttaaaaacacaggaaattcggctgggcacagtggctcacgcccgtaatcccagcattttgggaggccgaggtaggcagatcacctgaggtcgggagttttagatcagcctgaccaacatggagaaaccccatctctactaaaaaaaaattcaaaattagccaggtgtggtggtgcatgcctgtaatcccagctactcggaaggctgaggcaggagaatcacttgaacctgggaggtagaggtttcagtgagccgagattgcaccactgcactccagcctgggcaacaagagcaaaactccgtctcaaaacaaacaaacaacaacaacaataacaaaaaagcacaggaaattctctgtcactttttagagaaattttaaaatggtttaaatttatatgaatattttctttttttttctagtagaaaacaattaggacaattcaattataaagtactataaaacacatttataatgaaaatcacccctcgccctcttctttggaaattattggctgggtgaggtggctcgttcctgtaatccctgcactctgggaggctgaggaaggcagatcactggagctcaggagcttgagaccagcctgggcaacacggcgaaaccccatctttacaaaaaaaaaaaaaaaaaaaaaaaaaaaaaagcaaaaaattaactgggcatggaggagttcacctgtagttctagctacttgggaggctgaggtgggaggatcacttgagcccaggaggttgaggctgcagtgggccgagattatgccactgcaccccagcctgggtgacagagtgagatcctatctcaaaaaaaaaaaaaaagaactgatcgtggcagtggacacgctgtttcttagtaactgcagccaccgcaggatgctgcaaggctgcatcgactgctgctctgaaatctgctctcacaccccaggccgctacaggccgcacaggtggcacgtggccaccagcagcaggatgccctcgccgagtggcccttactggctgatttctggacctgggccaccacaccctgctcctctggtcctgccccgggccagcactcccctacgggaggtgcagacttcactgctctcagcctaagtggcctcactgggaagatggggagagacgctcctgtcttggaggaaggttgtacaaatgaagggcgaagggcagctgagcagacacttcacccgtgcagggtggaaaggggcagcccagaccatctccagggcctggggaggtggtctattttgcatccagcttacgctgacccattttattgagaagaaacccctctgcctgcacccgctaaatgcacttagcaacccctcctccccactctgctactctgggctccacagacacagacccaggctgctgctccacagggcctaggttccagcttatgtttcacagtttggagcagcgggcttgatttaaggatggtctcaactcccctgcagctctgtttgttcgcttatagtgaatttctcacctggcagctcctggttaatacaccagttccttgcaactggaaggaatgcacttttttttttttttttgagatgaggtctcaccctgttggccaggctggagtgcagtggcgcgatcactgcccaccacagcctcgacctccccaagctcaggggatcctctcacctcagtttttgtaatttttatggatggggtttcagtatgttgcctaggctggtctcaaactcctgggctaaagggatccgcccgcctcagccttccaaagtgctaggataacaggtgtgagccaccatgctcagccaggaatgcacgtttaataaaccatcctgccagcgacacctccagctggctctggttttaactatggaacccagagccagggggcccctccatcatgggcaaggtctctcctttccttggtcgttccctgcctcagagacgggcctgcctctgcagagcaaggcgcagcaggtagacgctcaaggccgctccggcttctcctgcacggggcagacagtcccgtgtgcttgggggtcctccatggcgggtctggctccagtgtcccttcgaatgcctgtctgcctggtgagcccccacctcctggggagactgcctctcccaggaaggtgggtagggcaagtccctctcctatgcgctcccccaggacccaaggctcccgccaagtcttctctccctacagcagggcacagtctcttcaaatcctggctctgccactccctggctgggaaacccactgggcttctctggctctcagctctcagcggcagtcatcatctgggctgtatgggctctggggatggtcagtggtcagtccccgatgcaggacagcaggccctctgcagagatgaccatccctgcctctcctactacggggaactctcacctcctgccctgcccacccggctcctggcactacctgcctcttggcacacctagcccaacccaggtgtagcctgggccgcgctgaggccaggcgctgggccctccctggctaagccggtaagggctcatgtacagacttcagcattccctgaggactgagggagggtcctgcccactaaggctcaatctccatttgggcagagacccaggtgcttcagcaggtgcttcagcagaaataactcagttgcggggccagggggcagggatggggtcaaacccctctgtgactcacagccaggggacctcaggcacgggacatgagcattgacacgccgagtccctctagcagaagacagacacagccccataagcagtggggtgctggaaggcacccagtggacctgtgagcatcgctcctcgagggcatcatcaggtgggagggagacacaaggtcagtgatgaggccagcaagggcagcactacagtgcctgggggcactgcctcagctggaggccagagaaggcctctccaaggcagcaatagtcagcttatactgaaagaatggaaggcactccaggcagcccgagcagcaggcacaaggccctggggtgggcatgggcctggcgcgacagacggggaggccagtaaggctagatctggtgggcaggaggggagcgtggggtgaagggccttggaaggattcagtggctgcgtggggctggggcgtggcaggcagtcgaggaggctggtggaggctccctcaggggggcggcctgaccccatctgctatgaaggaatcattatggaacatggggggcaggaggagagctgaggagccacagggaggcggttgggggaaagcggggcaggggagagtaaccccggtgacaaccatggatggtcagaggggacagaggggcctggggattccaggacagggatgggggaagaggcctgcagggccaggagcatggtcagatgggggtaagacctgggaccggggaggccggggggagtgggaggagggcagaggtcacagtgtgtggacctccaacctctgcctgtgcaggcgggcagtgccaccaccccatctcgggaggaaaaggcaggcaggggatgggcaagtcccctgcaaccacagagccagcatggggaagcaccagagtgagacagtcctgacttgtcccgggccctccccaagaagctcctccatgtgtgaccactttccagaagacaccagacccctgacccacaggagcatctcagctccgcagaaatgcccatcaacccttggggcactcccgtgaggccctgtcctccctttacctcgccgtcggctctgccaatcggtgagtccagaacaaagtcaggaggagcgatcacgtctaccagggcaactgcatcgtctttcagctgttggaaaacaaagcccagacacttggcacctcccgggaatttccatggtgaccaaagcataacagccccgtgtgtggttgccaggacccactagcaacgggtcacctgagcggcacgtgcggctctgctgcccatgcgtgatctcttcaccggcctggattcgaggcccttgctgtgcactggaatgttctcaccatgctgcttttcactcaggacttctagggcttgtttcttcccaacaaggtagaaaaggcccttaaaagtgacgaccctgaagctcgtgaattagcaactgcattcagaggctcgtttctaagccttggcttatctgggcaactgctgttccagtaaaggaaaatatgttcagaaaacatgtaatagagaaggcatttatgagcacttggaaaagccataagcatatgaagcctcctcggttggcggtggttttattactctcccattccactggacaaattattcttcaatatgacacatgaaatttatatgagtggactctcaagaattttcttaagatgcaaaacaaaaattatccttaaaatatgatgaaatgccgtggctacactgcatagaacccaggaatgggagacaccgctaatgatatggatcaaaggcaatcagtcagtacagagtaagaaaggccacaatggaggaactgagtgcacctctgcgcttcagcgccgcgctctgcagggcgtggccacctggtcctggtccacgtgcctcagcacagaggccgcagacaaatgccactgctcccggagagaagctctcggcagagcacaggcgctgagcccgacaaacgtgttccgtaagggtccaggtgggagatgttaccggctttgcgggccacggtctctggcaactgcctactgtgccgtggaagcacaaaggcacccacagacgacactcaggtgaacggcaggattggactgagtttgctggccctggtctagtggatcgctggcaacttctccacctggctgaccttggcctccccaagacagtggtatggatgggcacacacagagtggcacacaacggtcatccagccttggccatagcctcactgggaaatcagttgtggctttcatttttttgagacggggtcttgctctgttgtccaggctggagtgtgatggtgcaattacggctcactgcagcctcgaacacctgggctcaagccaccctacctcagcctcttgagcagctgggactacaggcatgtgccaccaagcctggctaattttttaaaattattttttgtagagatgaagtctcactacgttgcccaggctggtctcgaactcctggcctccagtgatcctcctgccttggcctcccaaagtgctgggattacaggaatgagccaccacacccggacactttttatcaacaacacctccccgctatgcccccctctctggcgaggagacccccgtgctttccttggtgcacctgcatactctgaaggcctccatggggtcaacactgccccaagggggtaaaatttggctcttggaggagccaaggaaaacccctccctgtggccagttcgatgttaagacgagtaaatgtggccacatacgtgcgccacaatcagacacgcccctctccggaaccgcaggctcagggaagggctttatacaacgaatcccgagagaggctcagagccagtcacagggacgttccactggtcccagatcaagtgtgaaagcagtgacaggggagatgaaaggccacgtctgcagtcacctgagacattgtgctaaaatgcagcagcactcagtccagttcctagcagcaaaagtggaatgacgtctccacggacacagtggccctgcccaccgcagcagcaccagcaccagcacaagtggctcctcaaaatcagtgcaatgaaaggaaatcggagaccctcactcacacagccgccttcccccaacccagcggctgccgtgctaaacagcacagcactgcagcttctgtccccggatggaagagagatgccggatcagaatgtggggttggggccctctgatttcctgggtgacataggtaaaagaatataataaacaaggaaactgccaggaaacaaatttaaattggaggctgagtcccccgaatgctcagagaattctcaaagtagctgcaaaaggtgtgtgagagggcctgggtgtgtgcagatctggagacgccccgacaggtttcttttgcaaaaatttctgatgtagccatattttcttgtaatcctacagtttttactaaacaccgaacacacgtgaatgtttgggttgcaaaggcggtgtgtgtcggctcatgggtgacgctaaggcggtgtgtgtcagctctgggtgatgctaagggggtgcgtgtcggtctgggtaagggggtgcgtgtaggctctgggtgacgctaagggggtgcgtgtcagtctgggtgatactaaggcggtgcgtgtcggtctgggtgatgctaaggggatgcgtgtcgctctgggcggttgtgtaacatggatgtagagaacgcgacagcacccacggctcacctgggaacacaaagccaggacggcgctctccaacacttctcccgcctgctcaccagagaagtatcctcctgcaagcacagcctcggtcacatgggggctgggtccagtccaaaaccacccccaataccaacatgccctgagtgcactttccaaatcggccatataggaggcctgttttgggtgaacacatcagtgtcattgctgtccccagcccagatgtgacccaaggaatgtgctgctcaggggccgagttctgagacccttttcccactcaggcattgatggtctctggcccgcggcagcgagggaggcaaggtcccaggctcagaggtgacaggtggccgctgggctcatacctgctggggttcagggaggctgggcgggttccttcctcgggagaaagtgaggaaggggctcctgggcagagtgaagcaggggtgcatggcagggggcgcaggggcgagggggtgcctgggaccacccaggggagttgggggcggtgggcacctgcagggactcagaggccgcagggggacttggtccttggtgtcacctccagccgctgtggtttctggcagggccctaagaggtccaaggctgtggccttgtgcgttcgggagcacatctgtggtgggatctgcgtttgctgtgatttccgctggagagaactgtgtctcatcacttagggtttttctcaggcagcagtggggctcctgccctgtgcccgccctctctggcagacacttgtgtcccttccttggtgcacctgagcactgtcaaggcctccacggggtcagcaccaccctccagggggtaaacgctggctcttggggtggggaggatcttattcttcacaagcccagagacacaggacatgaatggatatgcagtgtatcctagtaccaaagatgcatgggtgccagccattgggaaaaaccacctaaaaagcttcctggggggcaaagacgaacaaaaagttgacaaactttggtttagcctattcccaccaatcctccaggaatcagccccagcaccccctcctccaggaagccttccagtattcccaagtctaggcactcctggctcgtgtctgtctgtgccttatgggacctagtgggtgggcttctgctctctgcagagcccggcaggctgcctggcatgagggggccttctggaagtgttctctgaaccgaaccccaagtgaaagaaaaattgggtttctcggcaccaccctgacgctgctctgccccatatgcttctcattatggaactgggcttctcatctgtccacagcgccatccgccgtgctcagtgagtcccgtggaaggaggacgatggtgcaggaagcagcttcctagatacaacacgggggccctgactctggggaggacagcaagcccgcagtcagaagcctcacctcggtagagcagggccgcgtggcggctcagggaccacagggcgtacagagcactgagccgccccagcacggcccg

SEQ ID NO: 15208 - DNA, 44096 bp, Human
  misc_feature (1)...(44096): n = A,T,C or G
gtttggacaaggcccactcacattatggagagcagcctgctttactcagtctacccattcatatgtcaatctcatccaaaaacaccctcccagacacacccagaacatatgactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttctcagccactagagaaagcacacgtgttttgtttcagatggtcatcttgaggaagcgaactcagtataacgcaacttgagatggacacttaataaatgtggttttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaactactcctgatatctagtctgtttttttttttttttttttttttggcaatattctattgggcgtttttgactgcaatttaaatatctttcagtactggaaatggtttaacacgcaatcttgggtcaaagtatgcatcataaggcctcatagaaatattcaaatgttaaaaaaaataaataaatattcaaatgttcctcccgtggtgcgtttagtggttagaactcaggttctccagttaagctgcctggggtcagatctcagggctaccatttacagcccgggaaaccctgagttaaagttactttgatctctgttttcagtgtctttacctgtaaaaatgaggctatcaaatatgtatacactgtctatgatgtccaggcttcttaacaaccctaacaaaaagacaacatcattgtccctgtttcccagtggagaaaaccgagacactacgagattaagtgacttggcccaggctgcacaggttgagggacccggatgtaaatttaggcagcctacatgcagtccccggcatcccctagcctactgcatctgcctgtggctatttgtgagacggtgagctaaaatgagacagaacctatgtgcccagaacagtttctggtctgtagtaagcccatcattagccttcatcgacatgttatggtgtaaacgcattttaaaccatggcaggctaataaacaccgtggaaacacaattctgtgtattaactgatgatcttctaaactggggggtgatctaaatccagtaacacttgacaaaattttatataaatgcacaatgaaatgttctttgagtttggttttattaaagtttaattgatagactaggaattcctgtacttctaagacttgatgcaaatggtttttgtttttttgttttttttttgtttttttgtctaaaacatcttcaggatagtgcaaaacctcttttctttaatatattattataaaacactcattagtagagtcagcaccaaaaatgtgagatgtattgggagttgtgttttgaagacagttctcctgattctaaacccaaattgtgatttattaccttccaaaatatgtggaagggagtgcgggccttaagttcagtgatgtctaagtacactgctgcttgcaagccagctacacatttcagctaaccggattagcctacttccagttaaaacccgactgaggatatgaaaataaatatgactgattcatttaaaatcagaaaaacactcaatattttcttccctctatttctggtatgctaagatatcacacgagtgcgacttaagaaaaacttagaatctttttcatttaaaataagccatttttgttttaaccgaatggttcagttattaaatgtctacctgagtcaaggagcgaggtcacactgcaaactccacttatttctactaaagggaaatggcccggactcccccgcgcagaccaccgtgccaggacagcccgctccgggagtcgggcctggaagcaggcggacagcgtcacctccccgcagccgccggctgggacccgcggccagcctttacccaggctcgcccggtccctgcccgcatggcggtgccccacctggtgaggacgcgggctgcagtcctccctactggggatgagtcggtgggctcctttgagctaccagcgcccccagggtctagaccnnnnnnnnnnnnnnnnnnnnnnnnnnnnnnnnnnnnnnnnnnnnnnnnnnnnnnnnnnnnnnnnntcctttctcccggcttctccccgcacggttcgggtcccctctcccagtggtcttcccggacccacagctctgctctcctctcaccagtctccccaactccggctctgctcccctctccttgggtctcgcaccggattcggcccccacttccgagccctggtggctaagcccctcggcctccctccggggcgcagggggttggaggtactcacggcaccgcagcgggccggggactcccggacggggctggagggcgcgggcggctggtggctgcggctccgctgccggccgagtggagcgctgcgcagctcccgccctcgagaaaccccgccgtgtcatttgaccatataaggagatgcacgcctcggctcgctggcaccgggcgtggggcgcggggggcgggcgcccccaggcctcgcggttgccgtgcccccgccccgggctgcggcggtcccggcccgtaccctttgtttgccagggctcctttcttcgtgccctccgggtcttgggagcacagtagttatcgggagcgtcgcctccggcgtgggctctcgggcgcgagtttcggacgaggcctgggcgcggtggcaggggtctgcccacgccgggatctctgcctggtcccaggagcgggagactggagaagccccaggacgtgccgggggaggcggagggaggagggggtcacttctcaggaggcatgtgcctgggatatatttgcaaggtggacgtttttccttcttaccctgcagatgcttctttacgaaatgaacaccacagatgaccataaagaatccttcgttccactacggaggggactaaaggaaggtcctatccccacctctccctctcggggccagaagactagttagacatcttggattcccctccagggcgggaaaaccaaagtgagctgggagcgtgcctcccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccggtccacttgcagaaaccggtggacgatgagtaggtggaccacaaaggcgtcctcggcactttgggggcaggtgtattatttttaacattcggggcagctcataggaatacatcctccagagaaggcgggaagaactccgtgattgctttcttttaattgatactctccgtctggtaggcctcatgggtctccatcatggaatcacagaacttgagaataaaggggcttcatcaccttagcttccactcggtgagcactagctctacctggtatctcatttgatccacactcctttaaggtaaagatttttaccagatttacggtgaggaaagttcagctcagatttgctccaggccacgtgaacggtaactgtgccagctgagatttgaactgggatgtggtagatggcaaagccatgtaagtatattacgggatcagaaatgcctctcatccctcagtcactcaggtgactccagaggactgagacttgccataagcccagccagaactagatgtgcggaatacagccctcccccgaccccaccccactgtgtccctgaaacaggacgctttcctgaagaacctgagttaaggccaccctacctgaatttccactaagtgtcaaggcaggctagtattttgaaattcagagcaaagtttgtgtagaaaaggctcccagcccctgacagctacctagatgtgttgttgatatcgttacaaattaggaaatggtctcctagttctcaaatggtgagtcttaagcttcagtttgtaaaaacaagccctaaaatgatgaaacattaattctgcatttatcttctttctgattccttttgtcttatattttaattttttttttttttttagctttctgacttacgggtgtaatccatttagctttgcttttttactgatagagttatttagttctgttatttttcttctaataactgctttagctgtgtcacataggttcagctatgttgtgttttattattaagaaattctgcaatttaattttgtgtttaatttttgacctaatgggtagcagaacattttaaatgaccctgtggtcattcgatagggtcagtaaaatccggactctggaaacaaacatacccagtttctacaacaacgatgcacaaagaaaaacaagagagatggagacagaaccaagagattaaaaaaagacttagccaactgccatgtatggatcttattggattcttttttttttttttttttggatcttattggattctaatcaaagaataaactagtagaaaatcaatttttatgagacaaccttggaaaatatgacactgacaggatattttctagtattaatgaacaatttatgttaggggtgataatgtgattacacacacacatatatttttcttttcttaagtccttgcttttcaagaacagtgccaaaatatttcctagtgaaataacattatgcctggagttgtttcaaaataatttggggtggggaaatggatagggcctatatatatacgaaatactatcagccatggattgtggataatcgctgaagcttgatgatggatatgcagcagttcatcttactagtctgtctccttttgtaatgcttgaaaaattccataatgaaaacatttttaaattacagatgaacataccattttctctttacccagcatttccctttataggaaattatcttgtagatatacttgctcctgtgtaaaacgatagacacacaagagtagtcattgtagaattgtttgtaatagaaaaatactgggccatgttatgtgttcgtcaacaagggcttagttaaatacagtatggtgcattttagaattatttacatatgcggctgttaaaatgaacgaggtaactatatttactgatttggcatgatctccaagataaatcaactgagaaaaataaaagtagagaacactttgtaggtagaaaccaaccatttgtgttcatgagcaaagaaaggacgggggaagacaatgtatatttataagcggttgcttctggggagatctgagtggctaggggtcatggggtggaaaggagattaatttttactgtacacatttttatttcttgtaaattttgagctatgttaatgtactcattcaaaaactaaatatatatatacacgaatatatacatatatacgtatatatacacgaatatatatatacgtatatatacgtatgtatgtacatatacatgtatatatgtgtatatatacgtgtatatatacacgtatatatacatatatacatatacacatatacacacatatacacatgtatgtatatgtatatatgtatctgtatgtatatatgtatatatatgtgtatatatgtatatatatgtgtgtatatatatatgtgtgtgtgtgtatatatatatgtatttgagatggagtcttgctctgttgcccatgctggagtacagtggcgctgtcttggctcactgaaacctctgcctcccaggtgcaagcgattctcctgcctcagcctcctgagtagctgggactacaggcatgtgccaccacacccggctaattttttataattttagtagagacgaggtttcatcatgttagccaggatggtcttgatctcctgatcttgtgatccacccacttggcctcccaaagtgctgaaattacaggtgtgggcgaccatgcctggcccaaaaactaaatatattttaaaaataaaagcaacagactcctttaaggaaaataggaaacaaatttgttaaactgatattaatagtaagtcaaaggaggatggcaagaaattgaggaggggaatgcaatttctgggtttaatgacatatgctttcatgagcaattccatcgaaggacaaagtattaaaaacaaattttcatgagacaatctaagaaaatatgttttgaaaagttccatccatcttgtacatcattatattcctaggacctaattaattatagagcatggcacatagtatgtgcttaataaatatgtgtattgaataagtgacagatcacagaattgtttgtgacaagtctttcactatagaaagcgtaatgctgtctatggcagcatagcttgatctttgaagtcaagccaggatttgaatctctgttctatctatgactactatgatctccagtaactacaaaacttccctaaccctcagtttgctagtttgtaaaatgggctaataacatatagtctgtgaaattgtggcgaaggtcttttgagatgcacataaaccacttagaactattaacacattacttggcatgaagtaggccctttgtaaagtcctctgttttattcaatggcaaaggggaaattaatccagaataagaaggaaatggactgaactcccaccagaagaagaattaaggttcagatcctgttcagatcctgtttcttcttgagagaaaacctctctgctatggataaaaggctagttcatggaagaaaataaaaacaaaaagtactatttcctggggaaaggatcaacggtgactgtgatcagttattcaagttcttcttttgtttattccaattatcctgacattccttcttgagacaacactgcccataacgttttcccgtctctcctgtaggtgggcttcagggagaggcacagctaggaagggaggaaagagaggaaaagacttcctgcggctagcaggtctcaaagccttgtcccagagtgcagcaggatcccctgcaaacctgttagaagtgcacattctcaggccagctcctgctttaacacgccctccaggtgattctgatgactaaaggtgatttgaagtaaaataaataccacttagggcttccaactctggactcggtaatttaccagaaacctacgaaatgtcagtttagggcgtgggggagggacagggaaatagagatagactaaacatagactagactcaggaactctaaaatccagttggaagtattacttcctctgtcagttacttcactcagggaagcaggaggtagaagtttgagccaggaggtagaagtttcagccagtgggtctgagctgtacaaatgctgaaatttcattctctgggagaggccaaagaaaggcagggcttctaggcgtgtgctcgcaactgccaccctgtggtggggtcgtgggggggaggctggtgggctagacccatctgtgcaggggccaacagtagcctcctacccggatgggggctaccccagggggattaggatgagctcaccattaccaggtagaaagtgaacacaggaaaacatgagctggaggtcagaccgccctatgttcgttaccctaactgaccactgccatcaagattgttaagcattttgtcaccgttaaaggatttcacacaagctgttcctcccactcaaaccttggccaggaaactggtggatgatttgcccttgattcagaggcaatcattcttaattgcctcacatggttggaaggtgagtaagtgtctaagatcataaatgctggcgggaaggggtcaggagtgatcaaaccagcacccctcctggcagtggggtcaggaggcaagtccctgcatgccttcccatgacacagtaccagatcccagggtggtggcacagaaagctggattcgctttttctggaaacactatttgcccggatccagcagggaagtctatgaaagatgactctacgggcagggtatgcacctgcctgtgcccgtgagctgggtgcagttgtgacgggagacccaagggcctccagcaaacaggaggaacttgatctggttacaggaacgatcttgcaggatccaaactttgtttctctgcctgtcagactttcaggaaaagctcagctttccacaaagggcaagctcttttccttttcttctcccttctgccatgctctggttaggagggaaaatgattggctctttcttgagatacacaatttccatatcccatttcttccctctctcctttttcacaaactatttgttggatataaataatcagtgtttaaagcctcaaaacatgcctgacttttagccaaatccacaaacaactccatgattccgagtttcccatccttggttagagtttatttggagcgtcggatacagtttccactgtggctttgatacctctttaagaaagactctgtttggtacattaatgaccaatagaatgaaactattcacacccatagttcatttgggccagtaaatgttgctggatggtttcagatgaaaagtatttgtaaggtagactctgaaaaactttgcttcttatttgagatctctttgtctctgatttcagtccttttcaggagcaatccattcacttctctgcctgccttctcttagagttttactctttttttcctctgtcaatgattccaaaatccatttaaaggaagtattaatgtctaaagtctgtgcaaacctggcaaaattctcttttgagtgaacggtttgcttccctaaaatacctgaaatgggagattcttccaggcatttctgaaatgggggagtctcatgcctcacttgttcctcagaatgtttatgttattttatttgagacagagtcttactctgtcacccaggctggaatgcagtggagcaatctccgctcactgtaaactctgccttccctgattcaagtgattcccctgccatggcctcccaaagtgctaggattacaggcgtgagccaccatgcctggcaagagtgtttattttaaaccacaccaagatctgttattctttgtgaattaactttatgagtcaacattaaaaatttgaaatcccaagttctctcttcactgccaccaaggtcgttttgtgctatttccactttgattagggtcattaacagaaaatcccaatagtctaactagaaagagcctggactggccaggctctaggaggcagggggtgaaccccaggtccaggagctcctatggagcagtgtatgtggccacaggtaacacccttcacctttgtatgtcttctttacattatctgtgaaataaagaatgtaccacctctcttcttcctttaaagagttatttcacattatctagtttttcctcaagccacttttatggctaattgacaattgagaatgtctcctgtggctaattctgccccatggtacagatttgtgtgtgatgaaaacctatgctttaagttctagagagcatgtttaggaatacctttcacctatttcagaaggtactttaaaattggacctgggagtcatgacagagcttcctggaacaaccaagcatctttctccatccttgcaatagtagttgactgctgaagtaccagaaacagattttctaaaatatctgaccttcagcatctcctggcaggactgtttggcaaaaataaaaaaaccttcaaaaattctgggccatcctaacactataaatatacttggaatcgtgtgtacagtcagagatgctgagcaattactcctcagtaagaccagaggagtcattgtctccacggagggccggaggggttccagcggtgaatcaccatcagatatctgaactattcatgtagccatctttaaactcgagggctttttcttatcttttttttttttttggccttccttttgataacttgaaattcaatttccatttggcacatggctgtaatgtaatctagctccccagccattgctaacactttctggactcagttctctgtctcacgctctttgcatggagggtctgtctgtattgctgtattgcttctggtcccttgaatttccaggtcagggtagaagcagatggaaagaatgcttgagaggttttctttttctaagaatatgtttggaaaatgatgaggtcaggaaagcagacactgcaatcctgcgcaggagagagtctttgagagccctcgctgctcactctctttgcacctcacatgttctacctgcggccagtgaggggagagcctttcatcctgtgactgctggaactcccttcctcactctcttctgcctggtggactcctgtttatccttagaccaaataaggtatcccaactaggaaagctgcatggatagccatcatagcctcatttttgaccagtccactccttctttcccatgtttataacaacagaggagactgtgagctccttaggggcaagaactgagacatttgaatctgtgttcacagcactttgcagcttgatcagtattactgaatttaattcagttttcttgaaaatgcctaagctgctgggcgtggtggctcacgcctataatcccagcactttgggaggccaaggtgggtggatcacaaggtcaagagatagagaccatcctggctaacacggtgaaaccctgtctctactaaaaatacaaaaaattagctggacgtggtggcgggcgcctgtagtcccagctactcaggaggctgaggcaggagaatggcatgaacccaggaggtggagcttgcagtgagctgagatcgctccactgcactccagcctgggtgacagagcgagactctgtctcaaaaaaaaaaaaaaaaagaagaaggaaagaaaatgcctaagccaacataaggctgctatataatggctctatatgaccctgctcagaacaaacacatcaagcccatttcccatttaggcagtcgagttatctgggctttgcaccgagatccagttggcaaataacttgaattaaagcaaagccaagagcttggccttccagatatcagcagatgcaaacttgggaatctctgcctgaattaaaggaagtaacccccaggttacagcatccgcagatacaatgaagagctgaaaatgaggctgcagggaagtgtgcatgtggacgttcttgggatggtgcttctctctcagagtccagcttttctttgctagtgaggggcttcttctcctgccccaatcctccccccgctgccaccaccaccaccagcctaggccttaatcgcagagaaggccactcattgagggacttccttgaaatctgcatcctgcaaacggaagccaccatcttaatttttaggagtctatctggggaattcatggctttagtttctgcttgaagcttgttgattttctatcaaatgctttaaaaaatttctgtctgcgtaaatggtaacatacaaagttaaacaaaaattctgtctcccacagaaattccataaaggttctttcatctctaccagcatgagcatgtctcatttgtggaagcaggcctacttgccatgacaacaactattctgtggctttgcagaggtaccctcacagttgcagtgtgcttttgctaggcagccggcagagatggcccacatatgaccactgcctttcaaccctacctgttttaaggtggactcacttggattgagaaactggtattttcccctcacttgcacgtattttggatgtataaatattttcaaaagataagtttgactaatacatgcacaccttccttgactatcaccatccaaacccacagagatgactgggaatttccaagtcatgtaatcctaatgttgatttgagcatccacagcctgtcttagaacactttccaaccaagactggaaccagcactttggcacttgcagaatcacagccttcccttcacagccttcccttacgagaagtacggcttcacccagccagttggctttgtatcgagaattcatttattttggacaggtcactcttcctcacttacaactggcacgtggatgcagagaaaggacagcagctcctggctggagcagaactaatggggcagacagttagtgagcatacacatgatggccctgatcctagatgcagagtttggaggagcaatctttcgtcatcactactaccaccatgattgccactatgatgttcatcttatttattagcatattttgactgctgatagggtgacatttttggtataggaaggtgagatccagagtggatcttactcttagagtcttgaaagattactttcttcccctttccgtctgaagctctcagaagacaggcagtttcagagggaccctacatccaacgtgatgtagcaggcagcagagcaagggcagaggggagaccaggctgagccaaggcagcaccaggtcatggtgtcctctctgtgggtgcaagaaagcagcaggaggtgggggtaggaatggctgagagagggtgttgtggcccaaagaaggagaaagccttcatgctttgaggctttagctcacagagagggaacctcagagaccagttgggaggagcaggcccagtgagaacaaaaggagaccctctgcaggaaaaatgggcaagtgagggaaagaaagagactatggggagagcaagccaaaggaagtttttgttggggaaatattcaaggagtctgcacttggcagctgtgcaatttatatgtgcaaacaagggcgctgggtgtaattcacctgctgatttctgggagtcgggaatcattttagaggaagaagctgaagttgcccccagaagtctcccatgatgctcatgtgtggctgtggctattctaagtaggccctggcattgcaagcccagcaagatagccagatagggaaggataggggagatttgccagctctttaggtcagcccccaagttaatagtaaattttacatttttgtgccataaaggcattaacataattaacagcttggtgccagtttaaatatgcgtatgtgcttaggatcaatgctaccattttgatcattgtttgagagaatcccatttctgatgtgttagtaaataatatgatattattgttcacatgcccatctaggctctttgtcccagaaagaggatgcgaaggggtgatataaaatccaccttggagccatctcagggctggttgttcttgattcctctgaagacctggagctgcctgtgtgaatcagactggaaaaacacgtggctgcacttttccatgaagtaggtaacaaagccacagttcatgcctgggaaacttgccctagcatctccgccaggagagcaagccgactcatgcctggactcccacacgagggccagtgccaagtacgctggaatgaagggacactgccaaggatcaggaataccaggagctcagcccacttaccaggctgagctggggatgctgagattactgtgcacactcaggcagagctggaagctgagtctgccatccagaaggctggacccagacagagttcagggatcacaccagaatcgggacacaggagaagtttgctaacctaggtccaacccagaatcagattcagattcagagcaggaggtcagcaggacagctttgtcccccaaaaggaatcaggcggaggccggagaggcagcttgccagctaggagaacacctgagcagtcttaaacccaggcaggttactggcagttgcttcaccttctagtggcctcacttgcacaccagctttccccaagcagataaccccacatagctgcaaaatgaattattttctcttgtctgcttctagagggtccatgaccattctattggcagttggagaggtgagagttaaactgaatgtgagcctgtgtcaggggccatgacccattttaatggagggtctctaacagcaccagtctctcggtagatatcactcgaatggtgctaagctacctactagcagatttagcagggtgatgccttttgaagtctaaagttttgactgctaatctctgggaaacatgtcacatcgtatgctattatttggtggtggtgtccaaaaccaacacattggtctttctcagacgagaaggattcttggcacaggcaagcagagggaagtgtgtggtatgtgcgtcttcctgtatcagcttgtgtttctcttatgctggagacctgaggtgtccacactggtggaaaaaaaatgctgccagatttaaggtgaggagcaatggcatgagtaatcctttcagatagaagttagcagtgctggaccttggaggttgcagttacagctgccaacattcgaaaatggacttagttattttaggaagccaagtgctgcacatagagccaacctcagttgagatgccttgggaccagtacatagaaggtgtttaagattctacagttccatttcatcctttacaaaatgtccaccctgaatctacagcttgcttattgaatctttgtgaaatttgaaggggagagggaaacagtaatatgacccaacataagagaagtaccagcgagcctctgtggacacaggtgtgtgcataaccaccatcgctctaatccttaggttcattctttctcatttcagtcaaaaaactgattctaaaattaaggcagactgacacccactgcgtcctaaactgtagatgcattaaaggttattagcacaatttcctagtattatctttgagtttgttttaaaaagtaactttttaagataaagacaaattgtaactttagaaagaatactatgaactgtcaattctgtcacatactgagcaaattttaaaaaaaagtataatgtacaatttttttttctcattctttttcaagcacagcttgataaaccttgtctcttactcctggttttagatggaattcttttttcctactcacccagaatcctcatctttgaaatgatgaatttgtaaatggtcctgaacttagggtttttttttttttttttttttttttgactttaaaagttctcatggttcccagcactttggtaggccgaggcgggcggatcacttgaggtcaggaattcaagaccagcctgaccaacatggtgaaaccctgtctctactcaaaatacaaaaattaattgggcatggtggtgagctcagaaggctgagacaggataatggcttgaacccaggaggcggaggttgtggtaagccgagatcacgccagtgcactccagcctgggcaacagagcaagactccatctcaaaaaaaaaaaagttcacatggcatccttctcctagtaattggattgagtagagagcccgagggaaactattgagcagaaacttgttgattgctaagtgactcatcctcacaatgccaccaagatgaataaatctcactccatcccttctaagggttaaagtccagtgtgaccagaagggagggagccagctgagtaaagatgaaactccaataagttccggtcaaggttaagatatgaaagtataccccacttctgggtatatatctaaaagaattgaaagcagggtttggaagaaatacctgcacactcatgttcatagcagcattattcacaatagccaacaggtggatgcagcccaggcttccatagataggtgaatgcgtgaacaacatgtagtacatccatacaatggaatcttattcacacttaaaaaggaaggacattctgacacatgctccaacagggatggaccttgaggtcattatgctaagcttgaatgagaattgcttgaacccagaaggcagaggtagcttggataaccaaaaggtataatcatcaggaaaatagaaaaaaacaaactggtggtggaggatgaattcaattttgacttattgaaacagaagcagtttggggacagccatccaaatagaaaattttcccaaacttgtagaaggatgagattcagggagaaggttggagctgatggtatgaacataggggtcattagccaaatggtaggtaaaaaccagtagagcaaaagagcaaataaataaaccaggagagtgagtgaggtcgtgcaagaaagcacgtggatggttaggagtgggtcgaaggtcaagctccaggggagcctaaggtttagggggcagcatccgcagaggtggctgagaaggcagcgtcaaggaaggatgaggagaaagagccagaggcgggggcagtgaagccagtgactgacacagccgaggagcagtggccagggggtgctgagagtgtgttgcacgtggcagcacagtggctgttggtgacgtctgaatgtgatcagtggcatgatggggacagaagcacattgcagtgggctgagggtcagtgacaatggagggtgtggagacggtgatgtaagaggtctgatgggaaaaaaaggaagaaattccacgtagctcagtaaggaaactgaggcccagagagggcaaataatgtactcaaagtcagagttaatggtgtagaaggacaggatgcaaatgaggacagcgtgtgactggtgtgactgctcacgtttcctggttccatcccttccaccaggctgcctcctgaagcaaggcagtgatcagtttctgagctctcatgacccatcttcatagcgtctccttctcaaccagcacaagaaatacaatagtcaaaacagaaaggcaaagcctctctgcaaccctcttccctatttcttcactctcctgacaaaaagggactgaaaaatttccaaaatcaagaagcataaagcctgatttctttttctagtcagactaacgaaacgatttattttctttccactctcttttaaagaaaagaggaacagcaccgctccctggagctattctagcagttaacaacaaagctaagcactacttaccacagaactttgtaagatatcagaaaaaaaaaacagtttacaaaaatttttttagaggcagggttacccgggctggagtacagtggcatgatcacagctcactataacctcaagttcctgggctcaggtgatcctcccacctcagcctcccgacaagctgggaccacaggtgctccaccacacccaactaatctttttttaatttttgtttttatagagacaaggtcttgctatgttgcccgggctagtcttgaactcctggcctcaagcaattgtctttctttggcttcccaaagccctgagattacaagtgtgagccatcacgcccaaccccaagctgtttttcttctactggatgctcacaatgcagaacacttctgtgaccccagatgggggtaattttccctccatataccaagcaattctgcaaacgattctctagaagacaccagctgggtgtcctcaaattcaattctgacactatctacctggagttagatcccacaggatgagggctcagtcccacaagactgccactctgtacttcagatgccgcttgcaaatagtaggttgtcacctatacttctgaccaacaggctattagttggggagggggtcctagaacccctccttggcttccattaatttggtagagcagctcacagaactgagggaagcactttattaatatttaccatgtattatgaagatattgtgagggatacagaacaaagcatggggaaagacacgtggagcttctgtttcctccttggggtcaccaccctccaggaacctccctatgttcaaccatccggacacccatctgaaccctgccctttagggttttcatggaggcttcattgcataggcatgattgattagaccattggccactagtgatcaacttaaccttgagcccctctgccctcctgggaggttggcgttggggctgaaagtcccaaccctctagtcatgccttgttctttccagtgaccaacccccatcctgaagctagctaggacccgccccccctccgccgccattatctcattagcatacaaaagtactcttgtcactcaagagatttaaaggtttttgtttggtttggtttggtttggtttttgagacagagtctcgctctgtcgcccaggctggagtgcagtagcaggatctcagctcactgcaacctctgtctcctgagttcaagcaattctcctgcctccgcctctagagtagctggggttacaggcacacgctaccatgtccagctaatttttatatttttagtagtgatggggttttgccatgttggccaggctggtctccaatttctggcttcaagtgatccacccaccttggcctctcaaagtgctaagattacaagtgtgagccactgtgcctggccagatttaaaggattttaggagctgtacatcaggaaactgaaagaagaccaaatatctgtttcacaatatcaccagcttctttacaattcctcagtaacctatgacttacaattttctctaatacaactgtagtctaagtaatgttggcttacatatcttttgatccttaaagttatattagtatatgtttgttgtacacaaacgcagatgtatacagatactagaacattctttaaggtagcataagttgggaaacaatctaaatgtttataggtaggggcagagtcaagtcattcgtccatacaatggagcaagcgctacaccgctataaatagtgaggcaaaatctcactctctgggacaatctccaagacagggtgttaagtgaaagaggaaagtgcaagtcattgtgtggagtatcctaccatttgtaagaaaaggatgtgtggctattatacatgtttggaatatctggaaggatgcacaaggagttggcaatagtagttgcttctggggagaactaaggaagagaatggagggagggggaaaattacttttaattattctctttttgttgcttctgaattttgcaccgtgtgcattgattacctgttaataactaaaataatataaagtaaataaataatcagcatatcttaccacagcaaaggtggtttaaataatgtctttaaacaattaaattcaataacacttttaaacagagattgaaggtggcttcacaatgggcagggaaataatatgtgacacagtttgcaagaacgaaaaccgtgtctgaaaatcacattaaaatgtgttgggaaacagcctgaagaaaaactgttcctaaaatagaaccaacaataaataaataaacaaatgaagtaagcaatgcaaatttcttaaaagcaccgggattcctgtgtttttaagttatttctttgtggccctaaccccaagttaagtaccagggactccttggaaccgaatggtaccccatggtgggaaaatggcccatatggtacaattatctagatgatttcagcaaaaaatacgtctttgactcagtgttttatacaataggaatagatggggaatattaacaagaattgaaactgtgtgtggaaccatattcaatcaatttcaagtttaattaaaccagctactcttaacccctgttcttaaagagtgcctcaaagagtacagccctatctactctttaatattattaagaatcccaaagggcttttgtttatgtaggttatatctattatatttactgcattagaaaataaaacttagaagctaaaaaattaattcatttaaaattaacattaaatccgtaacaggtaacatagaatgttttcatgaaaaataattacactttccaaaacaaaacaactagtaagaagagtggtgtggttttgaatttttgcaaatctctttaacattgagcttaatagaagacagctggaaagctcaatgctcatgtctgcttctgcattcgatctgtggagtatgtggttttggttgaaatttatgaaggaaatgcaaccttatacagaaatgtcgttggaaaagagaaatatcttgatagccatctcagatcatcatctctctctataaatggatagattctacaccaaaatttgaaaaagagatgtttcttaactactgcttaaagattgcaatgtggaatctgaaatcacatcaatacttttcatattctattacattaaagcccatttggtctatcttaagctttaaacagatctttaacctacacattgttttgttagatttagaaaatattgcttctatagatcttccaaatgctgatacatttcattatacaatattaacaaattacagtaattgatatcaccatccatctaatcaggaaagtttttacacactgggaagctgccacactcacagtttcccaaaatgctaattttcacctgaaaactcaaattttatccttgaaaacaaaaacaaatactgtcagttgtttcccttagaatgacaggctactctgcatttttgggaaaatatctactgccaaaatctaagtatgctttgtctgtcagttgttcttccaagtgaaaatggaagaaacatcttgttgaactcacgacttgggccactgcacaacttcctttcctcaagacagtcacagttctttgatatgagcagaagtgcttcatgcatcttccctttcatcactctgaatactaaaaagatgtgtgttgtggccgggcgcggtggctcacgccggtaatcccagcactttgggaggccaaggtgggtggatcaagaggtcaggagactgagaccatcctggctaacacggtgaaaccccatctctactaaaaatacaaaaattagctgggcatggtggcacgtgcctgtaatcccagctactcgggaggctgaggcaggagaatcgcttgaacccaggaggcagaggttgcagtgagccaagatcttgccactgaactccagcctggcaacagagctagactccatctcaaaaaagaaaaaaaaaatgtgttgctgggcacggtggctcacgcctgtaatcccagcaattcgggagactgaggcgggcagattgtctgagctcagagttcgcgatcagcctgggcaacatggtgaaactcagtctctactaaaatacagaaaattagccaggtgtggcagcgtgtgcctgtagtcccagctactcaggaggctgaggcagaagaactgcttgaacctgggaggtggaggttgcagtgagtcaagattgtgtcactgcactccagcctgggcaatacagcgagactccatctccaaaaaaaaaaaaaaaaaaagaaagaaagaatgaaaaaaagaggatgtgtgtgtttaagggtccagatttaataacattaataattgttactgttgttttgtcaaggtcattctggaatgcagctgggcttttctttttccccctactgcttggtgatgaagaatatcatgattactagtttggtttggagccaccaccttgattcctgctaaggcactaggagtcttcccaccacaacttttgtaccagcataaatgtcaacacagtgaaaagatgagtcatatcttaatagtatcaaaaaaatagctttaaccacaaaaactccttgaaaaggactcaggggtatagggaccacacattgagaaccacagaattaaaacactttaggctggggaagtcattatattttgtaataggactggaggtagtgtattttccaccatgtgggtaaatggtggagattcagacacagtctgtatagctagtgtttcatatctgtccttatttttgactctgcgaatggccacccaaggctgccaagggctcatcattgagatagtgctgggcttgttaagctggatatcctaactcctgggccttctggtttgaaagatgtggggaccaggcagataagcaccagggcaagccacctgggccacagggaaacactctccccaacagaaaccacttattttcctcctattgaaaataagcctcagagacccaggtggtcaaacaacatcaacaaaaaaaaaacaaaaaacccattttaatctcataagtaggtcagagttgcacatttcatgagaactgggtccaaaagaccaggtaccactaattatccagatatttcagttgagctgatttagtgagcagtttccgttctgcactttacatttttatgaatacaactgtggataaagtatgcgcagacatagagtattctatttcttcttcaaggatatatctctctataaagtgtatttattcatacagtagcgccctcctcccgctccccttatctgcagtttctctttccacgctttcagttactcatggtccactgtggggctgaaaatagattaagtacagtacagtacaatattttgacagagagaggccacattcacataccttttattacagcatattgttataattgttctattttattattatttattgttaatctcttacggtgactagtttataagttaaaatttatcatatgtatgtatacacaggaaaaaacatagtatatgcagggtttgggactatccacagtttcaggcatgcactgcaagtcttggaacttatccccaccagataaggggagactggtgtgtaatatttgtatacaagtattttctttagtatatgtctgtccacaaagtaggctttcctatacccatacatcagaaagacagacatgtagatctatagaaggccactggagaatcaaaatatgccaaaccaaaatatgtcacaccagaatatgccactttggcataaggatttttaaaaaatttttttattttcataggtttttcggaactggtggtgtttggttacgtaagtaagttctttagtggtgatttgtgaaatttgggtgcacccgtcacccaagcagtagacactgcacccaatttgtagtcttttatccctcacccccttcccaccctttctccaagagtccccaaagtctattgcatcatttgtataaggattgttttgaggtgaaggcaattaagaagcagcaaatgcagaaaaagcaggacataaatttccctttgtgaaggtgtttctcctcccatcttccataccaagaggagaccaactcttgtcactggaaacagaaagtcagcaccaagacaggtctgcacaaacaaacctcaccaatatcacccttatctttcattaggttcccctatatgtgtactctcccagtcctagaagcccaggttgctttttgcttgttttgttacttctctgcaaatttatcaccctttgttaaaatggtatataaactcctgggtctaacagcctctttggttcttcacttcttttctatgaatgtcccttcacataaaaattaaaataataacataaaataagatttgtctgtcttttctcctgatggtctcacttttgccagtgtaattaacagaccccagctaaggaacagaagaaggttgaggaaaagttttattttcctcccctatactacatagtccagtatgactgaacatgcattgtcattaagggaaagtgttcagttgagggtgggaggggatgcattggccaaggtctcaagaggagaagtgactgcttggattcagttcttcatttgctcaaagataagccacccaatgccccattgtgttagtctgccagggctgtcatcacaaagtaccacacactggatggcttaaacaacagaaatttattgtctccaagttttggaagctggaagtccaagatcaaggtgtcagcagggttggtcccttctgagggctgtgagggagcatttgctccatgcctctccctagctgctggtggtttgctggcaatctttggcatcccttggcttgtagactcacttccctgatctctgtcttcacgtggacatagtatctccctgtgtgtgcgtctgcccaaatgtccccctaatatccccttttacaagggcaccactcatattggattagggataccctaatgacctcctcttaactaattactcggtaacaaccccatttccgaataaggccatagagttattaggagttacggcttcagcatatcaatttgggggagagacactcaacccataacaccttcactaataatagtagcaaattattcataactaatagtaacatgaggaagaatctaacagatgtggggcagagagagggatggcgaggaggaactagtgcagatatccctaacctttttggcaccagggacccattttgtggaagacaatttttccatgaattgggaggtggggggcagagggtttcaggatgaaactgttccaactcagataatcaggcattagattctcacaaggggcatgcaacctagatccctcacatgtgcagctcacattagggttcatgctcctgtaagtatctaacgcctccactgatctgacaggaggtggagctcagtggggaatgcttctcgcctgctgctcacctcctgctgtgtggctgggttcctaacaggccatgaaccaagtaccggtctatggcctggggactggggacccctgaactagtgggacaagttttaggagaaaacggggctccatccacaccatgagaatggggcactggggttgtacagagccagtggtggcccagtgtccctgtcctatactggatccagctcatgagacagatgcagtttatggtcagactccatgtggtccagtgctcccttgataaagaaggtaatccaatgggaagaaagtgaactgtccctggtcccatcgtcactgggttctctctggcttgtaaggacagccagtttcacatggaatgtctgggacagagtccacacaaatttgatttggtgtcagtgatctggggctttgtggcaatgttctgccctgcttgaggttacaggccaaagttcaaagaccagcaacccaaaagcctggtcactggagtgtagatgctgggtggagtattcacaagcacgctacagaaggcccaatgcctgaagttaagaccataagctcaactctcctgatcaaaaagacaaacactattctcttaacacaaatgctgtctctaggacaaatgctatcaggatgatgaaaatcaattttctgcccattttttgttgttgttgttgttgtgacagatctctggcaacaaaatgctccagatgaaagaaatcaaaattaaatactgtctgcagtttaacactgccaccaaattccatctttaggttgatttttgtgtcctctttatcaaaaggctgcttgattgagaaagtgtctagctcagttatactatggcttgcattgaccaagagaggtatcccagcctcatgacactgatatcgtaactgtcaaatggaggcacttctgtgatgcagagggcacagttccatgcatgagcttgcaatgcagtctctgccatcagggactcaacattctaggatttagttttccagatctgtttctttgatttaatggaaaagatgtttctattgcccaccatgctagttttatattaagaccagagttcactggtacatctttttgttcccatcagctttttgcccctcttggggtcctgttgcgtgcattggcagcgtagctcagaggagttgccctaggaaagaatcacggtggagggcagtccttccccacatacatgcaagtcctccaacaccatgcatgtccagcagcaatcttggccgcgttgtggaccagaaaggaaaagccatagtaagaaacagctgtttggcttgaagatgtgttggtttgcttatgtttgtaacttgtttgcttttatgctttgggttttcaagatgctggtgttattggtgagaatggcaagaactcccatgccttgtgaaccataaccagctcctggcattctcaagttggtggcaagatgcatatggaggtgcatgtcatgtgcatgggaattgcaggggccctatgtggatggatccttggtgcttctcagataagacaaaactacttaggaagcaaaactgtgatgggaatagtggatcacatataagagaaatattttttttatttatagtttcctcttggtttaatttactttttcattataggattatagctctagataagacatgatctacaaactaaaccacaagccacttagagacaacaggaccatgaaaatcaattttccgctaatttgttgttgttgttattgttgtgacagatgtgattcatctctggcaaaaaaaaaaaaaaaaaatgctccaggtgagagaaatcaaaattaaatactgtctggagtttaatactgccacgagattgcatctttaggttgatttttttgtcctgtttattttatcaattgattacttgattgagaaaaggattgtctgtatcagttatactacaggttgcattgtacaagataccaaaatcattgcagaaccactgtttttcgttctgacagttttactcaatagacactgtacctctcagataactaggaaacgagagtaaagtcttccgtcaataatgtcagaacactaatttactctcccacttctttccttttcctgcagctcagacggcatgggaacccattacaactccctcatagtggaaagcaagctgaggatgcttgcattgggcctgactcaggaagtggtatcaagcgtcaggtccctggggcagctcttccattcctctctctgatgtttgcccccagaggaatgaagattcttctagattttagtacagaatggaggctgtcagtgatacccatatgttagaaaaagccaacagagcaataatgtctccaaaaaatgaaacatgaagcttttagaatgattggaaattacagttcgattttgaattatttgcaagccacttgaagatttcataaacctattgcatcaactctaacaatagtcctttactggtataattatctgcattttgcaggagtagagattgaggtacaaacagaggacacattttgcttgcctgaggcttcgatgaaacttctgacaatatcaggggacatatttatacttctaacagtatttttagctatttgatagacaacagttgcttctcttttcaaagatcacagccattgaggaatccaccatatttctgtagcaggaagaatgtttatctctgtgtcttgtctttctggttaaaggtatttacttccatcacactacctgacttcaaactatattacaaggctacagtaacaaaaacagcatggtactggtaccaaaacagatatatagaccagtggaacataacagaggcctcagaaacaacaccacacatctacaaccatctgatctttgacaaacctgacaaacaccagaaatagggaaaggattcccaattatataaatggtgttgggaaaactggctagccatatgcagaaagctgaaactggatcccttccttacaccttgtacaaaaattgactcaagatgggttaaagacttaaacataagacctgaaaccataaaaaccctagaagaaaacctaggcaataccattcaggacataggcatgggcaaagacttcatgactaaaacaccaaaagcaatggcaacaaaagcccaaatagacaaatgggatctaattaaactaaagagcttctgaacagtaaaatcaactatcatcagagttgaacaggcaacctacagaatgggagaaaatttttgcaatctagccatctgacaaagggctaatatccagaatctacaagaacttaaacaaatttacaagaaaaaacaaacaaccccatcaaaaagtgggcaaaggatatgaacagacgcttctcaaaagaagacatttatgcagccaacagacacatgaaaaaatgctcatcatcactggccatcagagaaacgcaaatcaaaaccacaacgagataccatctcatgccagttagaatgctgatcattaaaaagtcaggaaacaacagatgctggagaggatgtggagaaataggagcactttaacattgttggtgggagtgtaaattagttcaaccattgtggaagacagtgtggttattcctcaaggatctagaactagaattaccatttcacccagcaatcccattactgggtatatacccaaaggattataaatcattctgctataaagatacatgcacacatatgtttattgtggcactgttcacaatagcaaagacttggaaccaacccaaatgcccatcaatgatagactgggtaaagaaaaagtggcacatatacaccatggaatactatgcagccataaaaaggataagttcatgtcctttgcagggaaatggatgaagctggaacattctcagcaagctaacacaggaacagaaaaccaaacaccacatgttctcactcataagtgggagttgaacaatgagaacacatggacacacggaggggaacatcacacaccaggacctgtcagggagtgggggcctgggagagggatagcattaggagaaatacctaatgtagatgatggattgatggttgcagcaaaccaccgtggcacatgtgtacctatgtaacaaacctgcacattccgtacatgtaccccagaacttaaagtatatatatattgtagggaaaagaaagagagatcagactgtcactgtgtctatgtagaaagggaagacataagagactccattttgaaaaagacctgtactttaaacaattgctttgctgagatgttgttaatttgtagctttgccccagccactttgcctcagccactttgacccaacttggagctcacaaaaacatgtgttgtataaaatcaaggtttaagggacctagggctgtgcaggacgtgccttgttaacaaaatatttacaagcagtatacttggtaaaggtcattgccattctctagtctcaataaaccaggggcacaatgcactgcagaaagccgcaggaactctgcccttgaaagcagggtattgtccaaggtttctccccatgtgatagtctgaaatatggccttgtgggatgagaaagacctgactgtcccccagcccaacacccgtaaagggtctgtgctgaggtggattagtaaaagaggaaagcctcttgcagttgagatggaggaaggccactgtctcctgcttgcccctgggaactgaatgtctcggtgtaaaacccgattgtacatttgttcaactctgagataggagaaaagctgccctgtggcgggagacgagacatgtttgcagtaatactgccttgttattctttactccactgagatgtttgggtggagagaaacataaatctggcttacgtgcacgtccagtcatagtaccttcccttgaacctaattatgacatagattcttttgctcacatgttttttgctgaccttctccttattatcacgctgctctcctactacattcctttttgctgaaataatgaaaataataatcaataaaaactgagggaattcagaggccggtgccggtgcaggtccttggtgtgctgagcgccggtcccctgggcccactattgtttctctatactttgtctctgtgtcttatttcttttctcagtctctcgtcccacccaactagaaatacccacaggtgtggaggggcaggccactccttcatatataatatagatgtatttggtatttgcttcctcttcggcaatgtaatggccacactatgtcatcatcgggggtgtctttctatcttgcatgcaagcttttacccggtgcatttgtcaaagtgctcttagctcttggaaaaacaggttctctgctgccataaggaagtgagaagaaaagaactttccagctttctaaaaggcaatgtgcattctgtcttagccacttcccatcacccccagccccactaggaaaagtcagtattcatttttgacgtataaaagtaattgcatctatgttaccttaaccaggctccataattcaagtcaaaagtaaccaaaagcagaatgaaaaacacatggtaaagaatggaaacagcatggtctatcaaaatacctttgcagtttgcttttatctctccttccagacatcctgcctagggtcgctctcttctgctctgcaccagggtcaccctcctcccttccctgagccagcagtcctggaaggcagcctttgatgtgagggctccccactcctgcacctaccttctgcaaaattacaggaagaggctagaagcccctgtgctgctgcaaagaccccgaaacaatgcagaaggggggccaggcactcaggcggagatattttccacttatgttgtggcacagaagggaggtgcatgagaacacacgcacagcaacacccagcactcccacacttaggcacaaatagtgctggggtgcagatgctgccgaggaggtgtggggttgctgagaattagccgggttgctttgaagcttctcagagatctctactcacatggcccttatcactccttggtgaatggtgcaaggttttggctttttctttcttttcctttttcgataaagacttatgttgatagaactgatcaaataggaaggcatttcgttggctctagcctaaaggatcaaactaagccatctgcagagaatggaggatgcctgagaggggtgtgtaggagtaagagagccgcccttggcactgtaagaatccaggcgaaaggaaaaagaaaacctgcaaagatggtttatagcaggggactgcaaattttggtggctgcccacaccaggaagtacattttttacatcataaccacatcaatcaccctcacatttaatgctagaaaaatatactgtcatgaaaaaattctggaaagaatttcttactatgtgaaaagcattctattccctttaattctattttttcctgctctagtcaatttcattttgttgttaaaaatatgctgatctcaatccactgaactgatttcatgacccatgatatgcactatgaaactcacccggagcttgaaacacttctgtttcagtgaagtctggacaagagagagtgtcttgtgaacatgtggagagggcagcagaaaagcacctcaatttagaacaatgtcacaaaagaaaagtgagctccggggcttgggggatggaggtgcaactctcaaatgtcaataatcaataggataaacgtgtccctgactttcgaacagaggcccttgtgagggagttacatcattggtctgcctcaaaagaaactttattcagcatttcttgtcttgcatgtgaaaggaatgagagtgtttgaggttgcaggcaagcatttagatgttgaataatccctctaaaccattgtgcttacagctaaggcagcttcactaggccctgggtgcctgggtgtgaggctttgggctcagagaagggaccccctctgacagggccccgagaaccagcagttacacctgtggacctcacatacttattaaaagtgctctcaaaagtgcctcagtttggaccataaattcaatagtcactctaagtatgaataactgaggaaagtatgtctagagtatgcagtctactttattcttattgctttgtcacaaaaacacacagcccatgtaaattcacctctgatttctaacactgtgatgctcacattaagcaaaggatcaaagcaactgggtaccaggtaagtaatcctgttctgagaactcatggtcataaaaggtctcagtcaactagaagcctgctgagggtggcccctagtctttcccacctggaggaacaaaggtccttttagattccagtcctggaggccctgagccacccccaagtgagtggaggtatgcgtatatgtgtaagggcggcccgtgccacccataggtgaggtctggacatagctcagctgacacagatttgggagccaggggcttgctgagctgtgaacaccccatcttccccaaactacagctcatctccagcttctagtttccctgcaaccccacttcttttgtacccaaataattctcatgtcctgttgacttgctccctccctggtggatcaaacctggctggtttgctgggccttggaattaccttcgggatctttccatccctgagaggttgggctcctcataggccgccagcctgactcggaggaccgtctactaccctctcctgcggacaggcccgcccatggctgccccatgaccatgcttgccctgtcccttggcttcgtgtgggtcagcttgttctgccaccttgctaggctggttcctggagcttctatctgttgtggcctgggttgccacgctctccctggtcacctgtgtgcccggaccctgtgtccctcactggagcactctgagctaggccgcctcagctcttccttacctgctcctcttactgtggggatcctgcttccaggtctgcccttggcggctgctctgtactctgtacagacaccctgttggatgggaggcatgtcatggcctgtccccatgctaggctttcatttttactttgtaacctacttttatcaaacgtctgtggttgcttaaaagtcaataatatatttggagatggggtgagatggattgttttaaaccttaccttcataagataaaacaatgttgaaagttaactgtgagcctttggcgtcctatactgcagaggagaagggcagaaggggatgacctgtcctgtttaatgtggcatacaaaacctgaatctgggatccagaggtttccaccctccctccactgccacaagggggaaaaaggacttaataaacaccaaagactttgccccacaatatgatggtcaagaaatcggctgggagtcaaatcgcagttctgcctcttagtaattggtagcaaaatgatggtctcccaaaatgtgcacatctgaattcctggaacccatgaatatgacaccttacatggcaagaggggctttgcagatgtgattaagttaaggatcatgagatagggggattattctacattatctggacatcccccaatgtaatcaccagtgtccttatatatgaaagatggagacaggagagccagggtgaaagagaaatgtgaagatgctatgctctgggctttgaagatagaagaaggggccatgagccaaggaacgtaggtagcttccagaagctggaaaaggtggggaaacattccttctctagagcctccagaatgcagccctgctgataccttgattctggcctagtgagacctgtttcagacttctgacctccaaaaatgaaagtaaatttgtgttgctttaagacagtaagtttatggtaatttgctacggcatccataggaaactagtacagcaactatagctccttagttcagatacttttctaggtttgttccctcatctgcagcctaggaattgtaattgtccctgcaccaggtggctgctgtgaagacgggacagtgcaaagcaagtcaagagtatggggtactttctgtgatacaacgtgggctcagttcatggtagccatggctgttagtgcctccttgaatccctgcaagtgaccgacaaggttactgttattattcccattttacagacgtggttctgggaagttaaaatcttgcctgggcccagtgtgaacagcagaactaggaccttgtgccctggcaacctgactcgtcagctcccacctcccttccttgacaaaatgcaagtgtagtggaaatttttaaagtgaagtttaagtggtgaacaagggacattagacttgaatcctaacaagaacactgtgaccagtgataggcatcgttggggcttagcaaacgacaccccaaagtgtggcgctgtggcttgctgagtgctttgaattgaagcacactggaaaggcctctgaagcaaagtctctgtctgatcttctcctgtcctcctcttgtttcctttcctcccttaaagcaggtcagagaagccagaaccactcttcctccaaaataaaacctagaaataggccaggcgaggtggctcacgcctgtaatcccagcacttcgggaggccaaggcgggcagatcacccgaggtcaggagtttgagaccagccgggccaacatggtgtaacctcgtctctactaaaaatacaaaaaattagctgggtgtggtggtgggcacctgtagtccaagctactctggaggctaagccatgagaatcgcttgaccctgggaggtagaggttgaagtgagctgagatcgcgccactgcactccagcctgggcaacaagagcgaaactccatctaacaaaaccctagacatattactttaagctttccccagcccttttgtgtaggagttgggtataaagaaattcccaaacctaccttgtctgaaaggagatcctaagacctcattccacagaggtcctgccctgtgtctgggagaaaagactgccccatacagaggccaagatgaatcagagcagacaggccttgctggggttccccactaagtctgttgccattaggccatacccattatgtccaatcacatttttacaccactgtacactcttcctcgactctaaacataaaaatggacagttttctctttgatctttgggtcttcctttctcaagcctcccatatcacgaaataaattagttatgcttttctcttgttaatctagattttgtgataggaatgcctgccatgcccttatgatggggaggaagagttttataacatttcccctctacaatatgaattacagtcaaaaagtttctaagatctcaaattaaatacatgaaaatagattattcacaacttcatcgttcaacagacatttatttagcatctagtagacaccactcactgctgtaggtattgggcatatctcagtgaacaaaatagagtctctgcattcattggagttcacattttattggaggagagataaacatatatgtaggtggatgtgtatatgtgtgagatagcaagtgaaccagggtaaggagctagagattgataaggagtgtcattttagatgaagtgtttaggggtagctctcagattgggtatgaatgaaggaaggaggaaggcatgtgattgtcttggggaagagtctgacagagatgccagcaggtgcaaatgccctggggcagggcagtgcttggcacagctgggtcagggcagtgtgactggtgcctctctagatggacagagagagaaggaagagatgaggtcagattcctagggcctggatcatgtagggctctgttggctatggttggagttaggattttattttgacttgggaagccattggaacgtttgggaaaaggagacacactgtctaatttaagttacaaatatgatcgcaaattttaaacagagacctgtggttaaattgggctcacattggcctctggggttgcctggctgctcctgcccaaggctggcggaggtttgctgacacttcccaggaaagagtgaagcacagcagacaaaagtagaagcagctcagggcagcaggccaggatcctgccggagctcatcagcagccagagtggaggatgtgctgctgctgctgctgttaataaaagtagctgaagggtttatcagtccttctacccaactttcattattcaaacaatgttgaacttgccactatgagtttccaaactgtctgacttgtggagagccctgtcttaattagaaggtcctcatcccacttttccttgctgcctgcagagattttccttctgagagtgtttgtagacatgaaattgtgggtgtgcttatttctcccctcacttggatgatcgcccatgctggttcatttgagtcccaacacatttgcacctgctcatagatttttgcattttcaatttgcaggagtagagaaacagggacctaaaaggagtttgtctcatgcactttccacatctcagctttatgtcttacactcgctattattttttctctgaacctaactgatttgactgtcttgtttgacctctgtctttgattttgggattggaagggcataacatttggccattggttctctattcaatgtaaataaagttgaaggaaagagactatcctctctcacctgctttttcggttcctaaattatatttaaagagagcaaaatattacagtttcctagtaagttaattaaaagattctgaagaaaattggacgcttttcaaaaaggaagtttacagagtttagaattttttcagcatttccatcctcttctcttcccccaacacaaacagacttatacagaggcacacacagacacacgcagagacatgtgtacacagagacatgtgtgcacacaggcacactcacacaaactaataaattagtaaatggaagctttcaagtcagagaatctactccttaagcatacattatcatcaaatgttaatactgattgcgtccaaaaaattccatgtaaaaaacacgtccttgtgctacgtattgaaaggtagggagtgaatatgaaacctggttcccagccaggattgcagaagggaaaagtactagccaagaagagaaacttctagctccttcctttggatttcaacactcctagaactcaactgaattaaacacaacagtttggttcagcaaatatttattagtcagttgtgcactgtgtgcaggttacagtgctagctctcagggtttaactaggatggatgaatacccttcccagcctcttgagaaggtgctgaaactaaagggagaattaaaaacgaaaaataaaaataagttcaaagtcctcattcttcttcttcttcttttttttttttttttgagaaggagtctctctctgtcaccctgggtgaagtgcagtggcacgatctcagctcactgcaacctccacctctcaagttcaagcaattctcctccctcagcctcctgagtaactgggattacaggcacgctccaccatgcccagctaattttggtattttttaggagaggcagggtttccccgtgctggccagactggtcttgaacttctgacttcaggtgatctgcccacctcggcctcccaaagtgctgggattacaggcgtgagccaccgcgcccggcttcatttttaagatgaggtcctttctccgttgtggagacttttccaagtttctagtgggattagtgtgaaactggcattgcactgcttgtatttaaatctggcttcccctgtactgcctctgtgcccctttgcctctcagtgcctcggcgtcctcacctgtaaacaaggaaaccaggaacactcctcatagagccaccctgtacatcctgagtgtgtgtgcagcatacacaacactgctgcacacaccatgagcactcgaacgccaacaactattatctctctaattcagagctttattttattttaaatctggaatccaaatcagtcctattccagattctttatgaaaatgatttttttcttttttccccttttactttggggagtcaagagactttcttatttcatcttacagaatgttgagttttcaaaatgtccaaaagagaacaaagagaagtgaggtagcccttgtccttaagtcattacccacccctcaacacatttagcatattttctggtaccttcaaaggaatcctatcactttccatctccatattgttcacattccttctcacctgtaatgttctcagcctctgctaatttctcctttccttgaggcaccacgtccctttctctgtaaactttatcccaagtattttaaaacattcatagattttgccctcaatacctgaagcattcatttatgtcattcaaaccatgctgtcccttgcatatggcaacagggttgctcttttgcaattgaagtctaatgccaactggatcggaaagtactggaaagaaagacattgaccaggcacggtggctcacgcctgtaatcctagtactttgggaggctgaggtgggcggatcgcctgaggtcaggagttcgagaccagcctggccaacatggtgaaacactgtctctactaaaaatacaaaaattagcagtggtggcctatgcctgtaatcccagctactcaggaggctgaggcactagaatcacttgaacctgggagacggaggttgcagtgagctgagatcttgccactgcactccggcttgggcaacagagtgagactccatctcaaaaaaaaaacaaaacaaacaaacaaaaaaaacaagacattatctttaacttggttgcaccctcggcaatgaataacatggttataagcttcagtttccttctctgaaaataggaataataacaaaattaataataatgtttacctatagtgctgttgtattaaatgagctaaaacatagttactggatataatgatctttcaataaatttcaacttttttttttaaatggggtcttgatctcttgcccaggctgttttcaaactcctgggctcaaccaatcctctcacctcagcctccgaaactagctattatttttaatagactaaatcattctggttggttatttatgatttttataattggtggtaataattagactgttttatgtttgcatagaattttgcattacgaaaactttcatgatcagacttagtatagaaaatttagtaaactatttaaaatgtagagaaaaatgtaacattactaccaatcttatccttcagaatcaataattttatatattttggtgtattttttcagttcatatattatgaatattgctttctagtttgagttttaaaaatcaaaagttctatgcaaactttatttttgatggttgcatatattccatactatggctaatcatattttatttaaccatacttcacttttgagctattgcactgtttattggttttagttattacatattattacatatatgtaatgttttcatataacccattgtgccttcatcttaaccatttcatcttcctacaaaggatacgacttggagtagaacattcaaatcatgtcattttctattttgtgttcatacgaaaccgtgaactgataccttgaaattactctagatttatctgcacagaactaagcccaggcaaaaagcactatgatggcttctacttaacatgaaagtaggtggttcccatagccgcttcagataccatctagacatgcttactctttaaagaccagaatgacagcactttgggaggctgaggcaggtggatcacctgggatcaggagttcatgaccagcctggccaacatgacgaaacactgtcttcactaaaaaaacaaaaattagccggacatggtggcaggcgcctgtaatcccagctactcgggaggctgaggcagaagaatcacttgaacccaggaggtggaggttgcagtgagccgagattgtgccactgcactccagcctgggtgacagagtgagactccttctcaaaacataaataaataaataaacaaacaaacaataaaaaaagacctgaatgaaattcttgcactttcttcttaatatctaattatctgctcctccttaataaaacagatcaagtatgttttatgcattgttgccttgatatggtcttagttcagtttaatttttcagtattactttttaactataacaaaagtcctgtgttaaaatggatttttattcctcttttctccatctaaaatgtatccattaaattcaaatgaagtatcaaattgtaaaacattaaattgctcagaacttatgtgagttcttttctatttttcatccacattttagtgtattagagattaagtgaggaggtgctgacaaatcaacggtaataaaaaaaaatcagtaaaccagattttgtggggtgtggagggcatgcagatcaaggcgcaaggtggttgagtttttcatgattcaaaagggaccagtaatagtgtagaagtcaattaccagatcatactttgaactgatgttatattgctatattctaataaaatgtcttatctaaatctttatccttttttacttctcatctatccaactattatgaatattttaatatgttgactaaacaaattggtcataatgatatatagagataaccaattttcaaggaattagattttgaatcaacagtaaaagacattggccataaattggaagaaagaagattagcaaataacttgatttatatatacatatatatatgttttgttaattattatttacagtttcccacataatttaatgtttttggattcaccttaaaatatctcatagtggtatttttttaaaaaaaacgaatattaagttaatggttaatctttcaatcaaagatatcttagaatgaataaataattaagataaacaattaactgcaaaaatagttatctttgagtagtaagactatatatgattttccattttcttctttttgctggtctgtattttttatagtaaacagattatttgtagagtgaaaaagatataaacaatcaatataattttacctctttctttggtggggagagaatgaattagaatcagtctctgggccatatcttgtaaatatgaaacatttcagagatcggtagaaagagtgcaggtccctgtgctttaggtcatgggaatgcagtgagaggcatggcttggcctggccttggggatctgaaatcaatggagaactctggaagccctgaatagaacaatgaaacctaaaagtacgaaacctgctgaaaggcaagatggtgggtgagcagtcagggaaccccgtattggaaaatatgcaacttttcatggaagttatgcattaaaatattttttaatataagaaaatgcctccaaagtgtaatcatttgagtggattagtcacctactcagttaaatacaaaaacttgtgtaaggggtcgggtggatctcaacacataatagaccttattccagcccatcctggataccccaaaaccctgacttggtcattacacattctatgtatgtactgatacacattctatgtatgtaccgaacactcacatgtaccccataaatatgtaaaatattatgtatcgataaaattttgaaagcctagcaataaaataaaattcaaataatattcccaagaaacaaataaaacaactatagtaaacttacatatagcaaatatgagctacaatagcattaatctgtaaggcaggtgtttattaacactatctttggacgtcagaataatttagaaaaataaactggactgacaactttatttttctttttagattagacttgataaagtgtcttacatggagtctggctagaggatgtttatatatatgatgtctattatcatatatatggcatcctatcaatattgagattattacacaattggccagggcattactcaggactgtgcattttggagtttgccctgctctggaaattgtaaaatattcatgcatttcctttttaaagcatgcaatagctctctgggctttcaaaccatcagctgcgaagagtcatgttgcataaacacactttcccagagtaatcagactcatcagtaatttgtcttttcatcccaggctttccggaaattctgtcagggagaaaaagttcaagtgcactgtggttttctccctttccaatgtttattttataacatttcttcttttgctttccccttaaaaaatgttttccgttgttcaaaacagattcccactgaaagggggcagaggttcaattttatttaaatctctcctcattcccaatgagcaggggttctctatcttcaagctgacaccccctgtagctctgggcagggtggcttctgttcttgggctctgccgttggtgggagccagctgccagcaacacctgcatctctgctggggtcagcgagctcccagtgcctgagagcttcctcccagggctggacactccctctgcatgcaacaagatgcctacagagctgctgcagagacaggctgggaaggatggcaagggtgagagaagggcacaggggaaccagtggcccttacctgtggttttagggttctgtcttctgtcctccagcccgatgagcagggacagctgctgtgcaggcggactgcctggttggatggccccaaccttctgtgcagctgccagccagctgcgctgcccttgtcagtggcgctataaataaggcacgtctggacattggccaggcctaggagataagaacccagcccctggctcccacgtgccttttaaggtctccagattaaagaagcctcagctcccagatgggaaggggctgccatgtcctcgtttgtcctgcctgcttcaaggacacacgaggcctcatattttccaggaatccaaagggtggctaaactgggaaggccaccagcaccagaaagggacctcactttgtcatacaagaggcagagcctccaacaggctgctcagctccacctctgtgcaccccccagattaggtaactggcatggaggcccaggagtgaaaggacacttcccccaggctacacagcacctctgtgagctgggaaatgtggatttctagtgctgcctttggaacgagctctctagcttacaagggcatttgcttgggtgagaggatgttgggaagatcgaacaatcggcttaataaatgccaggcatttgtgaagccgtggagtggaatacattcgcagaaagttctctccctccctatcctccctgctcatgcatgattataagggtttcttgagccatacactgttttctctatagaattaaaacagtgaaatcttcccagagcatttttaaagccatatgctgggagaggaagagaaactgatttgggggaccaacagctcctgattcttccttaatgtcttacttacgagtatgctgaaaaggcactcacccatggcgagggccaacttcttctgaggactatttggcgacagctgtctgcattaccacaacaattctaagcctgcagatttatcccgaggaaagaatagtggatgtgggcagagatacagctgcaaggacatttctcgaagctctttttatcttggaattaggaaaagttggaaacaacctaaatggctatcaaaagggggctgattaaatgagaaatagtatataaaaaagcagaacagaccaatcacagtggcttatgcctgtaatcccagcattttgagaggctgaggcaggaggatcacttgagccctggagttcaaggctgcagtgagttatgaacgtgtcactgcactccagcctgggcaacaaagcaaggctctgtctctaaaaataaaatcaaaaataaagcaaagcaaaacacgctgcaacctttagaaatgtcaaaggagaatatttaatgatataggaacaatacatataattatagattgataataaaaagcaggtcatggcccacgcctgtaatcctagcactttgggaggccaaggggcgggtgaggggggggcagatcacatgagttcaggagttcgagaccagcctgaccaacatggtgaaaccctgtttctattaaaaatacaaaaaaattagccaggtgtggtagtgggcacctgtaatcccagctacttgggaggctgaggcagcagaatcgcttgaatccaggaggcagaggttgcggtgagccaagatcgcgccattgcactccagcctgggcaacaacagtggtcacccttgagggaaaaaggcatatgtataacatgaagttactacacacaggtaagcacccccctcccacacacacacatacatcctgaaaggatgtgccacaaatgtggaaggtgttgatggctggaggaacggatatagctcattttattttcttctttgtcttatatgcaatctctaaattatttacaataatattgtattcttttataagaaaattaacttcatctaaaatcttagtttccgagactcagaagacagctttctgtgtttctgcactaatgaatctcagtttattttaaggttacagaattccttggggtttccccactctttggaaaaacctatgtaaggcccagaagctctttttcatgccaattccaatgatctgatgtagctggacctgtcaaatcctctaagtgtccctgtcaaggcaaaggcaaggcaagaaaagagaaagaaaagaaaaaaaaacactaagagaaaaaga

SEQ ID NO: 15209 - DNA, 24144 bp, Human
acacgttgtatatcatctgcagactcagtgtgaagtacacggagacaaacacatacagggacagacagcagaaacacttttaggtcagaaacaagcccaatttcttttttgttttgttttgtttttttgagacggagtctccctctgtcactcaggctggagtgcattgacgtgatctccactcactgcaacctccacctctcaggttcaagtgattctcctgcctcagcctccaagtagctgggattacagacatgtgccaccacgcccggccaacaagcccaatttcaaatgataagacatggctatggaatttagggacaacatgagcttgacggaaagcaaacagctcaggtttgggaggccccttccacaaagaggcattgagaagaactcagggtaggagagaaagggcagtggtttgctgcagtgagactcactgatacagtttcattcagtagaagcactaggcaaacttatacaagaaaaaataaacactgtaagcagctgagctaaagcgaatgtagaatctgagggactgaattttcctgttggcccgtgagtcaagtcacttacactagctgatatcactgaaataaggattgcccatatttagaaaagctcacagcaggcaagaatgctttccagactcctgccacagtatcaggagatgtcaatcaccactatgtgtttttggacagtacttggtggacagagaacaaggcagctataatgagtttatcctggattggccccagcatataaaataaaacaataataatattataagtcggttctgtacgttgtcatgcggatatgtgctccctgccctctccccaagagggcatttggcaatgtccagagactttttgattgtcacaacgtcgggggcaggttgcaactggcatctagtgggtggaggcctcctacaatgcacaggacagccccctacaataaagaattatccagcccaagatgtcaatggtgtggaggatgagaaactctggaccagaggaggcaatagcatttatggcatgagggggttttggtcactgacttttttgaactccccactccgcaagtatcagttctccgggatcattgcttctggcaggagaggtcatgaggaggcctagaatatgaaccagatagagattgcattgtttattttccttttcatctaaaacaataaatcatcctgtagcttaggcattaggtcccttcggatgtcacggtatccttgtgcttttctgacatcaacacatataaatacagggcctgtggcgcccggggtttctgcctgggtttaggtttcttccccctcagcatcgcgtgctgtgccctggtggaggggaagagcgaaacactttgggaatggggcgttttcgtaacgtcatttatttagtctagatgaattttgctctttaagaataagaagttgtggattcccagaagctggaaatcggacgagagaatatgcgttaactagggaagttaatcacgttgagtttactgacaaggacaaggcaagggggaggtggcggaaagccccgtttggctgactttctactgctggagcctcccggcccatgactgtctccgcgaagagggggatcggcgctcgcggtggacaggtccgacgcagggcggcgggggccactttccagcgggaccgtcccgccgccgggcctccctggaggggaaggaagtccctctccaagtcccagtggcttttggaactgccgggtccctttgggagggagcggtcccgggacgtgggaagatgccgggcgggcgggaagctgcaggaagaggcgggcctcctgccttttgtctcctggtggctagcccggagcgggcagagggcagcccgcccgctacacgccccagcccggcaagcggctccgggaatccggcgggcggggctgggaggagggcggggcggacacaggccgcgcccaccgagcgctctttaaaaggcaccggcgcgcgcttcgcctgggatctcggactccctggaccctccctccagcccagcctcgctagctccgcctgcggtacgtgctcccgcctccgactcaagtgagtaggggcggtggggcggttccgcggcgccgccaaccccggggcgggagttgcagggggtttccaccgcctcccggggtcgtgctgtcgcccggccggcgcgccccggtctcctccgacatccccatcccggtccgcatttgtgcccctgccagccttctcatccctgcgccccagattttctctctcttatcccccaaacacacctgcccttgtccccgaggccgtccaggccatgccctgggatcccaggcccgcggggcaggtaaataatcttatatgacctttaatttctccatactggtttctctgggagagaggcgggttgtgagtttcgcgtttctgctaatccgcctcttagcagccgtcggtcccctcgtccagcggcaggctctctctggggtgggggtcggagtctcagggccccctctgcccggagtgtggtgagcaccgagggcgaccttactgggttctgtcccctaggggtggaatggggcttctacatccccccgagcccagggtactgctcctgccgccgtaccgggctcctggcatccccattgtttggtggtgtctgcccacccagcaccgaacccctctatgttgaaggaacagcagggaatgtcaatcacttactcctagctttttccagaactttctacgattcaggtacaaagaagaatgcaagaatgcttggttgtgaaattatgcgacaggtcctgcgaatcacattctgggttctccagagccagattcaggagctccacgtaggcaccccctgggggcgggggcgggctttctaaaccggcggatccctttcccccttctaagccaggacatttgttaaacgatttttacttaaatggctacccaaaatgtttaacctgttttatttgcagtctgcaaaccaagcacattttccctttataaatgcttttcggtacagaattttttttggggggtgggggggtggggcggggggcagttagtaattttttaacccgggcagcgaaaatcgtcgtatttagttcttgacttttccaattaacctgttttaaaactctcctcataaaatgccaagaattcaaataggacagccacaaagttggctgtactttgactcacgtttttcaagaaagaattgggtgatagattttgaaagggagaatctaacatagtttcagaactgcatgccaagctacaaagaatgttgtgaagtactaagtggtctcccccagtactcctggggtcatcgctctcgtccattgtcactgatactttgtcagtatttctctgggtcctttctcctctgcattgtagttttctttgctcttttggttctgtgttacctttgagaccagacctgcatcacatgagtctttgaaactcacagtgcttgcttgggtaccttggacaattgactgaaagaaggagcgaataaggttgtgattatagggaacaaaaatataatttgactcacacaataggtatttgtttgcagatttgatctaaagttcgtatcataaatttttaatgcatttctccgaatgtatttaacaaatattgattgatactggtataggctaagtactgtgctgaaagcagtacttgctggaggcctgtcctgatgaaattgcaaaatcacttggatttgggggagattgaattttatcctaaaacagcaagaatgttggtgtagagtagaggacagcaataaatgaggagttttagaagcctgagtccagaggcaactctgacactaaattgctatagtgatctgggtctctaggttttcttctttgtcaaaagtgaggtgaatcaaatgaaccccaaaagggagccccctatgggagaggaggcatggctgaaagggggaggaacgaagccaggcaggaccaaattcacacctcaactccagtacccattggtttgatgcccttgggcaaattaactttactctttggcctcaatacttcatcatgtaaaatgggtgtagtggcacatgccttgcagggttgtcataaggcctgttgatacttgtacaaagcccagcccagcctgggagtagttccttgtaattagacaaagttgtgcacttggttgaatatatgtgggaaaaggctatcagtgaaagtctgtttcaggagagagctggctcacacctgaagagcgtttcctagaccttgcctggaggccagctttcttctctgtgcagatgttcacaggtttcctcaaggcaccttaccctgactgccagcatgccatcccttgggttctgttgggtggggatccccagacacctctggatctttgattacctaggtggggtttctgactttttatatcatggcactcctgtgaggcctccagaccccttctcaaaatgacgtaacataaagtatgtggtaccaagttccccaacccccagaattaaaaggaattgtggcctttgggttaagaatcctgaattaagggaatatttctcagtctggatagtggagaagctgggcacaatttcttttttttatattttttccttttcaaattcctttttaccacaggcacaatttctgattgttaaaaattttattgttgtaagtcacagaggaagaactaatagaagtacatggtgaatgatctggaaaggatatcaggttccttgtttttttgtttacaatcttattgtgccaacaatactattgtcttcgactaataagaacagacaccatgtaatacattagggccaaattacttcccagttcactataggaaagagggcttcatggtggtttcacagtacttccaaaagaaaataagcagagagaattgaatcctcatccagcacacggcagtgcaggaactactcagcttaagaagaacctatgccatagccatggaggtcggtactacatctgtattgctaccaggggtttagtttagcaaaacatcagtgaaataattttgaattggaattttattggtattcatttttaagttgaattgataattttattttggtttcacagttatgagtcatttaatagctctatgcctcagtttccccactcataaaatgagaatagtggtagtgcttactttagttgttatgaggattaaatgaggtaatataaacataagtaaagcatatattaagctttatagaagtatttgtaattattacctgtcatgtggcagacactattctaggtgttttgcatatattgtttaatctaaaaactgccttattgtataaataagcattgtccccatttttaaaatgagaaaactagcagatcaaatgaacaacctgtgatcatttggcaaataaacaagagtctcagcatatatatctaggtctgattccatgaaaaaatcgtgcaaatattaaattgtttgaataattaaataacttgtagttttgcacagattgtggattgctatggcagatgttggggatcagggttactgagcttatagcatagttgcattttaattacaatatgggatttggcagatagtgattcaaatctgtgtcgaattttgctgcactctaagttgaagacacgagtggtagcagaatacagaagtagtaagaatggtgaggctgaggtacacacaggagtgttcactagattagaagagagttttccttcagtggggttagatttaggttagcagagaggggtaataaaaagctttttggttgaaagtagcagtttgggtgtgagagtggtgcacagagaccacttactgaccgctagttggatggagaggaaggtgtgtaatttgtgtgtgtaatttggtaactcaaggattgagaattctcaggtcatttgaatagtctcaacccttaatgttctgtgcctgtcagatatgggagttttgaggaaagcttgtggttctggaatcaaaacatgagcctgatttgtttctttggagatctgtgacctcagcaagtcacccaactcatcagtccccatcctttttggcaccagggaccagttttgtggaagacagttttttcatggatggtgggtggatggttttggcatgaaattttgggatgaaactgttccatctcagatcaccaggcattagattctcgtaacgagtgggcacctagatccctcacctacacaattcacaatagcgttcccgctcctatgagaatctaatgcctctgccgatctgacaggaagcagagctcaggtggtaatgctcgcttaccctccactcacctcctgctgtgcagcctggttcctagcaggccacagaccagtagcaagtagcctgaacacaaaacacagccatcggtctgtggcctgggggttggaacccttgacctaacggactgaacttggtatattcaggccccgagtgctcctaaaggaaaaggaagcccgcccatttgtggagtacaggctctttgccaggtactttacaaactttatctcattaaatctttacaaccgcctataagatagttctcatccatttccaagttacctctgaggaagttaaggctcagaggttaaggaaatttggccaggatcacatagctgataactagctttgacaaccagcttgtgtctatctgattctaagctccgcactgtttcttttatatctggcatgtctaaaaggtggcatgtgtactgcggtatttccatggcaaaaataattaatcacagttctcttgattgtagaacctggactgaatttcagaatctttctcaacgtagttccaggaatccactctcagtggatctgcaagatgaaactgttttgtcatgcctgtgaaagtaaatggtgcagaccttcaaaagccctttttgcatgcctctgtgtcatttattatattgctattgtttgtccacatgtttttaccacctcagtagaactctgtgcaaaacgggcctttccttatgacccatttatcctcagccccctaacccagtacctggcttatgaaatactgttgaattaatacatttatatgagagcttcataaacagtaaagcattatgcagtgcttataagctgcctctaccctagaaaaattacttgagatacagaaatgaagttagctggatggaacggaggtaaggcagttgccttgatggggagggtttgggggataaggaaggaatagatatgtgagatggtagggcaagatgagtattgataacaaaggttagaacattgctaaatattgatactatcatttgagtccccactatgcaagcgttacctcatctataactctataaagatggtactgttcttaactctctaaaaaaggtactgttgccctaagtttacggatgagagaaatgacacttcgtggactccaaacgcgtgttcttactttgcccttatgctgaactgacttaaaggccaggttgaggatttggcttcagtaggaggagccaaatggagtacggagctgatcactaagacatgaagagttcatccttggttcagtggtattcacttccgtaagagaagtagactaagtgggtagttggggtaacagaagaaaaaatttgtagaacaggcatcaactgaaagcttaatttccaattaactacagctgtcaaatcctggtcttgctaaaaagtcatcgtaacgggacagtgctactaacttacattctttaacaagtgactccccctggatgtggctcaagatgagactgtattttataataaattctcctttaggggaaattggattatagtcaggttctagtgtaataacaaggccctacatgtagtaataaaatgtcaaagcttctggaggcatttagaatctgggcaaatatagaatatagactaattcaatccaaacttttagtttcagggcagataacttaaactttaaatggtaacatatagatttgaatttcatagattcaagtcattctgattctaaagtaagacagtaaatgcggcactaatggtatgagaatggcccaggtagtcagctcttgattatcatacggctctgatgagtgcaggaacacaagggttcttgatcctgccgccggtttagataaaacaacacggacacacgtggagtggttttaaggagcggagagtttaatgagcaagaaggaagggagaagacagaaggaagaagctccccggtacagagacacagggaggggggctccaaagcccaaagaggaggtccccacctgcaatggataccagcctggtatatatgcaaagactggaggaggcgatgtctgatttacatagggcttaggggattggtttgaccaggcatgtcattcacgtagcccaagaaaaagctggccctcacaccctagctttttagtatgcaaatgcagggcgccatgatgttccacacacgtggggatatgtggaggctgccctgtcaccaggcacaggtggggcatttgcatggcccacatggcctgcatttgcatatcaaaggttgctggcctggctctaagagccagggctttacaagaaacttttccagagatgctttaaaaaatgaaaacttcccaaggaccccttttcctctctatctgcctaaaataatttcgtaataactcctaccacagttatctagagagtgagctaactgtaccataagacgactcagacttagactatatcagtttttccgcatgggtgagtcttatgaattttggtggcatcttaggctaagaagaggtagcaaggagaaattgcacataggtgttcagatataaatcacgttgtaacatgtaatacagtggataaatcctagtgctggaactctttcagacactgaaaaacaaggaacaagactgagaaacagaatttgccctattttatcacatgtaaagtgggattttatttttgcttttaccattctgtaaattaatgcctaggatttgggaaaggcatgcagcccagattgcttagtgcaaatccagtttgctgtgattaatggcagctgtagtggagtagtacggccaaaggcttgtaagaaaaatgaagacttgcttttttttttttttatgcacagcaatgccaagagtgacagaaatggaagatcatcatacttcttccagccaaattcaggaaatgtccattagaggttcagcctaaaagtgcaaatttgaacttcgtttcttttctttttttttttttttgagtcggagtcttgcagtttcacccaggcgggactgcagtggcactatctcggctcactgcaagctccacctcctgggttcacgccattctcctgcctcagcctcccgagtagctgggactacaggcacctgccaccgcgcccggctaagtatttttagtagagacggggtttcaccgtgttggccaggatggtcttgatctcctgacctcgtgatctgcccgccttggcctcccaaagtgctgggattacaggcgtgagccaccgcatccggcttgaactttgtttcttagacagtcaccaccatatgtggaactgttgctttactttggagtgcattttaatgtccccaaaaaagaaggtttatagtgaccaatcagctcagttttgtccttaccttgtttgttgctctgcagctatgttctaggtgctggttggtgggttttcctactagagtactgatagcaggctggatagagtgagatgtcccctctgtcttcaagctgacagctactggattcctgccaaggcatttgcttaccttatcttgccttcacaatatttctgtgggtagagagagctacctatccccatttttagcttgagaaaatgaagcccaaggttgcgcagctattataacggtggagttaatccaggtgtgtttaaaccagtcaatcaacttcctctccctccttccattatgaaatagttcagacatacaaagtagagaacaatataaggaatattcaactatcaccatccactttttttttttttttttttttttttttgagacagggtcatcttgctctgttgcccaggctggagtgcagtggtgcaatcatagctcactgtagccttgacattcccagcacaagcaatcctcccacttcagcctcccaagtagctgggaccagaggtgtgtgccaccatgcctggctaatttctttttaaatttgttttaaatataggtaatatagcgtctccctaaattccaaattccaaagtgttgggattacaggcatgagctaccacacctggctccctaaccatcttaaaaaaaaaaaaatgtaaatccaactgaagctttctgacaatgttcttttgttacatcatttccctctatcacagaaaaggttattcagaaatccttaggaaagcccttaagctggatagaactgcaatattttgatatatgcaaatactctgatagatggtgtggagaatacagagatgtggtccccaccatcaagggaccagaaacttattgcacagtaagttgaatgttgtggaactttgataggtatttcctgaaaagctgacacatttacgtttggctggtgcagttaacttagaataagtaagtttaaagaaaccctgaattacataaagaaagggaagatattccttctttcttaaaaatccaggctgttcttcaatggtatggaagagaataacaaggttattagttgggttttccttttaatgtatttttaagtgttattcaaagacagcctagtctagcctcagtcgtgatagcaatctggctccttactggtgattgctccaaagtaaatatgtgtgaaaatgaaaaataccaagttggtattaacagttcactttctaatatgagaaatgtttcaatgatagaaatgcctcgacaacaacaaagtattttaagaaccagttgataacttgggatccaatataagtaattgtagtgtcattacctggaggcctggatttggcctttggttctgcaggaatcatgagggaacttccagcagatgtctgttgcatccatgagcattcagaatacaggtagctttggaggcaaggggcaaggtcagtttctctaactgtactacaaacacgggtcagtgcaggctgttggagccaaggctttatgtcttaggttttaccgccaggcttatgtttcactctggatttcaacaatggagtgcctgtctccaggggaggagaataaaagatttatgcagctacaaaaggaaagcttgtaaacatgtcctattgtcgcaagatactgatcctatatggatgccttcacggtaagcctggtaacatttgtggacccttggaatgactttgttcctgtctggttaagagaagttggctttttgcaaattcagacttacattttagtgataacaagccataccagtcaggggtgtgtgtgtgtgtgtgtgtgtgtgtgtgtgtgtgtgtgtgtgtgtgttgtttgttttaaggaacaggagctccaattccaaatgacttaagaagggaatttattggctcataactgaggcatgcaggataagataaggcacagttgattggccgtgactgagtcacatgcccagccttggagttgggggttgctatggtttgagtgtttttgtcccctctgagaatcatgttaaaacttaattcccaatgcaacaacgttgggagttgggcctaatgggagatgtttaggtcatgagggatccactctcttgaatggattagtaccaccataaaaaggcctggtgggagcgggttcaccctcctctgctcttctgccatgtaaggtacagtgttcctggcctccagaggatgctgcattggaggcaccattttgcagcagagatggggcccttagcagacactaaacctgccataccttgatcttggacttcccagccttcaaatatttatattctcagtctgttctttataaattacctagtctctggtatactgttatagcaacacgaaacagactaagataggggtagagtcagtaccatctaaaaccagtgcttttcttttttttttttttttttcttttgaggcggagtctcgctctgtcgcccaggctggcgtgcagtggcacaatctcggctcactgcaagctccgcctcccgggttcacgctattctcctgcctcagcctcctgagtagctgggactacaggcccccaccaccgtgcccggctaattttttgtatttttagtagagacggggtttcaccgtggtctcaatctcctgacctcatgatccgcctgcctcggcctcccaaagtgctgggatcacaggcttgagccaccgcacctggccaaaccagtgcttttcaaatcatctatggtaaatgtattagtctgttgtcacactgctaataaagacatacctgagactgggtaatttataaaggaaagaggtttaattgactcacagttccacatgattggggagacctcacaattatggcagaaggtgaatgagaagcaaagtcacatctcacatggcagcaggcaagagagcttgtgcaggggaactcccctttataaaaccatcagatcttgtgagacttattcactatcatgagaccagcacgcgaaagactcgccccaggattcagttacctcccaccctgtccgtcccacaacacatgggaattatgggagctacaattcaagatgagatttcggtggggacacagccaaaccatatcagtaaaggactgttatttttaatttccaagtacagactgatgactctgttcaacaagatgagttcactgatcttctcttagtttttgtggcgtaaaagtttctaaatgcttacctgaagtttgtctcaaattggtaacaagaatagtggcccatccatcaccaggagaccacattttaatgagcacttctctaaaccacatggtctaagaaagagatggctgctttcccggaagacagtctagggaaggtaccaccagaagagaggcaagagaatactgagtgctggaaagttccccaccgcaatgatcaactccattaatctttcttttggagaggcctcatctttgtgttcaggaaattgtcaggttctggatcaccttaatgggataagatgagaatttcccacatcccttttgattttaaggattggagactctttaatcttttctacttagtagcactctgtttcccttctctttctagccaggtttgggttagtaagaggcctcggccttattagccacctatttcctagagaggcaagcagtctatctaaggagacctaacaggcaagggctgcaaatgccactctacagaaggaagctcaaaaaagatgatggggaaaggggaatcaatcgcttgtgtttttagataccactcagggcagggcagacataacatgtcttcttagcagaacaactttctgtactggttaaggcatctgaggaagctggccattcagaaccaggcttttttcttttcgtcagagtctcgctctgtcgcccaggctggagtgcagtggtacaatcttcgctcagtgcaacctccgcttcctggttcaagcaattctcctgcctcagcctcccaagtagctgggattgcaggcatctgccaccacacccggctaatctttttttttttttttttttttttttaaatttagcagagacggggtttcgctatgttggtcaggctggtctcaaactcctgacctcaggtgatccacccacctcggcctccgaaagtgctgggattacaggcgtgagccaccatgcccagccagaaccaggcattttaaagtggtcgaggcagactaatttgttgagaagggagacgagaaaatgttggccctacatgacagtgagacaccctaggatctgtacttccagcttgccctttacagcaggccatactattcagaggctattcctgcatgctcagcaaacagttcaactggtaggaagggaacttgtagcagattctgtatggcctgactgacttgccaaagaggaaaacccaactgctggctgcactagtgggccttggggttagtgaagcatagaaacttaagccggagccatctggatgggcgtttgttgtggttacggcaaaagttccgtgcatgcagttgtacgagtcacagacacagctatttatgctacaatcgtgtaatttcagcaaacaaatataaaacttgttcttgcagggcaacacactttgttccctagaaagcgtgttatagcttatatatgttaaacgttaagaatttagtgttgttacaattaattaaacatgtaatgaaaacctccacccaagggtaagatcttcagctgagttcaaaaaaatatgtttattaaaaatgggcatattagggagggggacaaggcttgcctttcccctccccacgcttctttcttaactcctgtggattctaatggcatagcttgttttgtgcctggtgacctgtactattgtactgaatgcaggtcctttgtctggcaggaaaaaaaaaaaatcttgtgcacgacaagccagtttcctaatgaaagagttgttatttgggagaggagatgaggttattttggaggaacgcaggcctttgaaagatgtggttagagaggttcataaagaaacgaaaatctgcagctgtccctgggcttaaatagccctctagggagccgtacgaccagcacagggacattctaatgaatcctttattccttcagaatgcctgtctggggaggtggaaacaagtgtggggcctgtgggaggaccgtgtaccacgcagaagaggtgcagtgtgatggcaggagcttccaccgctgctgctttctctgcagtaagtagctctccatgctccacctttgacggaatttgtatgtacagagcttcaatatgtctatttaaggaaaaattgtggttttgccaacaaagatcattttgaaagcacgaatggtttttacctgtcttcttagatgttgtaaatgccaagcctagcagcgaagacaggaggggtggcccaagacacccagcctccctttgtgtccccatagcttttggcctccattttggcctttattttgttaacacatctgcctcccccacctcactgagtgctgggtgtcacttatgtggtctggcacctagcacagtttctggcacattacaagggcttagctcccatttttgagtaaatgattgctcctcatccaccccagctttctctttctcaggttccctttaatgacaacaaagtcttcggttttaaaactgtagagtagcaacttaaagcacttcattaatcatcttctgatttaatgacagaattttctttaatgaatgattatgtcaggtaaacccacccatacgggcagatgtttgccttatcaatagtattgtacagggaaaattcctacagaaaaccataggttaaaaataggttacattgagaaataatcttcaggaaaagacttctttctcaaatttgaattgtccttttccctcattggagccagcattcaaggtatctggacctctttaatagcataactaaactgctttgcagacaaccagaagcagacaacagaaagttgcagttacaaaaaaataaaaatactacataggaatgttcactatgtatgccttcctcagaagacttggtttaaccattgcttttagaagttacttttttaaaaaaggaatctatttttcagcaggcttgtaaccaagaaagtatggaaacagaatgcaaatactttagaaattgctctcagtttcatctgtctaggttaagccacaatgtctacaccatagtaacatatgcgtgtatgctgttgacatttgttttactaaatgtcaagttctctactggtcatttctacgaatcctttctaatatctgtctctgctgactaatgccttttaaggaaataattcagagtagtttgcagacctatgagaattttactgcagagaacagcatgaggactggggaagaaaggggtggttatatagtaacactttcatatacctacacttgttttggttcatacaggtttttcaaaacagtatttacatttattctctctgttaagggtagttgtccttcagcagtgcatggtgttaggttaactatggtttaagatatagttatctttaggcacatgtatttcagcacttgagcctcaacagttagattccagagtagatgccatttcattctaccatagaagactttagtttaagataatagactaaattttaaaccagccagctagtcctgcttccctcccctcctctttgctgtccttccttttgtcctccttcctttttattcaacccccccccttttatttttcttacttttaatttttatgggtacatagtaggtatatatatttatggggtacatgagatgttttgctacaggcatacaatgtatgttaatcacatcatcttaaatggggtatccattacctcaagcatttattatttttttgttaccaacattccagttaatactgtcttatttttaaatgtacaatgattgttgacagtaatcatcctgttgtgctatcaaatactagatcttattcattctaactatatttttacacccattaactctcctcacttccttcccgacaccctacccttccgagcttctggtaaccatcattctactctgaatcatcatacaattgtcttttaaataaggggaagaaattctgatctttgatttccagctgccagattgtgctaccagtgagtttcctcacaatttacttttttctcaagcttaattgaagttttagaaaatgaaataatgtctggatgaaactcgatgacatttggcagttttatgaagtgggacacgtggaaatgtcctgtggcaagagatccatcaagaaagaatgcattctcctttgggacagaagggaaaacaaatgcagactttaaagcacttgacgattttcaggcagactcatcactgctggagaagctgctggggagaggaaagtgtgatacttcccagtctagactagtgatgaaaactagaattcaggatttaaaactattattatcccaggaggtgcttttgggggaggaaaggctacagaggcaagtccccgaaggcactgagcttcccttctgttctgtattaggttgtgatttaacagtacttggttaagagaaggctgaaaagattaagagtgttgagggttgggagcaaggtggtgttttattccttttgtttaagcatttttatagccacctttgaaacttttctcccttaatatgatctcccagaaagggaaatcatagtaagagtttgatcagcaccacaggaaagggaataaaaaataaacgaaacaaactaaaaataaagcttgaggcttctggatgttatattctgatacatttctgaagcaactgtcatatccatggaggaatgtaaataatcctcgaatgtagctggccagtccagatgctgtctcatggcttttgggaagccacaggataaaccaggaatgtgagggagcctcagccttcaccatttgtaggccatgtgtctgtgccaccattgttctaaggaaaaaggcatctttggaacatgtgtaaagtctaactttttcccctgcagtggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagaggtgagttgggagaccgttggttaccttcagaaatgagttgcgacagttagtgccgcttgctgaacaggaacctggcagtctccagatttttagttgaaactaagcaaataaaatgggactctgattttctaatgtcaactagttcaaaatattgagttttggacctaacaaagttcttattaataattccagtgatttctacttctggctttatagcattccaagctgtatcaaggagtcgtgttctcaaaagcaagtgatttgtatttacttcaatttcacagcaccttggagaccggatgtcatgaaattaaatggtagagaaatgtgctgtgtgaatcatgagaggtgtttctcatgtgcaatgtaagcagccaatgaaaattcctaagtcactccttctatgtaaacatttttcatcaagaaatcacttttctctaacttaaaattttttacttaaaaatggaaattacttcttatttttgattctttgagagagtagtgttaaactttaaaggctttgttgccaacgtatcaaggtgctaaatttgtgaaagttcacttagtatttcatattcaggttaaataacttatttgtttagaattccccccacacacttttttttttcttttttgtcacagaatctcactctgtcacccaagctggagtgcactggcacaatctcggctcactgcaacctctgcctcccaggttcaagtgattctcttgtctcagcctcctgagtagctgggattacaggcgtgcaccaccacaccgggctaatttttgtatttttggtagaggcggggtctcaccatattggccaggctggtcctgaactcctggcctcaagtgatctacttatctcggcctcccaaagtgcatggaataacaggcatgagccaccgtgcccaacctggaatttcctcctaactcctacttttaacccagtgattccactatttgaacttcacattttcacatccattttatattgagaagtccaaaattggtgtaatagtccaacaaaatggcctttggacaagaccataaaccatgccagccaccgtgcagcattagcatatgttaactcgtgtaatcctcacaacagtcctacaacatagggcttcctctctttcttcagaacagatgaagacaagaaaaattaagtaaaaactttgcccaaagtcacactgttagttaattgtagagcctggaacttaacctagtctaactccaaaccttatgacctgaatgaaacgtggtgcttggcttggctaaaataataattaccatgtattgagtccctgttgtctgttgaacatttatcttcattctgtataatccttagagtaactctgaggtatactttgtccatttatagatgacgacactaagagtcgggtcacacaaataagtgagggagccaggatttgaatcaatgtccatttggttccaaaatctgttctcttcctactgcagtatgtactacattgaggctcacctctgtgttctttgagcttcttccaccctcagagtttctgggccatgatgcccagcttacctttttatctttgttaaaatttattttacttgttctgctctccttttccatcttgttacatctatttttgtgttttaaaggttttgttgaaaacctttcaaaatccatatcccctcactcaacctgcatctccctcaatccaaaccagatttatccatgaccccaaaagtaagtcagtgactatggccatagttttaaagcacaaagaccagtgaaccctcctttttttaaaaaaaaaaaaaaatatatatatatatatatagacagggtcttgctatgttgcctaggctggcctcgaactcctgagttcaagttatccttccacattggcctcccaaagtgctaggaagacattgtttttccagtaggaaaaattaacagttgtggagtgctatcattttatctgctcagctaatttataaggttctaagagggcttaaaaaaaaaaaagtcttctcaaagcccgagaatgttctgcacatactaggtacaccttactgaatggaaacagttcctactgatagcaagaaatatggtttactcagtgatctgtaaatagtgacaaaaataccacccttaccagagaaaaatgaaagataaacagattgcatagtaataatcaaaatttataaaatatttttccatgaagaaagttggctattcacactttcctttattcaagatatactgggagactaagtaatctataaaacatgcttaaatttcttagttacagaccaaagttaacttacctatttgtggaatttttaaactacttaatagtggtttttccgactcctgtgaagtaaaaagctaggtatgattccagtgatattattctggagtaaaaatatatgctctggtaagtttttataaaccgtaacataattgcttagtggagaggccaacactgaggagtaaatgaattctgtttagactcagagggacagatctttacgtttgggtccctatctggttttttgaaataataatgagcccatagataggttcaagtagtaactctggctggcacctgagtcacttcttctttattccctcccctgtgctggcctgcaaaggcttccagctttgaggcagtgtagcggttaagtcccagagttctattgttcctgccttgtgtacttaaaagggccctgtggaaactcttgcctactttttttttcctcttttcacaagtgttcagcctcacaggcctacaacaaatccaaacacttctaaatttgctcagaaatatggaggtgctgagaagtgttccagatgtggggattctgtatatgctgccgagaagataattggagctggaaaggtaaagtgctatttggaattaataacagcaaatgacttctctctgctccctttctcccctaacccttccacattccttgcttgggtgatgtcttacaaatcactgtcttatatgaaacttttctttaaatgcatttccatcagaatcattaacttttttgaagtgattcccttatttgacaagtcatttttctgtttaaaagaacttgttttcatagggggcactcctgaaggttaaactttaaaaggccagactgtaagggaatctccaggttattcagtatagtgaaaaaagcaggaatccgagtcaggacacctgatgcgaattcagtgtgtggatttggaaaagttaccagctaacctctttgagctgcgctgttcttggccagaaaaaagatggtctctttaaaggagcagactgggcttgtggttaggactgaggctgctcttagggaaacagcctttctgtgggtgatcaagagtgcagatactgaggactggtttcagccttctaattggagctgaaccacagaagtcaggagcttgctttgagatgatcatcctgagccacttcttgccatacatctaaattgaactgtaggaaacaggcctctcaaacatgctgacacattcatctcttccagccctggcacaaaaactgtttccgatgtgcaaagtgtgggaagagtcttgaatcaacaactctgactgaaaaagaaggtgaaatctattgtaaaggtaaaattcatttcagttactgctgtccatatgaatattccacactggttcttgtttaatgaaatgtcactggcattaaaaaaaaaaaaagaaaagtatgccactattttctgaaaataaaatatcccaagatgcttatagatgacagagaaccacagttaagttcctgatcatttaaaactccccaccagataaaaacaccacaaatagccatcttttgccttcatgtcttgagcaaagcgtaagtatatggaagaaaacagacaaatacataccttacctggcctgactcatgcttgcaactcagcaggaccacgctgaacactatagggccagaatgtgtggacttgtctttgcagctttaagatatttagtacatgacacatttaacatcttaaataagttgagctcttttacacagcagtttaatttatgggggtttgttgagtgggtcttaagcagtgctagcaaagcttaatggacttgcactaactatccttcctccctttcctttgtaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttgatttgggtgttcattgtcttttaattaatcttttggaggagatgctctgatttcagttagtggaaagtcatttggttccctacctttgttaccccattacccagctgactcactaggttcatgtttgcattacagctgttgaaaaggatctctctttcaagcaggcaagtgtgccttaagagtaaaggttgcaggccgggcgcggtagcttacgcctgtaatcccagcactttgggaggccgagatgggcagatcacgaggtcaggagatcgagaccatcctggctaacacggtgaaacaccgtctctactaaaactacaaaaaaattagccaggcgtagtggcgggcgtctgtagtcccagctactcgggaggctgaggcaggagaatggcgtgaacccgggaggtggagcttgcagtgagccgagatcgtgccattgcactccagcctgggcaacagagcgagactccgtctcaaaaaaaaaaaaaaaaaaaaaaaaaaggttgctaggcaacaggcatcattatttcagctcctcaaagctggtgttcagcagtgcagcatctcctcctttccctccccaccgtactcttaagtaagttcttttgattatacctaaaattcagtacaaacaaacacctatgggcaattatagaatcagagacttagtatgattctttttaaagactctacactgtgatctaatagatggtgacctactaagtcctggaaactggggtgtttcacacattttgattctgtataagtagcaaagaatgttgcattgtctgggcacattcagctggcttaggtagaagaggagcattagactttataaggtatggtttcattattcccccagaaagtttagttctttactagagattcaatccaactccctcacccccaggagcagggtgtaataggtctgtaatgtgtattagtaaaattgaaccagcccgtgaacatatcttaatcttttccaaggttcattttaacatactatactgtgtgagtctcgctctcttgcccaggttggagtgcaatggtgcgatctcagctcactgcaacctccacttcctgggttcctgcgattcttgtgcttcagtctcctgagcagcaggaactacaggcatgctactgcacccagctaattttttattttattttttttagtagagatggggtttcaccatgttgtccaggctggtcttgaactcttggcctcaagtgactcaaccacctcggcctcccaaagtgctgggattacaggcatgcactaccacgcctggccaatatattgcttattttgaaaaagctaaaggggatatggtatgtacgacatcaaaaaaaataagcagaaacaaagtgggaggaagttggtggagggtgtactgggtgcttatttcacatcatagccttgagcaacttcaggtgttttatgaggcataccagttccatcatggtggggcaggagaggtagttaagcagtctaggaaataattggcaatcaaagaggctgaaggagagaagttatggaataacttctgattctgtatgtggtagaacatgtccacaaattctttgaccttcccatcaaatgatagtctaattcccctctctttgaataaaggcccaccttagtgactcattcttagtatttattattttggataaggctaggttagaaaagacaatacagcttttgcccacctcttcctcttaggatgcttactcttggaattcagccaccatgttctgaggaagccctgactacatgaggaaaccacatgtaggcattatagctaaggcctcagctgagagctcattcaacagccag

SEQ ID NO: 15210 - DNA, 5828 bp, Human
ggtatgaggaagaaaaatgagtcaagaatcattcctaagtttctgatatgattaactatacttacacataattttacccacctgaaaaataatttaaaccaatatacaccatcaaaaccacaactgaagcaatccacacaattgaattaatatactctaaacactgcttttaaactaagaattaactgtgtaaaagttgtacataaaaatagaacagcatttttgtagaagaaaaagatgaaggcatcagttttcatttgaaatctgcagtgagctcaattttggatttgagatcactgctactgttccctatggaaacagtaaaagcatggtttctatgaaccatctgttgagatgctgaagtgcttctacagaacactgccttctaaaggtttatcactataatggagttttgccatttaaaaaattataactcatgtataaaaggctgcatatttttggtaatcaacttctagttcagcaaccttgctttccatgtttctatcttcacagttaggaattatcagtgagattttttttaaggactttaaatagtagtaacacatttattgtagatttgctgagtactaaatactttacactgtgcaagtaccttacatgacaacctcatttaatcttaacaaccttattatgtagttattatccccacttgtagttattatccccataaatgggttaacaagtgagaaaattgatatacaaagagctaatatgtggcagggccaaagatttgaacccagaaaggtctgacctcaatccctggactcttcagagatccacctctaaacctcacaaatattcctgcttattagaaaatgtgcaactgatcctctgattttaaatgaatacatgctttacatgtaataaccaagtttctaaattatgtttatttaaaacttcacaaaaccttatcattaaaatgttcaagctttcaatttgcctcaaagagattcttgcaaattagccaggtgtggtggcgggcacctgtaatcccagctactcgggaggctgaggcaggagaatcacttgaacccaggaggcagaggttgcagtgagccaagatggtgccactgcactctagcctgggcaacaaagtgagactctgcctcaaaaaaaaaaaaaaaaaaaaaaaagagagattcttcaaagcaggtaacttaatgagcaagaattataagtagactattagagctttcattaacatatgtatatgcatgtgtataacaggatgctgcattacagaacctgtatcatcagaggcatggcatggccgattatagacactgaggacctgaaaatgtacggagggtttaatacattaagttgcacaactgataaactatcaatgatgcttgtgataggacacatagcactgtgttaggaaccacaactcagatgatctatatggaaacaatgcttccatggcttccacatagaacgtggaaaccatgttgtatgatggaaatggatgagtaggcatatacttaaatttttcatgctgaattacatggcatattgtatgcatgcatcgtttgccaacaactatacagttattaacccaaaatcgtaaacgaacaaaacatttctccacagtttaacagaaactcacagtttaaaagttaattttcttccttcaacaacaaagaaaacctagaaactgaaagtctccagtaaagttcttttattcggatttaacctaaaatagttcgcttgatctctctttgatagagaaatgaaatctccagttctatagactataatggaaaagtattgaatttgcatatttccaataaaagatatttgcttcatgctttgggcatctatcatagttgcccaaaagactatgtccagtaaacataactgtcacagtactgaagcgcaaacttacaaaattgtctttgtgttaccacaacacacacagtctttagtcagctgactattcatgttgtttgaaaagcatgaaaatacaggtttttagcatgcacacccagttggaaaaggacttgctcctccggaaacaccattcattcgctttggcagagctgagagcacctgtgcatgtgaacaagcaggtgggtatctcactggtttctgcagtcatcactttccttgataggtaagttttgataccagccaggggagagtccaggcatttaactcagcttatgatttaattttccacagctaagagaacaaaatcaccaaaataagttagttctaggaaaaccaggtgggatttataggtacacttacatgactataaactaagaatcctttataaaagaagaaaatgtatcaagtctggcaatagcaaccatagaacatcatagagaaaaaacatttaaaacttccaggatcaaaaataatacaatgcagttcatgtactggttttcattcattctacatctgtacattccccaggatcagagtaagaccattacccagctcaggctattaaactgatatgaaattcaaacttgattttttttgttccattcaagagcactgtctgttatatttgtgtaaaatgagaaaactgaagctgaaaagcctgtggaccaccaatcaaaatgcctatttctttacctcaagagttatttgcatgctagaaacacacacacacacacacacacacacacacgtgtgaagaacacagatttctgtacatagtaatttttaagactaggatgctacagagtggtggtgatacttactcttatattaaatcctagaagatcacttataacacctgagacagcagaaaggataactactcttgtgatattgtagattaagggattcattgtcagtccatagagtctaaatggtgtgtccagctcctacaaaaaacatcaaagaattgaaatgagatacatgttttctcatagctactcagtgacttcttgctgtgttttgtcttgggtatagatgaatgcttaaggctgtctttccttaatattcaaagagctaccttcaaaaaatccataacgtgttctcacctacttttctactaactaagatttttttaggtggatttgagcaatatgtcatttgtagttttatatatatacacacacacacacacacacacacacacacacacatacacacatatataaaatatgacagacatcagcaatcatcagaacctgggtaacaaaattggaaattttttcacagtagttattaacccaaaaccatcaggtcagcattttgaatctacacagcctagcatctatctcttactgggttctgagaagtaaaacattaattaatgtatttaaaacaggttaactcactttatttttctggtataaaaccaccacatggtggccatagctagagcttgggtcctctacatggagagtctggtatgggtctttaggccatggtcactaaattcctgatagggagacttggtgaacatgtctcttaccagaggttgggggtgaaatagctgtaggtcttggagatggcatcaaaggtgcccttggcaaaattggccagggtagcagcgcagtccccagtcaaagtgcagcagtggtgggtaaccaccatcagcagcaggttcctgggcacaggggccaagacagtaccaacgcccctggaggcagggatgaggccaccagcacagagatgcaggctgccagtcaccttgcaagggtaggtagtgtgagtgtgaggcttgctaatcttgttcccccagtagtctcctcacacagggaggataaagagcttgaccatgattatagccccatggatggtgctggctacctccttggagcactaacacccagaccaacatagccgttgtagtcctcaatggtgacaaatgccttgaacctggtccttgatgcacagagaagaggcagatctcctccagggacttgatcttcatgtccttgaccagatggcccaacttggtgatggggagccactctttgtccttaatcttgcctccaggagctctgtgacctcagctctggtcctaaccaccactgtgacccctacccctgatgccactgtggaagagtccacttccaggacccctcccaacccaaggtatcatctgccatttaatgttttcttagagaaaagactgatttaactcaaatgatagtaaaagtgtatcatagcctatgacttactttcaacaacttggtggacagctttaatacattgtttactagagtaagctgttctttcttatttggctttttttccatcttaagatataaattaatctaagggaaggaatagaaattaaggtaaatttcttggaaaaaaatatatatactgcataaaatctggcatatttcaaaggtcatgttttcaagtaaaataaattttgaaattccaatagctatcgctacagagaacatatgtcatgtgctctagcccccattcctgatcagtctccctctggcaaagaaaaactatttagtgatgaaaaattaatgatgaagcaatttaaatatcaaaacaatgaaaaattttaatattacttgcaacataacataattagcacgtaagcaccttgagttcaaaacctctatcttattcatctcactatccccctagataatctaacatcctcattaaacatttatggaacagaagaagatagctccttttactttactaattccttatattttgccttgtaggaagaattctccattacgattctaagacaaaaaaaaaacagaaacgaatgataaatgtttttattcaaagtttatggaaaaacttgaaattaaaaacaaaattaaaaaaactttatactactctgtatttacaagagatatttctcaatcttagtgtctattcacatactgaaaaccaagtatcttccaaacactgaataatgtattctatgtctaatacagaagaattcaagaagcttattatacatgctaaatgacaagtactctaaagatctaatacttgacatagaatatgagattaaaagcatgctccattaccaccaataaaaatctctccatagtatacaaagtcttttcaatccattagatcttaattctcacagagcaggaggagatattacatccattttattagggataagcaactacagagcagcaaactgacttgtgaggtcctgtagctagaaagtgacagctagacagtgattaaaccctgaatcctctgcaggaaccttacagcgtattacgctacccctaaccactaaacccaattgacaggactgatcaatacctgttctgtaagtaatattgaaacattgctgtatttcttattggtttcagaccccagtgaggccagacgcaataaaaaaagtagtaaagctgtttcccagatcaaaaactcccagttataagcatcattcaggaaagttttatgtccttggagaacctatacaaaggatcaaaaaaaagttaagtttttcatttaccttaaaatcatgtaattactcttttactctgtcaatttaagaacatttccaaaaatccaatattttaatactgaaagcagaagagctttaatactcattaactattacctatttatttaatcactatatatttctctaagttttctagattttctcctttagcaagggtctagaagtaacaaagaaggaaaataccacaaataaaataagacaaatgcatttgcagctactttaactatcagtgtgtccactcacaactatatggcaaccattattcaaagtaataactttgctttatgtcaagtgagctccctaaaacatgtggctcattccactggtatgactagaaaatcctaaggatcagttctttatt

SEQ ID NO: 15211 - DNA, 6920 bp, Human
tttaaaagtcgatttctttttccatttattattattatattttttgtctcaaaaatgactcaatcatccttgcaagaccgtgctggaaaatccgtgccactgtcgaaaactggaacaaaataaaagttaaaagcacacacatcaccggccgggcccagacgcgggtggatcacgaggtcaggagttcgagaccagcctgaccaacacggtgaaaccccattgctactaaaaatacaaaaatgagccgggcgcggtggtgcaggtgactgtcatcccagctactcgggaggctgaggcaggagagtcgcttgaacccgggaggcggaggtcgcggtgagccgagatcgcgcccctgcactcctccggcctgggcgacagagcgagactcagtctcaaaaaaaaaaataaattaattaattaaagaaagtggagaattagcagctctgacttgattcaaatcagggctttttcctctgttttttttgccaccttctggggggacgttggctgagaagcggggaggtaggtttcagtaaaggaaggggatgggatacaagcaaaagtcaatggtacctcccgatctaaggctggggggcaacactgggtacccaccctggaaatgcacggagcagaacaacactctgtgttcagccacggccgactcaggattttttttttttttttttttttccaataagcctgtcctcaggggagaggttgagaatttttttttttttaacacttgaatacaaatatttataagtttatttatatctcagttttacaagatgtacattcatactacggggcgtcacaaaaatacagtctgttgctgcaactcaacattgagattattgaacgttaggagaatgagggcgtcaccagagaaactcagggtggttttttttggtttttttttctgtttgtttgtttgttttttttctacccctcaccgcctgccgacaataacagagggatagaaatgtgaagactgttggtttgggaaacggtgtgtgatttgttttcatctgaagcaatccctgaaaatatctgtagatgtatttgtaacccggacgcgggggccgctatgtcgtcaatgggggagggaaaaagaaaaagcaacagttttcagaaatataaaaataaatgcaacgcgatgtcaaatttacactcgacataattaaaatagtacatatttatgaacgtccgaccaaggaaaaaaaaataaataacaaatgcacatacatcacaaagtaagaagcaggggcttttgcctccttcccacgggacctgcacgtacaatgggctgaactcgtgaagccacatcccctttcaataaatagcacatttcatagctttgaaacgggatattgtctacattccttaaccggcttctcattaaatatcaaatttcaataaaacatttataaatggcatcaacttacccacgtgtgtcgaagaatatcagcatatactcgctaagctaattctctttaataaattaggcaccagttttttttttttttttttttttttttttaatgtcaaacgtgtccaccgaaagcctctctcctccccagacctcccaaagctggaggagacaagcggcttccagcaaagtgcctccgaaatgtgtgtcgtgggagtggctgccgtgtgccatcctcgctatgtccccgggaaaactgtggagctaaagggagctggaggcttctgcttgttcttaggggaaaacaaatgttagaaaggtcagcatgaaacccagaggcgaggacagaggactctggtatttccctttcatcctgaccagagcttggcaccaaaacctgaaacccgtctcggcttcatttcggttaaacgcccagctgtccccagactctgcggtatccacagatgctcccacgtgctgacgtggccaaggacagcagcaagaccagaacagaaactcaggcttccaaggaaatgggaccatttcgggggcctggctggactttggcgggatggagaggccattcctacgacagggcgtctttggagcggcccaaaggcctccttcccgtacgggagacaccaagcccgtcgcaccaccagctttgtaagtggaaaaacgggtgttggacgcggtcagttacgctctaaatcgtacagaggcacagaatctgtcccatctctttatccacggcgctggagaagacagccacagccaaggggccctgtcaccactgcctgtgaaacaacaccccaacggccaccagagaaggtgcatttttctaactcttggcaattgccaggaacacacctttgcaaagtatgcaccagtcagagactcgaacggagaaagaaaatctaatagcaacatccgatacatccaattccttctccctgtgggtgcttcgcagtcagagagagagaaaagagagagaaaagtggatatgtcagaaacagatttcaccagaacagccactcaaaggaagaagtgttttttgctcaactgcggcgactgacaaccctccacggactatttggccaagttttggggagaggagggaagaaaatacgtatcaatcaggacccaacccagcatcgttcagttcggccagcaacgtgttcctatcagtgtgctggagctggtacggatctcacacaccaaatcctctctctgcaacggcgttacaacggaacacagcccacgttgctctctgggtggtattccttgctctgcgagcgagctcaccgggaagccacagggaaagcaggaacgtgactttcaaaagaaccttgttttgagcaaaaagcaccaagaatcgccagcgtacacccaccccataaattcaatttctcacctcctgtggagagacgtatgttgtttccatgctgaatgttcacgcaaacgtgtctctggagggccttccgggaaaccaaacccacgcacatcacatacagagggtccccatcagcccagtccttcctaaacatctcagaaaaagagagaggaggccgggcgcggtgcctcaccccgtaatcccagcactctgggaggctgaggcgggtggatcatgtgaggtcaggagttcaagaccagcctggccaacatggcgaaacccagtctctactaaaaaatacaaaaattatccgggaatggtggtgggtgcctgtcatcccagctacttgggaggctgaggcaggagaatttcttgaagccaggaggtagaggatgcagtgagctgggattgcaccactgcactccagcctgggtgacagagtgagacttcatcgaagaaagaaagaagaaagaaaaagaaagaaagaaaaagaaagaaagaaacaaaaaaggaaaagagaaagaaaaagagagaaagataaaaaggaaagaaacagaaagaaagaaaagaaagaaagagagaaagaaagaaaaagaaagaaaggaaggaaggaaggaaggaaggagaagggagagagaagagggcgttggtggtgagaactggtcacagcccaagctgaatttcttacttccttccatccgagagtttcagggagaaagaagcagctagcatacacgtaccccacactcattcagggatcactcatccacctacagaaagtcacccaacttctctcgcaggagaaaagccaaaggcagccagtgtccacagacactcgtgtcccaccctcacagttctctgcgtttgatctgcttcggggacccatttgtgaggatgacacttggccctctttccatattaaatcaaactgaaaccgtccccgcacagttgagagtcagtaactcccttttaaaagttcagattcaggccaggtgcggtggctcacgcctgtaatcccagcactttgcgagggacaaagcgggcaggtcaacctgaggtcaggagtttgaggccagccgggccaacacggcaaaaaactgtctccaccaaaaatgcaaaaaaattacccaggcctggtggcaggtgcctgtaatcccagctactcgggaggctgaaaccctgtctctactaaaactaccagaaagttacccaggcctggtggcaggtgcctgtaatcccagctactcaggaggccgaaaccctgtctgtactaaaaataccagaaagttacccaggcctggtggcaggtgcctgtaatcccagctactcgggaggccgaaaccctgtctctactaaaaataccagaaagttacccaggcctggtggcaggtgcctgtaatcccagctactcgggaggctgaaaccctgtctctactaaaaataccagaaagttacccaggcctggtggcaggtgcctgtaatcccagctactcgggaggctgaaaccctgtctctactaaaaataccagaaagttacccaggcctggtggcaggtgcctgtaatcccagctactcgggaggctgaaaccctgtctctactaaaaataccagaaagttacccaggcctggtggcaggtgcctgtaatcccagctactcgggaggctgaggcaggagaatggcttgaacccgggaggcggaggttgcggtgagccgagattgtgccactgcactccagcctgggggacaagattgaaattccgtctctaaagagaaacgttcagattctacagggaccaggtagatgtctttctactcacgtggagtgagctttttcttgggaggaaatgatgacacactgttatgtttcgatttttcaaaattactcagcctttttggttaaaaaaaaaaaaatctagggctgtacatatcttaccaaccacttttccaaagggttacatactctgatgaatgaacctacttcccaaagattcaaaatgcaattcttcttttcgataaaaatttcagcttaactattaaagcctctctctctcttttttttttttaatttccagcttttaagaaaaatggatgaatgaggcaaactctctaataccgttaatgtctgggattctttctctctctctccgtcattttacagcggttgtaacattttgacataaaaaatgttgaaggggacttttggtttgtataaagaatatcagaagatacaaatgagacgggtccaaatggatctacagttcagctcagtgacaagatagaaagtgttatgcggaagaaaaaaagaagttgtttttttttttcttttatccccacctcagggagaagtatctaaatcagaagttaggaaagaaaaccaccaagcttgaatccagaaagatgcaaatgtgttatggaaataagagagttgaccagtggatgttagtaaatgttgggagaagatagtttctctctgggcaggctgtggtaactaatgccaatcatgcagatggatcttctcggaggtcaccaaaccccttgctgtgttcccagaaaaccaatcagaacatggaacgtggatctcccgaaatctgggggcagaacccttgaatgtttttggttaggtcatttcaagcaactgtccagcccatgccagctgtgacgacaagttgctatctgctgtttataaaactgggggcacgttgggaggccgaggcgggcagatcacctgaggtcaggagttcgagacgagcctggccaacacggtgaaaccccgtctctactataaatacaaaaaattagccgggggtggtggcaggtgcctgtagtcccagctactcgggaggctgaggcaggagcatcgcttgaacccgggaggcggaggtggcagtgagctgacattgcgccactgcactccagcctgggcgacaaagcaagtctctgtctcaaaaataaaaaacaaagaaataaaagaactgggggaacgcagaagatggagtaggggagaaagaaaagctggaaccacctacatctgcaaaaacttgaaaactctctggatctctccctggcttttacgcttcccaaccagaaacagctcaggtaccaaactgatatcttggcaccaccgtgccctcttttatccccttcagaaacacaaccacactcccagcgcgcccagggccatctctacacccgtgatttttgcaaagggccctcagtggccaggcggccagcgctgggagaagaggtaacgccttttccacgttggacgctgacggggtcaagagtgcacggctattttttttttaatctataatatttataatattgcacttcactccatgtcagtaaagttaatgctgcatatcagtatgacaccttgcaaccacgcgtccgtctcttatgcaagtcttttgcgtctgaatcctgtaacacagcaaaaaaaaaaaaaaaaaaaaataccaatccaaaacaaaaccagacccaatttgggaatcaaacactggaaaagttataaagtcggtcctcattcaggtccccggaacgtgggagtcccaacgtgggaggttcgggtctccctcccctccctttccaaagcccgcggttcacgtcctcagcctcagccagagaactatttccttattgctgcctgggaggctccgggggagcggtggaggagagcccggcccctgcctcctgggattccgaagtccacattcaaatccacacccgttccgcagcctctcgggatgaaggaaggagcatggtagtaaagaaaatcgttggcaacgaagaaatggcattttcatcggagaccagctccgggatctttgcagtttcaatagactctaaggatcttccaaacgtgtgtagttaaccgcatgcatagggtatagcagaggaagacgcagccaggcgggggtttacccttctccagggtcccaggacgcacgggcagccttggagaggcccgggctggacgcacggccgctcacccgctccgccttctgcaccatctccgcgagggtctggctgggtcgtgcgtggacggtcccgggagcctccctcctcaggcctcttgcaggagctcccggggtgcc

SEQ ID NO: 15212 - DNA, 64377 bp, Human
gggacaggaatgttctgataacttgctggatttgtcctctaagaaattttgcccaaaaaggggataggaaagggagagggttcattgcttgggcagaaaagatgtgcacaggcaagaatgattgcatgagagtcaatggctattggtacgtatcagaaccttagattgggtagaatctctaaggttgtcagagctgtttgaaatgagggcgtattagattcaccctggagcattgcctccctggtgggagggaatcctgggtggacaaagagagtttctgctgtggctgccacactccacacctcccctgcagcaggacacaatccagggcagcaaactggcccatggggtccggaggacctatgccaagatccatttccatcccaacacccttggattgtctctctctgggagggactgccagagaagttagggatctggagctttgaaaaccacagagatatttaaaattacaattttagagaaagatttaaaatgatgaagcaccaactatttttgtttacagcccctctttgcaaatgtggaggaaacatgtagggatacacatcttcttctctcttttttcacaagatgattcatttctcctaaattgagaaatgagaaagactgggtggaaggaggttgtggattgacatgaaagagaaaacttttttaattcagaaaaatagttcatgtgttttcacacacgtgtacatatgtgcatacacacacacacacacacacacacacacacatccaatccccctgaatatcccagtttcccctgcaccttccttgcccccctcccactggcttcttagcctcctgtcccagaacaaccccaccaggcctgcagagccatcactgaaaagggcatggctgtcctctagactgtaatcctgagtccagaggtctggccaaagattggaggagcatccaggccttgacccccaggcctgccagtgttccaggacatttgctcactcatacccactcacaatcttacgtgtaccccggttccccgactgagagaactatgaggaaggagggggcagcttttgccatcactaaggtaaagaggtgccaggcagctctgctcggtcccagggctcaccaaccctgccatcattcccaccagtggaccccttcttaaccacacccaggcccccatattgctgaggctattgattcctacagaccaggccagaggtcagctcagtcctgttcctttctaaggcctttccacacagagatgaagtctaggccctcaatgcccttcccctgaactcttcttccaagttcaaaatcctcaaggagcaagaaagagggcaggtggctgcgtgtgtgttccagaggagagaggcgaggagttgctgtggaatgggttatgtgacaattttgttagcctgacaatgcaagggtgtgaacgctatctgtgtagaacagagggaatggcttcaggtgctgctcaggattcttccctggaagaggtcatagctgtggtgagaaggtaatagcatcttgcctacagccccgaaagcaggctctacctaaagaatcaggcataaaacagaagttccctccttccttttacaaaagaaaaggctgcttcctggtgagcaaaccaggggagacagggggcaaggagggcatcctacagagaccatccctctcacttctggtggtcagtgacccaggaggacccagagaacctcatcctcaggctcctaggcctctgttccccactcctccaatatttccaggcctgctgagttagggctcagctgcctccctcttccctccgctggaaacagaagctcccagcgaatgtttctaactcctgagtccactcagccatgtcccccttgcaaaatcctccccttcccgcacccccctgcacccagccagccaatccgcggcctacgagcctcgccagacccatctcccagggcctcagcgggataaaaccggtcggtgatgccgggtggatgggaacaaacttcagaaggaggagagacaccgggcccagggcaccctcgcgggcggacccaagcagtgagggcctgcagccggccggccaggtatgtcacccaggggttagctggaagctggctagcagtgaggacgggggatggaagaaaggagagggtcccaggatgcctggcagccttttccctcccaagttaaacgggataagactgggacagcggagggagtgggcacggaggttggagtctggagcttcttcagcgcactcccaatccttgatcctcccgggaagcctgttagctaggctaggctgaggttggccctacttcgcctaaaaatcctcctactcctggcagacgatgcaggtgtaaaggatgaggcctggggagggggcctgaggatgcaggcatcgaatctcatcgcatctcatgcccttctcctgggtttgtgcagggcagcggcaggcgcggcccggacctacgggaggaagccccgagccctcggcgggctgcgagcgactccccggcgatgcctcacaactccatcagatctggtaagaacgcggtgtggtcaggatccccgagcccccgcgccgctgagcgtccgtgcgtgcgctcgggtggttggatctcgagagcgtcagcacgggattcgcgggacccacccgcgtggggacccagctggggcgcctggggcctggccctccgctggagccgcctcgctgttctcgggcactggggttccacccggccagctgagccgcccttgcccggtttcgagggaccacatggatcggtgaggggatctctgtggagttagagggggtttcctttgagctccattcccagccttgcatggcgcattagtgtggacattcttcgtgctctgtccctgggctgcaccggtgctggacttgccgtttccccgtccccgacctctaagtcctcttcctcgggtgcgcgcagtccttcccagtgactcccctggctggactgtgagctccccgcatctctcaagccaacggcaatggagccggtggtcccgggcccgggagccggcagcgcactcaggtgctctccgactcctcctggcccagcaccgggcaggccgggcgccgcgcgcggggcgtccggctggtgaggactaagccgctcgcggagtcaaaaccccctccccacctgcgcccggaagcagggccttcaaacacactcgagctcccaggccgcgatgcctgttttcccccttcccggccagggctgggcagggtctttgctgggaaggagctccagggtcagggctggtgggtgcagccgtcccggcgcgcagcgagtgcggacagcggcggaggcgcagcgcggcccgcagtgatggatggagcccggccggccgcagagaaggcgatttatggggccagggcgcatcgctatcgatttgggccggcgaagtgagaggaaatcaatatttcagaatgaattctccgcgaatatgatgtcccgctctgcaaacgggacatttgttataataaggagggtcggatcgggcgcgcagcgaggctgagatctctatttagccaagcgcactgcgggggcccgggctctgcggcgcagtctccagtcccagggccatggcccaactaggaggggagcgggaaccccctggggcgccggaagatttctcactcgggttctctctagagctgcagacgaatgctccctcccggcccccattcccctcagagacctgggccagaatcgtccggctgcccccagaaggcgcggggtcccttcaaggtcctcaggggagagacctcgcagccattccccggcgcggcggggttggggagccctgggaccgagcagagctccctggcacctctttacggtccgcgtcctggaaccacgagcgctcctaggccactatctaaggtcaggatcaggttttagtcccttaatctttagccaaaccgtggtacgataccagacatcgccaggaccatccctgaggcctaatgtgcagtgcccggtgcccatgccaagctggtgcaatggcacttctgcgccaagctggtgcaatggcacttctgctcggctctggaggtccatctttcctcctaaccttcccctgacccttccggcggtggcaggaggagtgagtgctctcggaaatcaaattcactgtggccgggctggacccttactctctgccgctgcccaagaaatgagacgatgtccccgtccctcagatgagcttttttttttttcgcggctacttattttcattctagaagtactcgttagaatagatggaaatagattatggaaagaataaataaaggcacaatttatttttactgtagttttaatcaggaacagtcccagatgatgagatgcgcgctttcccactagcttggatgcaaatcgcgcttgggttttgggagggagccctctgcccctggacctaccaggtaatttttttcccctttcttcttttcgggaagacagaggggcttcttctaccctctttccaaaacaaatagacaaagtggcgagggagggaagatgagactttcttctcatagtttaatttaaacgctaataaaacaagaaaatggcctataaccgcatagactgctgaaggcgctccctgtttcttttctgaaccctccctcggcaaacctgagggagaggccgtctgtctttctgatcagcttacctgacactgttgtctataaccggagctaaactcataagcggacccctctggtttttacaagcccattatctctcgggttttagcaggttcccccttttccccaggcacctctgttcctgagaccggccgtgcttagggagctccccttgagttttctgtgagcagagcccgggacgcaggcggccacacggctttccgcgggagcgaggccgagcgcacccttcccaataaccggggacgctcgagaaaacctccccgcgcggcctccgccgcccagcctgccacggggtcgcctcgtcgttggctggtcttgccttgcagagagtcttaacgttgtctttcctacagctttattctgcaggaatgttgaacgcgaatcattttaacgtgcgcaggtcagcgatgggctgaacgttccttaaaatcgctatttttgttgcatcagggacgaaattctctaaagcaaaaacatttttaaaaaaattcaaagatgcagaagaaacgataaatgccccatatatataaaagtgaaaacaatactgtaccaatgaggaagagagttttgtaaaagcaagcaggctggctgtcattaaaagttatcttaaataacttgtcgcagcccactcccaccagtcccgaaaatagttcattcaagtggtaaaataagacaaggcagaggacgatgtctctaacttccctgatgtgagatctaaagccccattcctaactcttggttttagaattgaggaaagtggaataaatgcatttggaaaggatctgttttcttcccaggtttcctgcctgggttgaaaataaggtttcaggggatggaagcaactttgaggaacataaagaggtattggggttcatcaattcatctttgtttcaagatggttcccccccaccctccacaatgcaagttaattaggagataatttagctaccttgtgaattagttttaagataagtatctttttaagctttgtcactttaattgccccactgattgataagaagtaattatttctaattgacacttttttgatgtctattggaagcatttatttggaactttttgggggtggaaggaaagttaattaattttatcagtctacccccaaaaggactctgcctaattttgttgaagaagacaaaggaagtgaaggaaaccaaataaaaaatcaatctcatggaattttaattattaagggacactttggtttaaattagagggcatctactaatataatacgtcaaaacgttctatttatggcctcaaatctctaatttattgagatgcattttataggtattcattttcctatggatacactcaacggccctttatatgcttccttcattttggagcaggttcctctgctgtgtaaataatttttgtgaaaagtaaaatctgtcaaacttggtatgcccagaaaaaatgaaatcatttttgtaagagccaattgtaagaaagatttactaatagtcatccttgttctgtaattattgatggagttgggtataaaggtgaaactttacttacagtgacttgccttttcatacctaaaccttggagtaaacagtttaatcattcacatcctccagaacattttgctgtgagagagaaaggagtgaaagaataaggagaaaaagaaagacactgaaaggaggcaatgggggtggaaaggaaagaaagggagaaggtagctggagagaataaaatgaaagcattcatttcagaaatgaagatagccaggtgcatggaacctttgccattcaatataagaaaattgaaatcctgctttcaaaatacatttttgttaacaccaaatctctaccacagtctctaagcaacccctaaccaccaagggatacccccagttttctaccccttaaaaaaaaagaggagaattttaggaagctggctgatccggatcttggatatctggctgtcaaagtctttatttggggtccatgaaaaggaagtaagaaaacgcacattgtgctctgggatttataaagagattcgagtgttgtttatgtttattttattattaaagcccctgtgatcttcatctccattttgtatgcacaatcttttcacagatcgacttgtgacttattgatataggaaagcattcccacattaacccaaagtagagacacacacacacgcacacacacgcacgtctggaatgagagaaacacaatcacacaggacgcgttcctgtcaggttaatttcagccagtgcctttttcaaccatttattgtaaaatcttgcctgcttttattgatgtttctccctgattatgtggagctgcaagaatgaggaaatattttaaatgaaaaataaatttaagacgtacaaacatcagataatatcacataccaacctcactattagtgaaattgaaagagtatataaataatgcaaaaaaaaatcagcaagggagagtttagtaatggaaaattccctgcaattaaatgaaacagtaatttagtgaagatatgcctcaatgaattagcatttattaattggttctcataaaaacaatttgtgtgtgtgacttggggagggggatgtttaaagtatatattgtccagagataaagttcctcaaatattcatatcaaattatgtcgttatcacattctattttgtgagaaatcccaagtctctcactggcaagttacacctgtacacagagagcttgaatgcaaaggaaaggattcccatctagatcaaagagtaaagctggttcccacttctcttggtacatttccaaatgtgaaacgaatgagggacacactggcagagtcttctatgcttaggaacatccaaaccgggccgcaagaagactccctgaggacccagctcttctggggcacagctagctaagccagagctaagccagggctggtttgtggttctggtcccccagcctgctccagcatcctctccggctcaggcaggaactgcagtttgtaatctcagcgaggagcttgctagggttgactggtgcatggatgtgtttactttctctcgccacagttggtctgtcttcagttctaagcattttaaagctgctctatttatcagtccaagaagtgctgagttctccgttgagctgagaagctttgagctctatggttctgagtacacgagaagccaaaagataaaagaaactgtttcatttaagaaaaaaaatgttttaaaaagtgggggcaggggaatgaatgagcccaccttcaagactgcagattagttttgcttttgttttagttgaaaacttggtgcactgccccccttcgggtcctcattctcttcagagatagaatttagtattgaaaacaccctctaagagaggagaatatgccctcacgttatcttctcttagagggtgtagagttctttgcgggagggattctttccaaatgcagattggaacaccttcttcgcccaggttcttctggggagggagctaacacattctgcctaggaaatgcaggcaatgactactttcagcaggagttctagacattcctttcgtggggaaggagtacagagcatgacaatccaggagtctcttggctcctgaaaactccactctgccacaccaatcctagttcatccagtcagtggtcagtgaccctgggatggatggaatctctgcagtgaggtggagtaggaagaagcatccactcgtctttgtttatctacagtaatgacacttttaaatggatcttgaggattcataattatttccttaggtccagagttagggctgacaagactgtttgggttgctgaaagcccctctagaccccttcgttggccagatagaaatacaatgagcaaatttctcttatataagccactggccagaaaaatattcataggaaggcttctgtcttaaacctgtaattcatgtaactgagtctgggctttaccttgcttggctggtgggggtccttccccaggaatgagtctcgatagaaaccagcatctgtttactgaggcatgtctaagatcaaggggaagaaagtccaagagtccccgaaggatacttgggttctgtttctgtgtttcttcccgtggaccctccatagtcctgaatgccatataagatgccagcaatccctgtggctcagccaagccagcctcacagctcctcctgctctgcccatgtcacatttacatccaaagaaaaagaacgtctgcacaagagctgagcatacctggcacttagtgagctctcaatgaatgaaagctgtgattcttctctctgaggactgccacaggtgtggtgtggtgctgagagcagatgtattcatcatctcatttaattctcacaactctgccaggcaggtattgctacgacatttttatagaagagaggggaaggaactggtgttcaaagaggttgataagactccaattcccctttccactgctccctacctcaaccacccaaagtccagctcatcagaactcggctactagatgatcgacacctggaatcctagtggaaactcccatcagaacccttgataagaaggcccaagtgcccgtgctggcagtgacaggcagagccttccgtctatcagcttgctttcctcatcagtgttccccactctccagtttaattaaaatacacccctttccagtatggttctcagtcttcccatctgtgaaatggagaagtggttcctgcctggatgcctctcctagaagtagctatgagaaggaaggagatgatcagccacttggaaaggcagagggagggaggccttactttcacacatccccccaaggctgccgtgtctccatctgcactggaaaaaaagcagctatcctcaggcaccacaagttgaaggaccctggggaacttacttccctaacttggcatctcccaagcacactcagcctccctgcctaggttcatcttggatgtgatgcgaacagcttcagagtggctggggaggcttccccatgctgttaggggccagcactgggggccccatccacaggcagcatagctaggagtggtggccactggaggtgccggttgttatgtcccaaagcttaggttcatcccctctgccacttcctcaggatccctctcactcaggggcttaaaagcaaggcatttctcttttggagcctctgcagaggttcagttttagaacgttagcttgaaagaaagggattttattttaatgttttcactttttcatgtagaaagtagctgcttagctcccgggctctcagatgaaaacctctctttggtttaagcagagggagagattgagaaagaaaaaataattcattcctccctgcttttaactttttttcgtcatcttcagccacaatactcattggttttgtcttttttatttgtcttcttaaatggccttggggtgacatgggtagttagtgctaattagtccactaggacatattgtgactgtcagggcagcacagcagaagggtccaggagctggttgggtgacgcacctaagagagaaatggcttaatctgctgtcatcggtgtgtactacagtgttcgcgcacacccaggccctctgtgtgttgcagttttgattcttcggcatctccaggaggacagtagaacttattattcttgggataaactcaggggccatgaggtgtcaagagaatgagaggcttttgaaatcagcgtgaagccaggatgaaagcccctgccctgcaggcagaagaagaaggcaaagcccgggcttccatcttggcccagaccttgctgtttttgtgtgaacttagtcaagtcagatgtctctctgggcttgtacttcccctttataaaatatggggatgctgcagggcttctggggagtcatgtgagtaaaacctgtctcctcacctggcacatagctgccactcaagacaattttctgtgctccatgtagtagtcaccaaggagtggagtctccagaacacattcccaaagtcccattgtcgtagtatttcctgtgaaacagccaccagtaacttgcaacccagtacttcgttccatttaaaatttaggacagacttttcaataattcatgtggacaaaataatagatctaccacctaggagtactgggattaaatgaagggacgcatagaaagtgctggctatgacctctgcggctgttatctgctgttaccacagcctgaaatggaaaaggatgccttagttcaccttaccagaaaacccagtcatagggaaaacactaagcttttgatagaatggctgtctgtggactgtgtgttgaaatccagaacattctaagggtttaatagaattggtctttgagcaaaaatgagctcaagtgggtttgcagttatgctgtgtgtgtggctaagacaggactgcaggaagacttgcctggggtacttgtttttaattgacacggaatcatatatttatttttaaaaaattaaatccacgtatcctccaccttctgctttcttctctctccctccctccccacctgcctctgtctcacaattttctactttgggtaataataatccagctttggcctgatagcaaaccctggttgacatttaaaagtctctgtgattagctgagcaccaaatctctgacttaagctttgctttgctcctttgcttcaacactgagcaaggtagaaggcacctctacagggcagggagctggagtcttgctcttccctttcaagaaggcagacccgcagaaccaggaggaagaatgatcagacaaaacaactcagtggtaggaaaaggactgaacactaacaacccattcggcaggagcaccaaagttcatttttcttgaacagtcaccccagcacaactatgttgtggctgttgacaggtaaaccccatctggctttctcgagtctgctcctcattgttccagagccagtgtgctccatgacggtctacactggggctccatctcagggctgctggacagtttgtggcaaaatgtggcagggctgtaggtagaagtgccatggagatacttctgccaaatgaaaatgcttactggacacttccaatgcctaggctccatgccttcacagatatgcaaactttcccctctgtaggccttacatctctttggcagtatgaaaagacctgggtccttcgagccttggggaccttcctgggccccccatattccctggggacatggcagtaccccataccaggaaggtccccatggcccatggcccacccccactgctggccatggggctgtctagacaggtgccccacactgtgacaggcctgcctgggcctcagggctcccccttttgcaggtggcacctgctttcaagggtcctgcttacagtgacatagctgctgtcctgagactctcctttcctcagggcctggctgggggccatgccatgtctgcaaagcacttggtcacgtgctgcccacattccagctgtcctcacccatcccagctccaaagccacctccccatgaagctgtccatgattcctcttcctcttccccacctccccaaggtctcctagcactctgtttgtacggcatgccttgcagtccaatttttggagaaggcttgatctctgtggctcgcagcttccagacttgagttacttgagtacctgggacaatgtatgcctcgcacatctcagaagcttcataggctttcattatgctggtctacctggatccagagttgttcaaggctagagggggctcacagatgagattctgttgccacatcttaccagtgaggaaactgagacccagagaggtatgccccgaccctggtcccacagcccttgtggcagagcagacactccatctcatcaccaggactctttccatgaccctgtggtgacttccagggcatgttgagttagagtgagggctgacccaacccagggagcctttgctgtggcctgtgctgcataagcaggacccaaggaaatgaaggggcctccttcgcctgctgacagggactgggaagcccagtgacagctgctgagacatacagacacacacccatgcacactcacatgcatgcacacacatacacagcatatgtacaacactcacatccaaacatacagacaaccggggggattagggtgaagcaggaaggcactcaaggtgcaaaattccaggaggctctctctctcaggctcacgcaagggcagggttggccctgagagcaagtgcctccttagatcttatagcctggacacctggctgtcctcattctagtcccctgtatccatatgacacacacagtcatacccagttacacacacagaccacagtactcacagacatatacatgcacacatgaatacaatattccccatctcacacacaaaaacatactaaaagtaagcctttaaaatgtagaagtatgtgcagaagactgtcctaggtctgtgggtaatttaaaaagaccagagaaggccctgctttcagagaccctgagaaatgcagctgggaagttacaggtgtgattgatgagtcccggctgtactcacagttgctagaaaggaagtcataatcgatgcactggggaaagtagggtgtaagctatccaggaatctgctctgtgctatgcatctatttaggcatgaggtcactgacatgtgacctccctgttcttgcaacctgtggtttaaggtctgagtagaggaataccagtgtccaaccatgagcccctcctggccactagctcctcactgaagttacgggtcatgggtagtcatggagccctgtagagaccttttggtccagcattcttgttttcacataagatccaggggcagccagtcatttgcctgcatcagcccctagcaccactaggtctctggggttcacagtggctcttcccagatgaggacagagctaccaagtgggcagcagcagtagcggcaggactcatccactcaagaactggcctcaaggtcccccaagaatgaagcactgaaggcaggtggctgccagctagcatgggcaggcctctctgctcagctcaggatattctctctaacattctgtccttgctcagaattcctgggccactctgcgcctgagacccctcagccccaggcagttcaggcatgttctgtctactacactctaaaggagaagtgtgaacacaaaccacagccgcatgcacaacaccgagcttgtttctccacccacatagactgtatttgtcactattatacacaatatggtgccatcatgcatattttgtacatttgatcagccaatatttatataaaactttcataaacactttcaaacagttttaccccacagggtgggcagaggtgcttgtcaatataataaaactgaacaacagtggtagaaaaaggtacacttgtacttatcttcaagtttaagatgtaaattttttctgttcaatggccactacctcatattatttttaggatctgggatcggacttagcaacacattatgactttcaagaagttgagctcactgttttgtggcgttctttgcagaacaccatgaacttccgggtgccccatgtgctgacaagtgtcagaacagctggtgtccagctgacgtgaggctggacttgtgtgataggcacgttgtggccatagctccccactctgtgaaatgatgagatcgacatgcctccatccatcagtaggatccccagcatggagaatttacaccgtcacccttcaaagaaaggagccaagtcctgggcacctcctctcaccttgactttcctacaaaacacccttctttcttggcaccagtatagcacatgtgtattggtcatttaggagcccaggtgccttgtggcagagtaaagacacacacagaaaggctggtcttttcttactcagcatccctggagcacacccagaacatgatgccttccttgagatttcctttaaagaccctgtcacccctgaggtttccatcccagctacctacagaagtcgtgatttcttttgtctttctctcagcttcacagacttcttggtccaccatggggagggcttctattcccagtcatccactgtcctgtggtgaacctctctcctctcctcctggcccatttctctcccaagtgtgtgctcagtctgcaccatgtggccagatcatcttaggttttgatccagctcctaaagaagcactcactgccccttcactctctcactctgacttcccagcacttgggttttgctgcctctgtgtctggagtgctccatgcaaatttctcaccccaaccactggcatgctcagttacctttagtttttatgatgtgtcctcacccatcctctggccacacaaggctcaagatctaactccaaattatttcaaagagcattattactcaactattcaatttagtaagtcaatgtctactaagcccctcagtgtggcaggcagggagttaggctttggggttatggaactcaggagaccatgcctctgccttcgtgctgacattctagagataggaaagcaaactgaactttcaccacaatcacagagagaaagcaaaggcttcagtctagatagacacaaaatgctgagcaagtaggagagggaggcatggtgagctctgaccgggtcagggtgggattccttaaggtggctcagaggagaaaccagccccagcagagatgcagagtcccaggagggtgtgcaggttccaggcaccagcagtcagccctgagggaaggagacagcaatgggaacatggtcagggttcagcccaactgcaggggttgacaagagaagctaagctatggtgttaattccaatgtgccatcagaacgtctgggtaaagtgcactcgatgtatacgttttagggcattttattcacttgtgcatgaaacttccatcctcccctggcttggcctcacgcttctgttgttggcagttttcatatccttcttggctctcttgccacagctgcatacctactgacgctgttgtcttcaggttttgcggtgattttattaagtggaaaagccatggcaataatctgtgatagctaggttattcactttttcaaaatgttctggtttctctcctctcttggctctgtttcagacaaacttagcctggtgattttccaaaataatcagatttctccttgcacttccttttaatccaatcattaacaagccattttcaggcaaactgctgatgtacaatccgagaagactttctcctacctccgtggcctatttcccactatttccgtatgcaaacccatgttccagccagctagtcattgtttccaaaatacaccatgtacattctcacctctgtgtctctgcccattcaatgcagctacctggaacacccttcccactcccactcccttgacaaagcctcagtcaagctccacctccttcccaagacctttttagacaccctttacctttagtgaccatcctgtctgacttcccactgcacctgctccactccctgggtactcagtacttgttccaacaaatgtcacttagcttcttacagtgacaacctgcctctgagctagaaaagaacaagaacccttccagatctctctctatccccagcaccttacacaaaatcctacataaggagtgaggactctacaaatgtctgggctgctggttttcacctaattctccaataacattttttattgcttccttggttgatgcaacttgcacatttgagttttgtacatgaagtttttccaacatgaaatacacctgatcctttcccatgatattgctatattacttttctattttctttataataattggcaatgagggaactgagaaagcaagaaatgcagcctttgagggaacctgatgcagccattcaggccggagctgccccactgggatacctgcctggtcctagaggcatcttgtaggcacagaagcctatgcttgaaggccagatagccaggttgagcagcaatgggcactgggagtaaaaaacactggcaagcctggggagtttgaaccaacaagggaccttcctagtggatgctgggtgtcgacttggcagggtaattggtcagatttagggtgagagcatctgtgaggataaaagattacaagattcctgtaattcctgcagactgggaatacagctccaaacaatatctagcacatagtagacatatactaagtgcttcacaagtatttgtaaaatggatctttcttttcttcttttttcctctccttcttccttacttccttttttttcttcttctttcttggctttagataactgtttctcaagtgtggtctatatcaaaacctcctgggatttttgttagcaaatatggagccctggaatctgtatccttcacaagctcccagggatttttttatgatcagcatttaagaaacactgatctacagcccacccacagtctttcccatgtggagtccctcatgcctgcctgctgggggcacagcccttctttttgcactgtgcctcctcctcccagagatctcccatctggctatgggtagaagcagatcagatttgaatgcagtctcaggtctgcccctaactggctgtgcacatgccatttgagcctccgagatggcatctttatctataaaatggggcaaagtgccagccccacctacctcatgggattgttgtgaaaactaatcctggatgcaaccaagtccaacaactggtgtttgttgaactaaatttaagaatcacttacttgacagtattttggaagggccctgtggatgtcaggtgagtttataaccaacatttagactggatccagggtcagaaagttcttgaaaggaggagaagcctggaggtcctggtaattggagggaatccagcctggcatttggaatatttgctgtgctgatacactgatgttctttcactgaaaaaaaacaaaacaaaacaaaaaaaaacattgccacatgatgcaaggatcacaaatggagaacaagatgatgaacaagatggtagcaagtatagtaatgtcaagagaaacaggttttcaccaaaagagggtaagctattagaaaggattttaccctctacttgactgactgaacctgccttacacttaagagtcatttggagggaactggaggggcagccagttaccctaggagagcagcctccaggggctgcccaagcctgctgtgtgaaattcagggctaaagctctaaaactctgttgatctgtgcatgcgtttgctagcgctgcagtgacaaagtactacaaactggagggcttacataatagaaatttattgtttcacagttctggaagccaaaagtgtcaaatcaaggggtcagaagagttgtttccttctgaggctggaggagaatctgttctgtgcctctctcgtagctcctggtggtttgctagaagtctttggcattccttggcttgtgacagcataactctgatattcatatggctttctcactttatctctgtatccaaatctccccttttcacaaggacttgatcatattggattaggcccaccctaatgacctcaccttaactagatcatctgcaaagaccttgtttccaaggtgctagggtggtgggtggagacaggggagagactattcaattcataacacctaagtattgtgtctccttagtccgtttcagtccccacccagccctgacttgactctcagctgctttgggtctgagcaacaccgctgcagaagctctgatttggagctgacagaaaaagaaggggaaggtgacatccatcctccagaacctttcctattgctccaacagagaaggggactccccctcccaagccagaatcccccaaagagagcctgaagtccaggttcaacacttagaaaaggcgagtcatggtggctcacacctgtaatcccagcactttgggaggctgaggccagaagattgcttgagcccaggagttcaagaccagcctgagcatcatagcaaaatcacctctctacaaaaaataaaaaacacttaagaaaacaaaaaggataagcaaacaagctgatacaagaacctaaaatcggccgggcacagtggctcatgcctgtaattctaacactttgggaggccgaggcaggtggatcacctgaggttgggagttcgagactagcttggccaacatgacgaaaccctgtctgtactaaaaatacaaaaattagctgggcatggtggtgggcggctataatcccagctgcttgggaagctgaaggcaggagaattgcttgaacccgggtggggcggaggttgcagggtttcagtgagccgagatcgcaccacttcactccagcctgagtgaaagagtgaaactctgtctaaaaaaaaaaaaaaacctaaaatctttcagggcatgccttgcttcaggacatgttctgcgcaaacctcactttcttcctccactctaccaacatggccccagccaagaagccactaagctcccaaagggctaagacagggatttaggtcagaacgctgaggttctttcttggttctgccatgaggtgaatctgtgacattagacagctcacctctccttcctggtcaaggatcctctcagaagtgtgccttgcaactctgccactccacagacactgtgcacatcaaccttcatagtctgtaagccgtggcagcccactttgtcaccatgcaagtcatgtggcagcccataggccccactgtgtgctaccttccctcatcttatggcacgcccagtgtcacccctggtgttttgtcacataggaaggttactcaatgtttccctctagagctctctctgtaccagcttctgggggtttctggcctctgttccccggctgagggcagtcccagagttgtagacattaggactggaaggatcatctgcttctgtcaagccagatgaaaaaactgaggcacagactggcatcgtcacagagtgggcagaacctaggcctcctaattctcagcaccccctgtttcctctccagaaactgcagcctgcaggctgcatctgctggcctctgtcccttccccttttcttctgcagcagtgagggcagcttttagagtggataatctccttcgccatggtgcctgctatcgacaggtgtggaaacaacagatgcacggttttgtcacagattttgctcctgtgtgtccctcaaaaaggcggttccccttcatttgttcttacctgttatggtccccaggatggccaggccctccttctgtcccccaccctgaagactctgcaactcacacacacagtcacacacatacacacacacacacacacacaaaacagtcactctctctctctctctaaacgtgccctaattcaggctaacgcccaccctttacaaatgcctcctccatgagctagtcaagcccatcaggttgtatcctagttaagatctcagaagcaaagaatctcggccttcaaaagaaacttagaggtcatttagttcaactgtccgggtgagggaggcatctttatgtgacttcattatattcaatattccctagttcctctggcttctcagtctctgcagtcaccccagctacagctgttatttccttcctattcccccttctccccatcctccctacctacccctactctcatggtttcctgccctcagcaggggttcttctcaccatccctctatttccctccttacccatctctgagtgatttttaaatcagtgcccactaaactcacatttatagtattataactttgagctgtagaacctaccagtactttatgtcctttactatccatccccatccccaacacacacacatactcacacatgagcacacacccccacacccactcattcatacacacattcacacagacacccatatacacacctccacagatattccacggagctacttgtggacagaattgaaggagactgtgcatgtaaatgtgttgaaaatctttaaggttctataatatgtcagggactattaacttgtaagtttctcaagggcaaggactgtcttctactcagaaaccatcaccccacatacacacagcctggaatattattagacacagagtaggtgctcactgaattgaaatctaatgtactgaaaattgctttaatataaacccattaaaaaaaaagcattagtagccacaggcctctgacctcagggggagttgagggtgtagtgcagtaacttgtacagtcgctaagcatctaaacgcgtgttcggcaggtgctgccatacctgccttgcctgtttccctccccaaacgcagagaccctggaccttccttctgcagcccagagggcccttccacagccctggtgtgcgatgccaggagtctgcaagtgtctaggaagctcagtgggaaggatctgggaagaatgacctctagtaaacctgcagggagcactgggaagctccatttgcagcccctgactagaagttcatgtttcatcaattaatgctttcgataagtgtttgttgacatccacagagtagatataaactctaggctatcaacagaggagatttttaaaaatacagattcagggatgctatgccaaaagattctgactgaactgacctgaggcgggaagtttctggactctccaggtgattccagtgtgcagctgggaggaggaaagcactgctctacccactgcaaagcacgcctgcatggtcagatgaaagctgcacctcccctcaaggagccaggtgtctgcgggaagaacttgacaacgagattcaaagagaggacaggggctggggaggtcggtgggaggatggagaaggttctggaaggttgcttctgggaggcttctctccctgggcttctgaaggccagagtgcagggtgtggattagccatacccaaagccacattcacagagggggaagcatcactcctgcaggaaggaaaggaagtgagtcccctgcttgggaaatggtgcccaatctcagagggagaaagtggctcatctgctgttactttatataccttatattgctgatataatttataggatctaagacagcgtgaagagacctccagaaatctctgagacagcaccaaaggcaaccctacccagggaacccttggacttggtgaccttcaggctcagagcagcccatgtgtgtctcacttgcctcaagctctctggcccctgtgctcccaaggtctccagcttggctccaggaaaaggcagggcctcatgtcaagtagtacttttcttaaggagcttagaggtctattgacatttgaagcagctccatccctaaaaatccacacactgaagcccttcttgggagggaggtgacagggttaatctaagggctgggggaggcggagaaaggccttgaaaccacacagtgaagccaaccagattaatagaggaagagagaggggggtagaccattaggaagacaaagagaaaatcatgctggagcaatagaaagggaaatctaatatcaactagggaaaaataaatggagattagggcaaacaaattagctttaatgggttcaatgctaatacaagaataacagcggagctgcgaatgcctttgaggggaagatgggataaagaacctgagcagtcatgcaagcaataaagattatgcagggaagggggatggccaaaagagccagcagggagggagagagaagggaagactccgggcagatgggtaggggagcggtggcattggaggagtctgccatctttgacaggaaaggactgggacagagagctggtaagaactggggaggcagcaatcaggagggaaataaaagaaagcaaggaaactgggagacactgagggcagggatgcaaacccagagccggaaagactgggaagaaaggaggcagcgatggatgtaaacaaagagaatggaggacaaccagccagtacacaagagtaaagggaaataaaggaattaggtgccctctctgactggagaaaatttaaaaaggaaaaattaggccccaagaaaatgaaaagctggagaggacttggaagtgtgttttggaaagcacccatacttggtaggtgacgaaaggacatattcgctcttagggcggggtctggctattcctggaatacagtgctgctgccaggggtggcgccggaggtgggtgggcaaaagtaagcagtgcagagcattcactatggcatctgagagctctcagcttgagtctcagtaatgccactttgtaaaggtggagccttgaacctgttacatgccgaatctgttcctcatcttctcatcaataaaatgataatgtacttcatttctcaaagggttattataagaattaattgaaaagatgcatttaaaatactcagcttggcccaaaaataagcacctcccataatactggctatgattattattcttaggcattgactaatggggaagaggggctgggtactaaagatagctcttcctccctccttcccccacttcctcttcttttaggtccagcattggtgaaatacgagcctagtttgattctctcccagacagagtctaatccaagggaaacctctttatccatcctctatctccctcccctgtccctccccagctccctctcactattggggatgaaataataatgctaagccttccaccacagccaccctctgggctgatctaaggcagaagcatctaaggaagccaaatatcacattcgattggaagaccctcttatatctgcctgagcctcagagtgtagtagacaaggagctggcgttggtcctcatggcctcacatcttaggatcctcctgggatgcattaaagagcatagacaccccaccagggaaacagagccccaaagaccagcacacagcaacaataacaagctaggagtcaatcggtaacagcctagtcatgggcactagaaggggaaagaaggagctgggattatttcctacccctccaggcatcccagaaccctgcccttttatcattactaaggattttagaagagagagaagagaaatcaatccaggcaagaagaggggcagataggggtgggggagctttgccatttgctaataaataagttaattaacttgaaatcattacaaaaagaatcttcccataaaaccataacctccaagagggcagagacccatctttcttcatccccctatgtccccagaacctggaacagtgcctgttatggaaatggtgggtctcagtggtgagggtaatggctaacatttgtggacggtctactgaagcccaggtcctgtgtcaggtgctgcacgtgcaccatgttatttagatcacttggcacacttagaaggaaagacagaaagaagtgacagaaattcatgccaaagtaataagttagtcagaggtgaagcaggggtttctgactctctcctccatatagctttaaggaatggaaataaatgaatacatgaacctcacccactcatcagggcaagaggacagatttgaaagctacctctcagtttgggtgttattctatatatatatatacacacacacacacacacacacacatatatatatatatacacacacatatatattccatatatggaatatgtatatatatatagaataatagaatatatgagggactgataaatgggccacccggcaagtagtagaagtttaaaggatagtggaaggactttcttcttgttgttgtatgtggctcttgtcagccaatacctcagcagcagtagttgaatcagattccagctctcagctctcccagagccagcctcacatgcccccagcaatagctgggatgagccagcccttcggagatccaatccccagctccacaggctcttcctctaaacatgtagctctgataactccagtttcttccctttgattcctccaggctgaggagcagtggttgcttcctgtagctactatctctgggctatttcagtgtttcctttgtgctcttacagccctccaacaccagacaacaattccccatattaaagcccctttgttgaaatacctaggaaggtttctgtcctctgaccaagccctggctgataccagaagagatctgaggaaaccagattttaagactggattgatcatgtccttggccttgaacacagtactgagctccttgacaatgagaactggagaactttttttttttttttttactgattgagccctggcaggcatatgcatgcagcactgcctacacagtcctgagtcagaaacttctcatggggtctctgagtctggaatgtctgagttctcagaaggggtagcatttgctgctaaccctctgcctccctagcttgagctgtctctcgtggttttttcccctgatggatgttaacatcttcccaacagagctatcaacccagtgagggaggagtctgtgtagatcacctcccatcattctccatagagtctctatggcccaggttagaagaaaaagacttcttggctcagactccaaagactagagtcagtgacagtttccttagtggtgtaaaatggcaagagtagcactaatctcacagaagactcctgcagaacacactgccacattcaaccataaagctgctctcaacagtgtgagcctggcaagcactcacgcatttaatgttgacgttgaagatctgatatgtgagccaacaggaagacctctgcattcataccctgactccttcagaagcagggcaaacctcttttttttttggactgtggaatctggaccgtcttctttaaataactcatttctgtgagtatatgtgtctgtggaaaacagaattctgtttaaggcaaagaaggtgtgggcttcactagacttgtagatctgcctccctcctcccctccctcctcccctccctcctccctccctcctcccctccctcctcccctccctcctccctccctcctcccctccctcctcccctccctcctcccctccctccttccctctctccttccctctattcctctgtccctccttccttctttttttcttccttccttctttccttccttccttccttcctccttccctctattcctctctccctccttccttcttttttccttccttccttctttctgtccttccttccttcctccttcccttccttccttccttcttcccttctttcctttgttctttcctttcaataaccaacaggcacttatattctgcttactgagactatgtcctggcttatttaaaagaaaggaccaaagagagcaggcagggaaagccagggaagactttctgtaggagggagcttcctgaaccgactcctaaggcatgaatggaaatcaatctggagaaggtgaggacgggcactccaggcatggaggacacagtcaaggacccaggagaggattcagatgcagcgaaagaatggcaagcaattctgtgttgttagggcatcaggttcaaggctcagacaggtaagaaatgaggcttgaacactaagtcagggtcaggtagtggtaggcattgtctacaagatttagtagcttggactttgccatgaagaaaatgatgccatgccttgcaaggattcttaaatatgggagtgatatggccagactaggatttagatgtgttgctcccgagctgggtagcaaaggttcacttgagcaaggttggatgtggagaccaatgagtccaggtgagtagttaactcctactcaccttccactcaggttacatgtcatttagagacatcttcctaatcagcttgagctcattctctcttgcacccccaccccattacaccctgttgtgttcttcttagcacttattccaagtagtaattacacatttagttctgtatttactttttaaatatatacccatccccagcctacctatccctagcctgaaagcttcatgaaggtagaaatcaattctatgtaatcagttctattaaaatgtttgccacatggtaggcatataaaatacatgtagaatggataaatgaatgcaggaatatttgaatgctggggacagacaggaaggtattggttaggtaaatatttaggaggtaaaacgtggtcttgtgagtattccatatgcagagaatggaaaaagataaaggctattagttgattcatgtgacatgtttactgaacacctaatataatttaataatgatcaaaacgaaagaagtcttcccctcatggagctttctatctggtgatagaagacagttatgattcatacatatatagttatgcaaaaaatgtaaaattaaaatttggacctaaagatgcaattaaatttatctatgatacctccccagtccccccaaaattcctcccttgactatgagactttttcttcccctcactttcaaccagattccaaacagcagttatatttgatgctacctttctatgacagccattcaagaaaggtaaagcatgttattagaacacccaaacagaagcctgaacctactctgcaggataaagcaaagccaccgaggaagtgactcagtgctgaaatataaaggatgagcaggagttaactagatacgacagggagacaagagctccaggaggagggaacagcatgtgcaagtgccccaaggctggggacacactgttacttccaaggttgtgcagaagaccgatgacagtgcggtgcagagagtgtggtggcaggtggcaggaggttgagtggaaggggcaggccctgagcttgcatgacagctggtattgttaccaaccaagacaacactagaggaggagcccccttatcacctaagaggaaatctccaatagaaattgaaaacaaaagttgggggaaggacctgactggggttacctgggatgcccatgatgccatcatgagatgggtagtaggtatgacaataagggtgtgtaggatcaccaaggatggccttgaagggggagagaaacactgagaactaagagaagcctgaagggagaaaacatatgtcatggagcaaataagggaacagaaccccattaaagcaaagcaaaaagcctagactgaaggtataaggaatcaggagatgggattgtcactaaaatctcttcaagagggagaacatggcaccctccaaccactcactgtccatccatggccactcatcaccaagcacatgctaagcaggaggcacagagcaggctgagcaccgaatgtgaagggaggaatgggctgcaagtatagctgctttttgagaaatttagttgaaaacaataggaaagaagagtatcatggtcaagggaagaattttttttgtttaatgtattttgaggtcagggggtggagaggcaacatagattaatttaattccatttgtacgtttaggggaaggacctggtataaaagaagaggtaagtaatgtttttaaatgggaggataattgacggagtaggattccagcacaggtagaagggcaagagatcaatgagaaacacaagccgcagctttgcctagctgctgtctttcggctacagtttcccttaggaagacaagtgtaaggcacagaggtaaccaagggtcatgcagcaagttgggggtaacagcagatgcaggatgctgctttccagcatgccagcctcttttacccagtccaagggtctcatgtgtccaggtaacccataacctcatgtgtgctggcatgatccagtgtgcagactttggacactgggattccatggccctgggacactttcttcaggagcagttggaggcacagaccctggcctttactccagaaaggcaccaagccaagaggattagctgggaggtggcacatggagatcacagacctgcaagtgagcagctggggaaggcaacaacaccaagctgagaatgccagggactgattcgcatggacaaggcctttcctttgtggaaggcgtataggcctggcatgatttgaaaggcacccaaagaggccactgcacctctcactatagccctgccaaggctcagctatcaccttgacactctatgggactaaagcaaaaagccccagatagttaagtggaaatttttgcagaacaccacattgagccattgccactttaggactgggcagagccgcaaaagataaagcaaaaggataaagaggaaagtactgaagcatgggatttgggggtcccaccatgcagaatcatgggaatccatgcaacaaccataaccaatgtaaaccatttttctatcacttgtatataagaaaacactaattacagtagacaaagacagggcccctgcctttgagtaactcataaagaaactcaaatagagaaagttactgttcaatgcagtcagtgctatgataggaatttgtgcaaaggactataggaacatggagaaaggatttccacatcttaagggtttggatattggtgcatataacaagaattttggtcaataagtgtctctgttttctttctgccatcccaactactcagagctctataaaggatgaagaaattaccaacaaagtcctaagacctccctgaatggtcacttttcaaaaggatatgtttctggacagcaagcttcacctagacctttgctgagctccaatccctttactgtacgataagtcctctctgaccccaggaaagcttgcatttcccgtctgagtacctttcactcaggaacctgcttgcatccggccaggcggtcttgtcttcctcccccatacccaccccacctccccactcacaatcctccagacatacaaagagtctttgcttatgaggcttcaaacctcttcctgggccacaccttcccccctcaccccacttcccgcccaaccaggaggctcctactcatttttggcttccggcctcaaagcccaccccacctgcagctgcatgaagaggtggtcagcacagtgggcgccaatcgtccccccaaccccagtgcaggaaggaagtctgcacccacctctgggcatttggtggtgactcacccagaagagtccactcccccacaccggacacaggaaagacaaaggtctttccattgcagagactcagcttaaaacttcaaaccataggggccatctccatctgcagccagcaggctctttccaaattctctttcctgcctgtcctacagccacactaaatgtctttcaatttcttgaaggcaccaagactttatgcatggatttctttccccctgaagaaaattcttcacctagttacctcctagatactcttccttgcagcttccctctaaccacttacgggtctccccaagcacctggacttatatccttcaagaaagataaccattaacatggtgattcctaatgtgtcttatcatatcccccaaaaggttcgaagttccttgaaggccaggattcttgtcttgttcaaggttgtattcccagtgctttgtacctgagtcatgataggcacttggtcaatgtcttgagttgaaaagaaatgaaaaccataatatacaaacaatcattattattgtcagaagaatgttggaggagtatgaagagttattctcttacgcttaatttaccagccatcacctggcctaaaccagtggttttcaaagtgtgaccctggcctagcagcattagcaccatgtggaaacttcttagaaacataaattcttagttcaatcccagacctactgattcagaaacttagggcattgtgctcagtactctgtattttaataaccctcactgccaagtgattctgatgcacactgaagtttgagaaaacactccctagtcctagtcctactcccaagattgggtcataacattcaaccatgggaatattacaaattagaaaaacgttacatttatagcaagatttgtttatctaaataaacacttctccatcctggtccccctatcttcttttttttttttttttttgagatggagtcttgctctgtcacccaggctggagtgcagtggtgtgatcttggctcactgcaagctctgccttgcgggttcatgccattctcctgcctcagcctcctgagtagctgggactacaggcgtctgccaccatgcccggctaatttttggtatttttagtagagacggggtttcaccatgttagccaggatggtctggatctcctgacctcgtgatccacccacctcggcctcccaaagtgctgggattacaggcgtgagccaccacacccagcccccctatcttcttataggggtttaagtcagcagcaggcataagttttgttaagctccattcgatagataaaaacactaaggttgaaaaaaaaacccactttctcaaatgataagactaaaacaggcagtgtcaaagaagggatcaggcccaagactctttccacagtaacacaaagtcattcagaagacagtcaaataaaataagcaccagagaattcaccgtttaggggccagaaatgtgaatgcatctttcccagcactacaatgcttgctgataacggtaaataacctctcaggtggcttcctgagggtttgggtttctaaggatgcgagtcagtccttcataataattaagagcaatgtcccacacaacttacagcgtcgttttctttttttaaaaaaaaggcacaatacccaattcatgccaccccagaatggcattttttttaaacctgcttcacatttgtagaggtgaagaacctccacctctaagaaaccttgctttcagatatagaggtcccagcctaaacacctaggtttgggtggatacggcccggaaacttctggaaaatgaggacaaagctggactgctgaaggtcttgtctgtgtttgggtggctgtctggcgcccccttgtgttcagtgcctggacccaaaagagccggaaggcaacaatgatgcagtgagggcaaatggctacagcaattcacaaatggcactctggccagtgaggaccagaggaatgggcttaggactgggcaaaggcccctctgcccaccatctgggctctcctgaaggccctccaagcactcttccagccctagtggagaagcagtcactaggaagacttgcctggacaggcataggtggaagctgtgcccaagctcacccgttgtgtccaccaggaagatgggtcattgcatccttcttgctgggtgtttggccagagggcttttcctcctgacttactgcccagggcagaggcttagagcacccccacctcccttttttttcttttttttgacggaatttcgctcttgttgcccaggctggagtgcaatgatgcgatctgggatcatcacaacctccacctcccaggttcaagcaattctcctgcctcagcctcccgagtagctgggattacaggcatgtgccaccatgcccagctagttttttttttttgtacttttagtagagatggggtttcaccatgttggtcaggctggtctcgaactcctgacctcaggtgatccgcccgcctcagcctcccaaagtgctgggattacagatgtcagccactgcacctggcccccaccccctttattaaagggaaattgagtgttctgctgaagacagcttgggcccctgaggagacattgcaaggcagttctgaatgtgctaagtcagtgggtgataatgggcactgtgtgcccagcaaaggcacttcccaccctcggccataaacagtctttaactggttcacacagaaggctggggttggctcttccttctcacctgcctgctccctgactcccacactgcagggctctaccttcccagtcatatcaccaaatcctgcccttggtgtgaaaaagaccatggcatgttcagcacaaaacagcagagccaatgacaagcatccaggcatagctctagccccagaacagggctcccctcaaggagcagccctgatctgagccttaaattctggatggatctcagctcctcctcatataagctgagttagacaagtcatataaatcagagcactaaaactctctgagccccagtctcctcatgagaaaaatggaaatctcggccctgaaattagcccagtatggctctaggtactatagagttgaatatgttggaaaatctaacagacaagtatcctcttgcctctgagtctttgcacattctgttcccactgcctggaacagttttctcccctctctccctcacttggctagtacctgtttatcttcagtctcagcttagacctcctcaggaacccttctgtgtttccttgagccaagtcaagttcccctccagtggttcccataactctctgcatgtcaccagtcccaaaagtggtcacaaaatatgttaactggctgtttgctggtctaggacctcactgtaataaaccccatgagggaagaatagggatcatgtctgccttattcaccttggcatcatcagggacctgtgcagtgcgtggcacatagttggcactcaatacaaatggatttgactggatagatgggctcagaatgaaacacaggctggggccagagagcagaggccaagtcaggaaagcagctaagggaacgtgtacacacatccatgacgtggatagattcccacagtggcctgtagcccctgtgtcagtcctggaacccagtgctatctatgcctgtgaggaccctgcaccaggtccctgctgctctggcctattagagaaagaaggaaccttgggggtcattcaggccagaagtccacagacagagctcaggccttctctgcccaagctctaccagagagtttctgcttttattcttttgtatttgtttttctcaatgaggtagtgttttaaaatctggttccatgaggagaaggagaaaggtgaaaatcacctgtgccgtcattttacaaaaggaaaagagactctcagaagagaaggggttttccccaaggtcaaacggctcagtattggtatgggaagaccccacatcctcaattccttacacacttttcagagggagggaagaaaataggggattgtgatttggagtgaagggctgagtctgcctgaagagtccccaagcccaaggtgctcctgtgacaccatcccatcgtgggggatgagcatcacataccatttgtgccagcatcttgggagtgagaactggggaaggggtgcagaggggcccacagggcctggccgtgggatttcatggtcacagtcaaacacacacacacacaccagcacctgtactcatagctaatccccacccaaactcctacctgaccctgacagctgtccctgggaatattgtctccttaggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtaagcacgaaattcaccgcaggccgccttccccgcagggcttgacttctccagctgatctcagggcagctagagaattcccctcccagggaatggggatttgctcccaatgtccagctttggtcctgagacctgaacagttatggtggtccttctgggcctctacccagccactatttttctactgttttcttgcccttccttctttctttgtccatttatccttcttttagtttctccctctcccttcttctcttttgctccatgtctcattagctataggcttctctcctgctaaggcaagagaatcttcccccaaggtcctcctcctaccgagacctagggaaattaggccactagggaggggacacacagatgagctcccaaggtctaacccctaaaagagtgatatctgagtttgtgcttctcaaaccataattccccaagaccccagatcagtgcttcatagccctggtagcacattacagtcaccaggggaagcctgatttttaaatagcaatactgtttatgccccagggcagaccaattaaatccgaactttagggaaataggcgcaagttttggcatataactccccagcccatccgcccccagcaagtgactctaattctctgcagccagggttgagaaccactgacccaaagattcagaagagaccaggagcagcaaaggcctgcttctgagctgatgcagtcacagattccagtctgcaaagccacttccattaaaaatgcctctgtgccacagcttccagtcagctctgtgtacgtgtgcctgtccccctgctctgacccttaggtggatttaggaggagccctggttggacaaggtaaagggacctggactgttctttgaaccgtgaaaagccctggctcccctcctgaagtagttagggaaaggcatgatcctttgctgggctagggagaggggattcctgtgatgggttgtggtgtcccagaagagatgagtcctggatggaagtaacagatgaatggagttttaaagagctagattctttttcatgcagatgagagcagagagtttctacaacaagaagaggaggatatgctgacacaggcggttgatctgccaaagcaactagttggaggatagagggaggggaagggtggaggccccagaagaggaggctcagcttaacaagttggacctggctggggatccaagcaaggtcaggattccagagtccatgaggagaagcttcaacttgaacctgctaaaacctgatagaaaaccagtgaccaggggggtgagggatatgcctcaggcttggacagggcagggagcaaaggtgaaccagcaagacagagcagagggtccagtgacctcggctagctttctaggtggccaaagaaaatagtcagtcattggctgggcatggtggctgatgcctgtaatcccagcactttgggaggccaaggtgggcggatcacttgaggtcaggggctcaagaccagccaggccaactgagtgaaacctgtctctactaaaaatgcaaaaattagccgggtgtggtggcagacgcttgtaatcccagctactcgggaggctgaggcaggagaatcacctgaacctgggaggcagagtttgaagtgagccaagcttgtcccattgcattctagcctgggtgacagattgagaccctgtctcaaaaaacaaaaaaaaaaaacaaaaaaaacctcagtcgtgctttagccaaaagaagctggatagagcaaactgctgtgcccctgtcattcacacatcaggcacaccaagatttcctttcttagaagggaaatcttttgtgccccatacaatggctgttgcagatgctaggacacaagagactggccagagggaaggaagagagagaagccaaggtgaggcctttagcagagggtgctggtttggcagtagcatgaacctacccaagtgagggaaacagatagttccatgcacatcaagcgtttgagaccagccttggaggcacatttcactctcatacccctacccagaagcctcagagaggagggaggctctggctaaatccctgtctaaagaccccacctgcttattgggtaattctttgggattctctattggagtaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaataggtaagagagaaagcagcctctggtgtcaggctggggcccctgggctttggggaaatcaggaaagagacaagaaaggcctggcttgggtggagcagaggccgggaaggggcctgatgctgaacaatcaggcagggagcacacctggctccaggcagatatcatacctccctgcctcctcccttgccccatgctatggggcaccctccccctggcccccagccatagtgtgctatctacagtttccttcctcaaacaccacatctgctttcattcaataaaagaatcttcatgaattgatccttttctaagccatcagacccctaacccagcccacattcaagcattcattcgtttagtccctcaatgattcactcactgcctcaatcaatcatttacttactcactcgcttgttcattaattcattcacacataattcactcattcattttgtgctaggccctgggacacacaaagcccatctttgcggagcttacagtctaatgagaacacagatattaatcaactacctacaaaaaatattgtaaaaatgcagctgtaagtcctgctaagaaaaggaacatgaagatatgcaaggtagcacaggattatttggtttatgaagttcatgaaagtcttcccttgagtaaaaaacaataagagaactaggtgaaaagagctcagacagttatgcaaaggccctgtggctaataggatcaaaagaaaaccagtagataggccaggtgcagtggctcatgcctgtaatcccagcactttgggaggccaaggcaggtggatcacctgagatcaggcgttcgagaccaacctggccaacatggtgaaaccccatctcttctaaaaatgcaaaaattaactgggtgtggtggcgagtgcctgtaatcctagctacttgggagactgaagcaggaaaaccacttgaacatgggaggcagaggttgcagtgagctgagatcacgccactggactccagcctgggcgacaagagcaagactctatctcaaaaaaaaaaagaaagaaagaaaagaaaaccagtagataaagagcaggggagcacaaggtaggctgaagttgaagatgtcagcagaggtgacctttcagaggctgggggctgtgttatatcttcttgcctttggtcataaagcaatgggaaacccttggcagattttaagccaacttgcatttcagaaagtccactctggctgcagtagggagaatcacttagaaagggccaagaggggatgggcgtgggccactgagtgaccctggaacactggtgatgacatgcactaaggtgctgatggagagacgcagagaggggtcaacgttggcaaggttcacaaggtcaaaacacagaacttgatgatgggtttgataggaaagagagggaagcagaggttaagccccatctctgttttggccttgagtgactgatggtaccaatcatgaaatgcggacaactgaggaggactaggcatgcggagtagggtcacagacttgactgtggacagttgagtttcaagtgcctttgagatacccaaaaggggtgtcaaaaaggcgactgggtctggggcagccatgagttctctttcctcctcttctctctcatggcctttcttctcttcatcacagaatcatccggaccaaagtgcagcaaccattcaacctccctatggacagctgcgtggccaccaagtccctgagtcccggacacacgctgagtgagtgctgagagacctggatacacacacatgctcgtgtacacctccccttcagcatacccacatatacacagaggcacacacagacacacccacacagacatagctgtgcacagtaccattcacaaacccatgtgtagactgagttgtgccactgcgacgaagtctggcctgttcccagggcagattcactgaactatggagaggtgcaaacacttgagacagctctaactccaagaatccctcccaccaggaggccccctggaggaaggacctgagcccctccagggctcagtccatggttcggcttgctgcctcctgcacagtgtcagcagggactgtgaggggtgtcactctcactccctgaccctctccctcttcccaccaccgcagtccccccagagtcaccccagggctgtaaggggtgtcccaccccttgctcctctccctctcccccagcccctgcagtccccagctcaactgtaactaccccagagtcacccagggctgtgaggggtgtcactcccacccctgaccctctccctctcccccactgcagtccccagctcagctgtaactcccccggagtcaccccagtcggattccctgggctccacctactccatcaatgggctcctgggcatcgctcagcctggcagcgacaagaggaaaatggatgacagtgagtgctgggacaggagggcagcgggcggtgcacgagagcagtttgctcaggctttgatggggacagaaacccttccacttatgatatgggactttgtaggggctctgcatgtgactgtcacatgtcctgtccctcagttggccaaggctcctgggcccacgtggctggccctttttctccctccacagtgagtcagcttggagtcagtcctctactttggcctagagcatgaatagataggtcccctaaaagctttcttccttcccggggggtaccaggtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccgtctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggagatgaggacctctcctggggagatgagggctgccaagtcctaagacacaggctcagggtctgcaggaaggtcggcttgttggatcgtctctgtgcgctgacttctctttgctccccagggcctctacccgctgcccttgctcaacagcaccctggacgacgggaaggccaccctgaccccttccaacacgccactggggcgcaacctctcgactcaccagacctaccccgtggtggcaggtacaacgcccggagcctccctggcaggtggagggcgggggactgaagagcttggctggctgtcaggcggaaggtgtggggccctggcctggagaggagaggcgggctgtgccggccgggccgccaggtgggcccaggggtcgcgcctccggtcctaggccgggcctcaaggtgggccgaggggtcgcgcctccagtcctaggccgggcctcaaggtgggcccaggggtcgcgcctccggtcctaggccgggcctcaaggtgggccgaggggtcgcgcctccagtcctaggccgggcctcaaggtgggccgaggggtcgcgcctccggtcctaggccgggcctcaagctgggccgaggggtcgcgcctccggccctaggcggctcccgtaaggtgggccgaggggtcgcgcctccagtcctaggccgggcctcaaggtgggcccaggggtcgcgcctccggtcctaggccgggcctcaaggtgggccgaggggtcgcgcctccggtcctaggcggctcccgcaaggtgggccgaggggtcgcgcctccggtcctaggccgggcctcaagctgggccgaggggtcgcgcctccggtcctaggcggctcccgcaaggtgggccgaggggtcgcgcctccagtcctaggccgggcctcaaggtgggcccaggggtcgcgcctccggtcctaggccgggcctcaaggtgggccgaggggtcgcgcctccggtcctaggccgctcccgggtctccgcgctccctcctgtgggagaggcgggcgcacacacgccttccgggtctctccattttcgctgcagaagcgcagcagggaggtctagcttctctctccccgccttgccacgcctcgtgggccccggctctccccagcccagactctgagggcagctgagcctgccccgcgccccgcccgcaccctccacatcccacggcttggcttgtgcgtgttccctccccgccatctcacacccctctctccttgttgtctccctccctccggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcaggtacgacagggaggtcccggggccatgcagctatggcggcgggtgggacgggggtcctcagggcagaccgccagccccctctctggcctcagtctcatccacccccaccctgttccctaattcctccggcaacttttggaggcgccaacatgaagttctctgtgacggaagacatgctcggaaggggcggatgctgtaggggtgccggggatgcaccaccccaagaccccatggaaaagcaggaaccctaaggccgggagccgggtgctgtaacgtagcaacttggccttggtaaatgcataaatagatagaaggaaaaatgaacattttggagggaaaaaggaattggcttttggagcccatttctggatcaaatttctaaaaaggccaagggtcagtcccagttgtgtttccatgatgcagctatcttcattcctagcttaacagcatcaccgggaggacagtcagacatctgttaaacatgataaattcagtgattcaacaacttgagaggagtgggggacctcccatcaggaacctcaactgcctcaaaatatttaaagctggaagcaccgaccgggcgaggtggctcacccctgtaattccagcagtttgggaggccgaggcaggtggatcacaaggtcaagagttcaagaccagcctggccaagatgatgaaaccccatctctactaaaattcaaaaaattagggggtgtggtggcagacacctgtaatcccagctactggggaggccgaggcaggagaatcgcttgaacccaggaggcataggttgcagtgagctgaggtggcgccatggcactccagcctgggtgacagagcaagactccatctcaaaaaagaaaaaaacaaataaataaaaataagtaaatctggaagcacctgagggagcctctagatcaaacctcttatgctgatgaggaacctggcccagggaggagaaggtccctgccaaggtctctgggcaggagcaccatctgtagctggttgaggcctgggcctgcactgcatgagtcagacctcaaggggagctggctcctcctggcagaaggaccttcgctcatccagccagggcctgaggaatggctgagagtcaagcgcttggcttgggttggagagggcctgagatgcagtgaaagtgggaagcagagacccatatggtcttcagatacctcaagggcttccacagggataggactattttagatgtgggcccagtgggggcccaggaccagggaaggaagccagctagctctcagttcagcattggaggaatctctttaatagcggcactgtctccaaggagtgtgggtatttagtgacagaagtaaatgcctcttcacctcccacaccctcctaccccgacgaccttgaaatgctggagcagagaccagtgcgtgggtggggtgtgtgagacctgtcacagaggcagcccagagtcagacagtccatctggaccagtggtttcaaatttgggcctctcaatgctctcttgaaatgaagccttttacagaagacatgtatgctcaccagacccctgaagaactgctcttttagaaggggtccctgcccctagaaagcccttggacttcgaaaccactgcaccagaggattaagacctctacaagcccagagtaaccacagggtcatgtgataaaagtccctggacccttttttttttgttttttttttttttgagatggaatctcactctgttgcccaggttggagtgcagtggcgcgatctcagctcactgcaacctccacctcctgggttcaagtgattctcctgcctcagcctcccgagtagctagaactacaaatgggcgccactacacccggctaatttttgtattttcagtagagatggggtttcaccatgttagccagaatggtctcaatctcctgaccttggtccgcccaccttggcctcccaaagtgctggggttacaggtgtgagccactgcacccagcccatggacccttttttataactggctctacattttctttctggctggcacccgggttttttttttttttttcctccgtacatcccagcacctaatgtgagaagtttccttagaagagagggacatccagtgtgtgggcagagagatggtgtttaagggtctaaagcgaggagttgacttggagttcaagaattcaagagggtgaaggcagcagagatgggtcatttgttttgaccaaagtgatgaaaagagcaaaacctgtgagctgagtaaaattatgtcagccagagaaaatgggatgcggggtagggaggggaatgagaggatagtggagaggaagggaggggaagggaagggaggggaggggaggggaggggagggggtgaggagaagaggttcatgtcagttacagggagttacgcaagcctgcatgtcttctgagaatggcaggctagagctggcggcggtcatggggcaggcaaggggtgagggtgtggtggtgcccatgatgatggggagcaggtgctgtggaagccgcggagaagcttggcaagaccagctgaaggagagggaaggatgtagggcagctggaagtggatagatgtatcagagtgcagacataggctgtagtgtaaagtgcaactggaacagcccagggcaaactccctactcccaaagcccctacactttgtcccctccctgtcatcctgttagcatcccctgtcaacatgcagtcaatcagaggtgacgcctccaactactgtcagctgttaatttagtggacatgcccactctccaggccaactgcaggactgagaggtcacccaacccatgggacaaaacagctggcagcagacaccaggtagtcatgtaggaagcaggcagccaaatatgcagcaccggcatatctttcaggctggtggcccccaatccaggcccagatgatgctgaagtgcaggtgtgagcactttgaaggttgctggctggtcacagggccccctagcccaagggttgacaattcagcacagaggcagaggctctgaaaagagtgaggagtgctagccttggaggatctggggtccaggcaaatggccaagagtaggaagcaagtcagaaagcagctcaggcacaagggaggggatggctggtgtccatgctgagctcagggtgttggcctggagctccttacagactgtccacctgaggcctctggtcaagactggatctcaatacctaacacgtggctgagccatggtgagagagctgggaggacatgacggggggcggtggggaaggttaggaagggaatggttccaggagcgcaggaggctgcagaccttcccaagaagaggtgaatttgaaagaaagagaaggaacctgggcccaatggctcacacctgtaatcccagcactttgggaggccaaggtgggtggatcacctgaggtcgggagttcgagaccagcctgaccaacatggagaaaccccatctctactaaaaatacaaaattagccaggcgtggtggcacatgcctgtaatcccagctactcgggaggctgaggcaggagaattgcttaaacccaggaggcggaggttgcggtgagccgagatcgtgccattgcactccagcctgggcaacaagagcgaaactccgtctcaaaaaagaaaaaaataataaagaaagagaaggaagttgaggccacattattcctaagtaatgctgcagaccaggagagaggagagaggacacagtgagttttcattccataatcagctcagctttaacccgcgtgaatcttccacatgcctctgagtgactcccaaggaccctcgctgccgcctcctgcaactccttcactacttcatagcgtttttctctgggtcacttatttccgcctggtggctctgatagtgtgatttccaaggtgactatccttctgagtctcagctcatccccagtcagccaagaaagaagaaacagcaaggtttggggaatagcaagagtgcccctaacattgctgccagttccctttggaagccccagtctggagtcccaacacactggccaagacagcaatgtcgaggccgtcctggtcccagctgctctgggactgcctccagctcagctcaaaggaaagccatgagttaggttttatcatcaaagagtccattcccctcctccatccttttgtacaaaattatatttagttctgccaaagagatttctgagttgccataaattctccttgctatcagaacgagataaggaattgaaaaggggttacatggagggcagacttcaaagggggaaaataaaatagtctgaaatcacctctaccctctgaattcctccaggcaatagctttatgattctggcctctaccaatatttagaatatttaccaatatttcaaggtgtagggggagctagagttttcttagagaactccacggccagtcaacatgggcctatgctttctgtcaacttcctaaaataggaccacgttggaaagaaatttgggtgtagaggagatggaattcatagcgaggatcgttttatgatgaagagtcttaaaaacagagaagtaggtaagagggcatggttaggccgtgatggagtttccaccccacagcttctgtggttttgtttctaagaaggcttgcaagcttcttggctttttggaagaaactatgcatttaagcaattggagcaaagagttttgtagggctgttgggagagtttattgtgccatagtctgggtgagagccatgctgaagaaagtcttaccagtctttccaggaagaccagctttcatggcaggaagcctcaggcgtctgttctgatgtccgattcagaagcctctaccccattgggaagacattaggtgactgaggggagatgaagattaaaaatcgtagagtacaggggagtgagactgatgaattccatttataagatcaatgtaggggctagttctcatgcggtggagccccgtgggggcacctctggaccatattaagctgtgttgtaaggggagtatatgccctggaactctgcctgctactctgccaggctcgagaggcagcaggttcaggtaatagaacgagaaggaacaggatgaaggcagggggaaggggagtgcggggccacaggctgccaggccagaagcagccctgcagggcacaaggccagcaccagcaaacaggtgacctgagagtcaagaccacctcccactgctccccaccccgatcatggcagacacaggctgcctcagaatccttctcaacactgggtgccaggaggtccctaccagccaatcaggtagtcaggtgaatccagtttacaagctgaaatctaaactagttccttatgtgacaggcaggaagacgtggttcagagaattaagtggctgtctttcatccagggtccagcctggatctggagttccctttctctctctctcatggaggaagaggtagggagggaagagaaaagaaggaagcaggcctgaatccgccaccaccttcttccatcactccctccctcaccacctgtccctgctctgtgctcctcctgctctcacagacttcctgtcactccttccctcttgcctagccggtgcttcatctgagggccaagggggctgagtttgagggtcgattgtgttgtattcttcttcaaagaaagctcagattttatctcagtatagcttctgcatatttctccctctgcgtctaaatatcttaaaattctcttttcccctcctgtgtttccagcccttcatttgttcccttgatgaccttgtgtcaggtaaactgaacacacctgtagaattctagtgggtttcaccccatttggtccagtgccaagcacagctggacactgcaggaaaagtcaaacaaattagaaggtggtgttcaggtttaccaaaacattcacacggttttaaacaatgaacactgatggctctttattctgtaggagttcactggcatataaccatttctagaatgtgtccattgtgctaatcaatgtccacctgtagcatgaaaccctggctctgaattatgcagataacctcatagaaattgtaataaggtgcctacagctatgtttttttttccattttgcatatgaagaaactgacccttggggcacatactaggcttatctaagggcactcagaaaactagccacagaagcagtataaggactccaggccctctgattcccaggccctgccctctagaggaagggaagaagttgtgtgtgcctggtttttgttcattgaccccttgggcttggctccaaatgcctatcccagcctatgtcccttcttgatttagtgcccggccttgctaatttagcatcctggctttctgctatatacccaagtgcttagaaaagtgtctagaatatagtatttactcagtaagtatttagtgaatgaacactgtctttggggaatctccagaaagagagataaggaggaggtagtcactgcagtattggcaacttacaggctttcatggggccttccttcccttctgtcatgaccaggcaccccttgaaggggctgaggtatgaaggacctgggggggactgatgggtggatagttggacaagcagtgccatagaggagatgaatttggtaagttggttaacagggctcacaggtggcccacacaggtcctgggaggaaaaagcagcccccaaaatggaagaggcagaaggcatttgggtaaaagagtcatagtccaacacaatggttcttagccagcagcgattttgcccttactacctcctgctgaggacatatggcaatgtctggaggcatttttgttgtcacactgggtgaaaactgctgctggtatctactggatggaggccagaaatgctgctaaacatcctacaatgcacaggacagcctcctgcagcaaagaattgtgcagcctaacatgccaatgttgctgagactgagaaactctgtaaatatcaccaagaactaggaagagcaaataactcattattccaactggagcattttgagaatgaaatgggcattattaacaaatatgctgggatactggtcatcacctgggtacaccttggcaaaccagggtgtattgtcaccttgccaagaatcttggggtgaaggagaatctgattggggcctgcaggacacaggagcaatagaagaggggcaggggcaagggatcatgtttatgttcattgttatatgcagtagatggggagatgctcgccaggtcaggtggggcctccaaaatgggaaagtgatttctcgatgtagaggagaagcagagccgggaaatgaggtctttacagagctgatttggtatcaccaaggtgggggtatgacccacaagctatagataaacagagagattggtgtctgttttgctaaaaatggttcttttcaaaatagaatggacagatatgtggcttgtggtcatgtaaaagctaaatatctccgccacatctccttctaggttggggttagccaatcggtttcctgtacctggcaactctgatagattgcatccacttggaaggccccctctactcagggggaaatggtatagtggttgattagcaatgtctgtcacaggccccccaaaaaatagtgatgagttagtggcccacatacatgccatcccttcatagggtcttattcttggtactcctcagagccgggaatgaaagggatgagctctgagttaagtggtctcaaatgtatttatggaggccagctatacccactgctctgctggctgctgttgggggtaacagaaaacagaagacataacctcagcctccaataccaggacattcttgtggattaataagataacaatcacgtaaacaaaaccactggagaacagggaacagtgtgagactgcagtaacaagtgctccctgcatggtggagcctctgtcctgcagaagaccagacagaggtgaaaagaacttgggctcagatgaggagtgggggcaggaggaagtgggtttggagaatggctgtagagagggtgggaatggcatggaggaagacagcctcaggagagtgagatgatacatatgggagcccccatggtccaactgacgactctttgctgtatttttccagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaaggcatctgtgacccccatgccagccctaggccagcctctctggctgtgaccccagagacttggcgtatttacctaggcctgcttcccttccttgccggcaggagttaatctttgccagccacccactctgggcaccctatgcagaggcaggtgggctgggatctcctgggcagagggaagggagggagagaaagagggagggagaaatgctctgtgctccctgggaacctgctgagctggcacttgttgctgcctggttaccgtggcgatgtgcttaatgcagcgttgaaaatacagaatactgactcctctgtccctcctggccccggactccctccctccctcccttcctcttctggagcgtgaaatgagattggtcaagataaaaaaggaaaagattcggttatttttttaagagtgtggataatggggcctctcaatcaaaatcccagtctccagtcggttccccccattccccttccaacccctccaccttcccctgccgcctgcttagaggaggaggaagaaacataaagcacaaggcttttctcttaattatgaatcattccctgagggcaggcccagggcaaggggttcctggggcccagagtctgacctgtgaggtagctagaaggcttgagcctctcatcaaagtcccccaggttgtttccagaaagaatcctgagtgggttctgtgaaaaagaaaaaaaatagcacaactaggacactgactgcaagtgaaatccacaaaggagggaccttgccctacacagttgggctcccagtgagttccatgaaaatcagttttagaaaatgcaatactatttaaatgaatcacttggttcctaggaatggcactgtgcaaatgaattcttaaggaaatttttttgtggaaaaattctatgtccgtctcttaccactgcttgcaatctcccagttggttgaatggggactcctgcaattaaagtgaataaactttcatcgaacacctactgcattcatgttaggtacatgataaatgcttaaagcaaggcatgccaaagacattcatcaatcaattgtgaaaggaaggaagtgatcacttattatgtacttttgcatgtctagccattcaaatatgtataactttatttctaattttaccctgaccataagactaagaggctaatactatcccagttttatggataaggaaactgaagcaaaagcaaagtggtgtgctcagggtcataatcatactaagtggctgagttatgcaaacacggatttttcaatttcaagtctaaagctctttcctctacaccatactgcctcctaccataccagaaataaagacacaagctgcaagagaggagcacaggaaaagggctaggacagatttcccttgtctattcaccttctgtttctattttattttattttattttattttattttatattttattttattttatttttttattttattttattttattttattttttgttttgactccattaacagtcaatgattctcaaccagttctagagcagaaccagcagctccagacacatggatccatccagtcatctatctttccactcattcatcttcccatacatttttccacgcatccatgcattttcccatctatccttctatctttcatcatccatcccgtcatcctccacctttccaccgatccttccatctttccatccatctttctttttttttttttttttttggagacggagtcttgctctgttgcccaggctggagtgtagtggtgtgatcttagctcactgcaacctctgcctcccgggttcaagcgattctcctgcctcagcctccccactagctgtcactacagggacccaccaccacacctggctaatttttatatttttggtagagacggagtttcaccatgttggccaggctggtctcgaactcctggcctcaggcaatctgcccgccttggcctcccaaagtgttgggattacaggtgtgagtcactgtgcctggtccctccatccatcttttaattcatctgtcttttcagttatctatcatccatctttccatccatccatctttccatcaatccttttatttttccatccatattcattcgtccattcatcttttcatagaactatcctttaatctgtctttccatctatcctttcatcatccattcttccacccatccctcctctcctatatccatcttttcatccccttttcaatctattcctccattaatctatacatctttctatatatacatccttttatctgtccatctttccatccatcttttcacccatccatcctttcatcatcaatccttccatcattcacactttcattcatccttccatccttccatccatttaccactttttcacttaacaaatactggttgaaggtctactgtataggatgctggggatacagcagtgaataagtcagattcctttattcctggagcttataacctaatggtgaagacaaatggacaataaataagtcaatgaatgaacataataatttattgtctgtgaagacaataaaatgggatgatgtaataaagagccacagggagaggagataactactttagattgggctgtcaggggaggcctctctgagaaggtgttcaaagtgaccattcaagtgataaactggggcagaccatccctggaccaaagaacagcaagggcaaaggacctaaggcaggaactagtttagcatggtagcacaaaattgtagtggctgggtcgagttttaaaaggctactctgatttctaggaaaatgaattgtacatagtcaagagagaaagcacaaagaccagttaggggacagttgcagtagttcttgcaagagatgacagtggcttgagttagggaattagcagtgaaggagggaaaaagagaccctgaaaatatattttggttgcaaagccagcaaaccttgctggtagattggctgttgggatgagaaaatagaggaaacaagaatcatttgtaggtttggggcatggatgatggtggcaagtatatatatggcagaccaggaggggaagtgatgtagtagatggcaagtggaaatcaagagttttttgggccgtgttatgattgagatgcctactaaatgtccagttttaataagtcagcaggtacatcatgtgtgtctgaagccaggaaagaatcctgactagagtataaatttcagccattgcacaaagctgtcatttaatgacaagactactagaaaccaagcctggggttcttcaacaatttagagctctaacagagaaggaacagcaaggagaatgagtaggaaagacaactgagttacaaagcaaacagaagactgggcatcacaaacccaaaggcatgagacagggatgagctaaaaggtcaagggaattgaggatatagaagtgaccattggtatgatggagttagagactgtggggacttgaggggatcagagttggcctgataggaagggataagaaggtgaaggcagagaccatggggcagagaaaggcactggtagctagagaggaatgtggggataggaagaggattttttaaagacagaagatagcagaatatgtttgcagggtgaagggagagactgatgaaacagaaaacgggatcattggagcggccaaatccttggaaaggtgagtagggtgggatgcagagcaaagaggcagggttggcctttcatcggggcagagacgtttcatctgctgtgactgcaagcaggtaggcacatctgatgacgggaagatgccacacccaggtgtgtaccacctaccgagctccatcccctgccccaggttccatgtgactgaggtactcggtaaatggtagttaaatacataaataagtgggtgagtgagtgaatgcatgaatgagtgacaaaatgagagggtaaacacatcatgttttccacctctctcccttgtcctctagagctcactgtgtttgccattgggtagggtgtggtaaaaggtgagagggcccttgctgtgtggccagtagagaatcggctgaaacccgggagacctgagttaaacaggaggcagttggcactgggagatgcaagagagagtgccattgtggaaggacggggccagggttctagttctggctttcactgaatatgtgaccttggccaaatgtctttacttccctatgtcacagctgtgttatctgttaaacagatgtttagagtagattatttcttagtttttcatctgttaaatagatgtttcgattagattatttcttaggtttttttttctttgcttttttacttctttacccccttcctttttttacccatgttttttgcttgatttacgttagacttagtctctgcccctaaggaactttcttactgtgttctcagtccgtcattgacttcctagacaaggagaggatccagtagcctttctctgctttaggctgctcctcttcatctctcttcttcctgtataaatgcctacttgtctggcaataaagcagctcccactaaccccaacccaggccttaagactggttggatgactgatttaagcctccattgagctttattttcgcacctgtttaatgggaaaataataaaagcttagatttattgagcactccctgtatatttgaagcatggtgctaagcatttaatacatattttgtcatttaattctcattaaaccaaatgagatagggataattatttggcccattttacagataaggaaaccaaggttcacctgtaagtcactcactcagagaggctaagtgacttgtccaagtttacataaccaggaaatgggaagtaaggatttgactctagacaggtcagctccagagtcagggagtttcgagcaacccctccaaagagtctggggaaggagactcagaaccacatagctcccaatcgtaggtgagtttctgaaaggctgggtggacattcattgagtctcagggttggcaggaatctagctttgtaaatggaattatcgcataagtgaataaagggattatctgcaatttggagtcaagagccctaaggtcgagttctactctgacatttaacaacagtgtgatttgaggcaaactgcttaatcatgctgcactccagtttccttttctataaattggtagtatccatgagtacctcatggggtagtcttgaaaataaaagatcataatgtatgggaaagtgctttacaaactttaagctctttaccaagcaccggtagtagctgtggtgatcagtttgactttgtttttgttatgtaagggaattcttaagtaatttcttcggtaaataattcctttggaaaactcaagaatccattaacagaaggaggtgatctgatttactttgtgtaaatttatacgttgagtttgcttaaagcggcagactcaggatggaacaacaaactactccaagtcccaggacacagcttcctgagggtgtgtgccctctggggctctccctcctctcccatccttaaccctcacacctcccctcagccccccatgcacacaaacacacacactcatacctagcgaggctaaaaggttcatatatatggatgtcctctttggcccctaaccccatacccctgctgtggggccctcccagaagagcccttctccagaaggtccaggcagcagaaggagcagttagtccctgggccctacactcacagcacagtttcccagctccaccaaaccctccagctctgggagcttccgcagatcccagaggctcagtttcttcatctggaaaatgggggtagttataacatctaccttctgggcctcctgggagggctgtagtatgtcaagccagtgcctccagtacctacggaaaaggacactgccccaaattttccagatcgatgggttccaaaagggatgacagagggaccttctgagctccattgtccctgccgtggctccaactgtctcccccaccattcctgagcttgcccattgccagccctgcagaccttcccacaccccagccctgcattgatgcccttcacctcacaggcctctcccctgtgtgcctccaacaggaagtgaatactctggcaatgcctatggccacaccccctactcctcctacagcgaggcctggcgcttccccaactccagcttgctgagtaagtccctggggctgcccaggcctctgctgggcaggatggatggagtggtggggggcaagggtgggtcaaaggttacctgaaagctgggagtcctcagattatacagagggcctgggagatggtgctgtttgtgatggaagaaggcagcaggagggcagtgtacctggttgtttggggaaagagggcagaagtccagaggcttccaggcattcgtttccctcctgcttctcaagcccatgtcttttaaatctttgttttgtgtaagattcagggctcaggccttgaaggggaggacaagggaggacttgagaaaagcctaagagaggacctcctgcctccacggcttacagtcccacagtgcagacactgacgcagggcacccgccagaatgtaactgccctccttcctgggagccagtttcaagaatgccatcctgttgcccccattaaccatctaagtggctcagaaatactcatgattcagcaccaaacccttaaacagaaatcttttgttccaccacattccccatatttagcctgagatgaagacagtattcagggtcgaggtccagagagtgagcttcagcgagcttccaggcttctcttcacccctctcttgtcctggggtcctgaactgggaagagaagcttttcagcaaagcaaaaccccaccaatggggggacttgagggatcccactagagcctccctgagtggtggccttgggtgtatcagagcaaaccggagccagacagaagcagtgatccaaggatggccaaccccacaggcaccattgcaggctaggaaccatccattccccaagaccccctctcctcccattacctctttgtattccagaaataacttgaaaggtggcagacctgggccctgtttgccagatgagttcaactccaacccagctttccattcaatttagccagaaaagacgagggcaatgagacatgccagggttcaggcaccttcccactgagcctccccaggctgcccatcctgcaggtgtgcagagcctcaccttaagggccgtcaagcccagatcccctttgacccctcagcagtctaatctccctgggtcttaagaaagaagactctctgtcctggcactgtttgggcaaggctagggaggatcccaatgacctctcagtgcacttgattctttggggttccacatgcaattgttttctattgccctctccctattgcaacgagggtgttgaaggtcaaagcagccatagggggaaggggcaagaagccactgttctcattctggccagaaactcaaaggtgaggccagagaaggaggaaatagggctggagaggagttaatcttcgatgatcagataggccagagaaatgaatgattaacttgtgttgtcttaaaggtcagcagatgcagggaaggctatggtgcaattttcctttctgaccagcagtgttgttgttatttttttttaatgtgtccaggttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgt

SEQ ID NO: 15213 - DNA, 64377 bp, Human; identical to SEQ ID NO: 15212

SEQ ID NO: 15214 - DNA, 64377 bp, Human; identical to SEQ ID NO: 15212

SEQ ID NO: 15215 - DNA, 64377 bp, Human; identical to SEQ ID NO: 15212

SEQ ID NO: 15216 - DNA, 64377 bp, Human; identical to SEQ ID NO: 15212

SEQ ID NO: 15217 - DNA, 32379 bp, Human
gatctgggatcatcacaacctccacctcccaggttcaagcaattctcctgcctcagcctcccgagtagctgggattacaggcatgtgccaccatgcccagctagttttttttttttgtacttttagtagagatggggtttcaccatgttggtcaggctggtctcgaactcctgacctcaggtgatccgcccgcctcagcctcccaaagtgctgggattacagatgtcagccactgcacctggcccccaccccctttattaaagggaaattgagtgttctgctgaagacagcttgggcccctgaggagacattgcaaggcagttctgaatgtgctaagtcagtgggtgataatgggcactgtgtgcccagcaaaggcacttcccaccctcggccataaacagtctttaactggttcacacagaaggctggggttggctcttccttctcacctgcctgctccctgactcccacactgcagggctctaccttcccagtcatatcaccaaatcctgcccttggtgtgaaaaagaccatggcatgttcagcacaaaacagcagagccaatgacaagcatccaggcatagctctagccccagaacagggctcccctcaaggagcagccctgatctgagccttaaattctggatggatctcagctcctcctcatataagctgagttagacaagtcatataaatcagagcactaaaactctctgagccccagtctcctcatgagaaaaatggaaatctcggccctgaaattagcccagtatggctctaggtactatagagttgaatatgttggaaaatctaacagacaagtatcctcttgcctctgagtctttgcacattctgttcccactgcctggaacagttttctcccctctctccctcacttggctagtacctgtttatcttcagtctcagcttagacctcctcaggaacccttctgtgtttccttgagccaagtcaagttcccctccagtggttcccataactctctgcatgtcaccagtcccaaaagtggtcacaaaatatgttaactggctgtttgctggtctaggacctcactgtaataaaccccatgagggaagaatagggatcatgtctgccttattcaccttggcatcatcagggacctgtgcagtgcgtggcacatagttggcactcaatacaaatggatttgactggatagatgggctcagaatgaaacacaggctggggccagagagcagaggccaagtcaggaaagcagctaagggaacgtgtacacacatccatgacgtggatagattcccacagtggcctgtagcccctgtgtcagtcctggaacccagtgctatctatgcctgtgaggaccctgcaccaggtccctgctgctctggcctattagagaaagaaggaaccttgggggtcattcaggccagaagtccacagacagagctcaggccttctctgcccaagctctaccagagagtttctgcttttattcttttgtatttgtttttctcaatgaggtagtgttttaaaatctggttccatgaggagaaggagaaaggtgaaaatcacctgtgccgtcattttacaaaaggaaaagagactctcagaagagaaggggttttccccaaggtcaaacggctcagtattggtatgggaagaccccacatcctcaattccttacacacttttcagagggagggaagaaaataggggattgtgatttggagtgaagggctgagtctgcctgaagagtccccaagcccaaggtgctcctgtgacaccatcccatcgtgggggatgagcatcacataccatttgtgccagcatcttgggagtgagaactggggaaggggtgcagaggggcccacagggcctggccgtgggatttcatggtcacagtcaaacacacacacacacaccagcacctgtactcatagctaatccccacccaaactcctacctgaccctgacagctgtccctgggaatattgtctccttaggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtaagcacgaaattcaccgcaggccgccttccccgcagggcttgacttctccagctgatctcagggcagctagagaattcccctcccagggaatggggatttgctcccaatgtccagctttggtcctgagacctgaacagttatggtggtccttctgggcctctacccagccactatttttctactgttttcttgcccttccttctttctttgtccatttatccttcttttagtttctccctctcccttcttctcttttgctccatgtctcattagctataggcttctctcctgctaaggcaagagaatcttcccccaaggtcctcctcctaccgagacctagggaaattaggccactagggaggggacacacagatgagctcccaaggtctaacccctaaaagagtgatatctgagtttgtgcttctcaaaccataattccccaagaccccagatcagtgcttcatagccctggtagcacattacagtcaccaggggaagcctgatttttaaatagcaatactgtttatgccccagggcagaccaattaaatccgaactttagggaaataggcgcaagttttggcatataactccccagcccatccgcccccagcaagtgactctaattctctgcagccagggttgagaaccactgacccaaagattcagaagagaccaggagcagcaaaggcctgcttctgagctgatgcagtcacagattccagtctgcaaagccacttccattaaaaatgcctctgtgccacagcttccagtcagctctgtgtacgtgtgcctgtccccctgctctgacccttaggtggatttaggaggagccctggttggacaaggtaaagggacctggactgttctttgaaccgtgaaaagccctggctcccctcctgaagtagttagggaaaggcatgatcctttgctgggctagggagaggggattcctgtgatgggttgtggtgtcccagaagagatgagtcctggatggaagtaacagatgaatggagttttaaagagctagattctttttcatgcagatgagagcagagagtttctacaacaagaagaggaggatatgctgacacaggcggttgatctgccaaagcaactagttggaggatagagggaggggaagggtggaggccccagaagaggaggctcagcttaacaagttggacctggctggggatccaagcaaggtcaggattccagagtccatgaggagaagcttcaacttgaacctgctaaaacctgatagaaaaccagtgaccaggggggtgagggatatgcctcaggcttggacagggcagggagcaaaggtgaaccagcaagacagagcagagggtccagtgacctcggctagctttctaggtggccaaagaaaatagtcagtcattggctgggcatggtggctgatgcctgtaatcccagcactttgggaggccaaggtgggcggatcacttgaggtcaggggctcaagaccagccaggccaactgagtgaaacctgtctctactaaaaatgcaaaaattagccgggtgtggtggcagacgcttgtaatcccagctactcgggaggctgaggcaggagaatcacctgaacctgggaggcagagtttgaagtgagccaagcttgtcccattgcattctagcctgggtgacagattgagaccctgtctcaaaaaacaaaaaaaaaaaacaaaaaaaacctcagtcgtgctttagccaaaagaagctggatagagcaaactgctgtgcccctgtcattcacacatcaggcacaccaagatttcctttcttagaagggaaatcttttgtgccccatacaatggctgttgcagatgctaggacacaagagactggccagagggaaggaagagagagaagccaaggtgaggcctttagcagagggtgctggtttggcagtagcatgaacctacccaagtgagggaaacagatagttccatgcacatcaagcgtttgagaccagccttggaggcacatttcactctcatacccctacccagaagcctcagagaggagggaggctctggctaaatccctgtctaaagaccccacctgcttattgggtaattctttgggattctctattggagtaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaataggtaagagagaaagcagcctctggtgtcaggctggggcccctgggctttggggaaatcaggaaagagacaagaaaggcctggcttgggtggagcagaggccgggaaggggcctgatgctgaacaatcaggcagggagcacacctggctccaggcagatatcatacctccctgcctcctcccttgccccatgctatggggcaccctccccctggcccccagccatagtgtgctatctacagtttccttcctcaaacaccacatctgctttcattcaataaaagaatcttcatgaattgatccttttctaagccatcagacccctaacccagcccacattcaagcattcattcgtttagtccctcaatgattcactcactgcctcaatcaatcatttacttactcactcgcttgttcattaattcattcacacataattcactcattcattttgtgctaggccctgggacacacaaagcccatctttgcggagcttacagtctaatgagaacacagatattaatcaactacctacaaaaaatattgtaaaaatgcagctgtaagtcctgctaagaaaaggaacatgaagatatgcaaggtagcacaggattatttggtttatgaagttcatgaaagtcttcccttgagtaaaaaacaataagagaactaggtgaaaagagctcagacagttatgcaaaggccctgtggctaataggatcaaaagaaaaccagtagataggccaggtgcagtggctcatgcctgtaatcccagcactttgggaggccaaggcaggtggatcacctgagatcaggcgttcgagaccaacctggccaacatggtgaaaccccatctcttctaaaaatgcaaaaattaactgggtgtggtggcgagtgcctgtaatcctagctacttgggagactgaagcaggaaaaccacttgaacatgggaggcagaggttgcagtgagctgagatcacgccactggactccagcctgggcgacaagagcaagactctatctcaaaaaaaaaaagaaagaaagaaaagaaaaccagtagataaagagcaggggagcacaaggtaggctgaagttgaagatgtcagcagaggtgacctttcagaggctgggggctgtgttatatcttcttgcctttggtcataaagcaatgggaaacccttggcagattttaagccaacttgcatttcagaaagtccactctggctgcagtagggagaatcacttagaaagggccaagaggggatgggcgtgggccactgagtgaccctggaacactggtgatgacatgcactaaggtgctgatggagagacgcagagaggggtcaacgttggcaaggttcacaaggtcaaaacacagaacttgatgatgggtttgataggaaagagagggaagcagaggttaagccccatctctgttttggccttgagtgactgatggtaccaatcatgaaatgcggacaactgaggaggactaggcatgcggagtagggtcacagacttgactgtggacagttgagtttcaagtgcctttgagatacccaaaaggggtgtcaaaaaggcgactgggtctggggcagccatgagttctctttcctcctcttctctctcatggcctttcttctcttcatcacagaatcatccggaccaaagtgcagcaaccattcaacctccctatggacagctgcgtggccaccaagtccctgagtcccggacacacgctgagtgagtgctgagagacctggatacacacacatgctcgtgtacacctccccttcagcatacccacatatacacagaggcacacacagacacacccacacagacatagctgtgcacagtaccattcacaaacccatgtgtagactgagttgtgccactgcgacgaagtctggcctgttcccagggcagattcactgaactatggagaggtgcaaacacttgagacagctctaactccaagaatccctcccaccaggaggccccctggaggaaggacctgagcccctccagggctcagtccatggttcggcttgctgcctcctgcacagtgtcagcagggactgtgaggggtgtcactctcactccctgaccctctccctcttcccaccaccgcagtccccccagagtcaccccagggctgtaaggggtgtcccaccccttgctcctctccctctcccccagcccctgcagtccccagctcaactgtaactaccccagagtcacccagggctgtgaggggtgtcactcccacccctgaccctctccctctcccccactgcagtccccagctcagctgtaactcccccggagtcaccccagtcggattccctgggctccacctactccatcaatgggctcctgggcatcgctcagcctggcagcgacaagaggaaaatggatgacagtgagtgctgggacaggagggcagcgggcggtgcacgagagcagtttgctcaggctttgatggggacagaaacccttccacttatgatatgggactttgtaggggctctgcatgtgactgtcacatgtcctgtccctcagttggccaaggctcctgggcccacgtggctggccctttttctccctccacagtgagtcagcttggagtcagtcctctactttggcctagagcatgaatagataggtcccctaaaagctttcttccttcccggggggtaccaggtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccgtctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggagatgaggacctctcctggggagatgagggctgccaagtcctaagacacaggctcagggtctgcaggaaggtcggcttgttggatcgtctctgtgcgctgacttctctttgctccccagggcctctacccgctgcccttgctcaacagcaccctggacgacgggaaggccaccctgaccccttccaacacgccactggggcgcaacctctcgactcaccagacctaccccgtggtggcaggtacaacgcccggagcctccctggcaggtggagggcgggggactgaagagcttggctggctgtcaggcggaaggtgtggggccctggcctggagaggagaggcgggctgtgccggccgggccgccaggtgggcccaggggtcgcgcctccggtcctaggccgggcctcaaggtgggccgaggggtcgcgcctccagtcctaggccgggcctcaaggtgggcccaggggtcgcgcctccggtcctaggccgggcctcaaggtgggccgaggggtcgcgcctccagtcctaggccgggcctcaaggtgggccgaggggtcgcgcctccggtcctaggccgggcctcaagctgggccgaggggtcgcgcctccggccctaggcggctcccgtaaggtgggccgaggggtcgcgcctccagtcctaggccgggcctcaaggtgggcccaggggtcgcgcctccggtcctaggccgggcctcaaggtgggccgaggggtcgcgcctccggtcctaggcggctcccgcaaggtgggccgaggggtcgcgcctccggtcctaggccgggcctcaagctgggccgaggggtcgcgcctccggtcctaggcggctcccgcaaggtgggccgaggggtcgcgcctccagtcctaggccgggcctcaaggtgggcccaggggtcgcgcctccggtcctaggccgggcctcaaggtgggccgaggggtcgcgcctccggtcctaggccgctcccgggtctccgcgctccctcctgtgggagaggcgggcgcacacacgccttccgggtctctccattttcgctgcagaagcgcagcagggaggtctagcttctctctccccgccttgccacgcctcgtgggccccggctctccccagcccagactctgagggcagctgagcctgccccgcgccccgcccgcaccctccacatcccacggcttggcttgtgcgtgttccctccccgccatctcacacccctctctccttgttgtctccctccctccggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcaggtacgacagggaggtcccggggccatgcagctatggcggcgggtgggacgggggtcctcagggcagaccgccagccccctctctggcctcagtctcatccacccccaccctgttccctaattcctccggcaacttttggaggcgccaacatgaagttctctgtgacggaagacatgctcggaaggggcggatgctgtaggggtgccggggatgcaccaccccaagaccccatggaaaagcaggaaccctaaggccgggagccgggtgctgtaacgtagcaacttggccttggtaaatgcataaatagatagaaggaaaaatgaacattttggagggaaaaaggaattggcttttggagcccatttctggatcaaatttctaaaaaggccaagggtcagtcccagttgtgtttccatgatgcagctatcttcattcctagcttaacagcatcaccgggaggacagtcagacatctgttaaacatgataaattcagtgattcaacaacttgagaggagtgggggacctcccatcaggaacctcaactgcctcaaaatatttaaagctggaagcaccgaccgggcgaggtggctcacccctgtaattccagcagtttgggaggccgaggcaggtggatcacaaggtcaagagttcaagaccagcctggccaagatgatgaaaccccatctctactaaaattcaaaaaattagggggtgtggtggcagacacctgtaatcccagctactggggaggccgaggcaggagaatcgcttgaacccaggaggcataggttgcagtgagctgaggtggcgccatggcactccagcctgggtgacagagcaagactccatctcaaaaaagaaaaaaacaaataaataaaaataagtaaatctggaagcacctgagggagcctctagatcaaacctcttatgctgatgaggaacctggcccagggaggagaaggtccctgccaaggtctctgggcaggagcaccatctgtagctggttgaggcctgggcctgcactgcatgagtcagacctcaaggggagctggctcctcctggcagaaggaccttcgctcatccagccagggcctgaggaatggctgagagtcaagcgcttggcttgggttggagagggcctgagatgcagtgaaagtgggaagcagagacccatatggtcttcagatacctcaagggcttccacagggataggactattttagatgtgggcccagtgggggcccaggaccagggaaggaagccagctagctctcagttcagcattggaggaatctctttaatagcggcactgtctccaaggagtgtgggtatttagtgacagaagtaaatgcctcttcacctcccacaccctcctaccccgacgaccttgaaatgctggagcagagaccagtgcgtgggtggggtgtgtgagacctgtcacagaggcagcccagagtcagacagtccatctggaccagtggtttcaaatttgggcctctcaatgctctcttgaaatgaagccttttacagaagacatgtatgctcaccagacccctgaagaactgctcttttagaaggggtccctgcccctagaaagcccttggacttcgaaaccactgcaccagaggattaagacctctacaagcccagagtaaccacagggtcatgtgataaaagtccctggacccttttttttttgttttttttttttttgagatggaatctcactctgttgcccaggttggagtgcagtggcgcgatctcagctcactgcaacctccacctcctgggttcaagtgattctcctgcctcagcctcccgagtagctagaactacaaatgggcgccactacacccggctaatttttgtattttcagtagagatggggtttcaccatgttagccagaatggtctcaatctcctgaccttggtccgcccaccttggcctcccaaagtgctggggttacaggtgtgagccactgcacccagcccatggacccttttttataactggctctacattttctttctggctggcacccgggttttttttttttttttcctccgtacatcccagcacctaatgtgagaagtttccttagaagagagggacatccagtgtgtgggcagagagatggtgtttaagggtctaaagcgaggagttgacttggagttcaagaattcaagagggtgaaggcagcagagatgggtcatttgttttgaccaaagtgatgaaaagagcaaaacctgtgagctgagtaaaattatgtcagccagagaaaatgggatgcggggtagggaggggaatgagaggatagtggagaggaagggaggggaagggaagggaggggaggggaggggaggggagggggtgaggagaagaggttcatgtcagttacagggagttacgcaagcctgcatgtcttctgagaatggcaggctagagctggcggcggtcatggggcaggcaaggggtgagggtgtggtggtgcccatgatgatggggagcaggtgctgtggaagccgcggagaagcttggcaagaccagctgaaggagagggaaggatgtagggcagctggaagtggatagatgtatcagagtgcagacataggctgtagtgtaaagtgcaactggaacagcccagggcaaactccctactcccaaagcccctacactttgtcccctccctgtcatcctgttagcatcccctgtcaacatgcagtcaatcagaggtgacgcctccaactactgtcagctgttaatttagtggacatgcccactctccaggccaactgcaggactgagaggtcacccaacccatgggacaaaacagctggcagcagacaccaggtagtcatgtaggaagcaggcagccaaatatgcagcaccggcatatctttcaggctggtggcccccaatccaggcccagatgatgctgaagtgcaggtgtgagcactttgaaggttgctggctggtcacagggccccctagcccaagggttgacaattcagcacagaggcagaggctctgaaaagagtgaggagtgctagccttggaggatctggggtccaggcaaatggccaagagtaggaagcaagtcagaaagcagctcaggcacaagggaggggatggctggtgtccatgctgagctcagggtgttggcctggagctccttacagactgtccacctgaggcctctggtcaagactggatctcaatacctaacacgtggctgagccatggtgagagagctgggaggacatgacggggggcggtggggaaggttaggaagggaatggttccaggagcgcaggaggctgcagaccttcccaagaagaggtgaatttgaaagaaagagaaggaacctgggcccaatggctcacacctgtaatcccagcactttgggaggccaaggtgggtggatcacctgaggtcgggagttcgagaccagcctgaccaacatggagaaaccccatctctactaaaaatacaaaattagccaggcgtggtggcacatgcctgtaatcccagctactcgggaggctgaggcaggagaattgcttaaacccaggaggcggaggttgcggtgagccgagatcgtgccattgcactccagcctgggcaacaagagcgaaactccgtctcaaaaaagaaaaaaataataaagaaagagaaggaagttgaggccacattattcctaagtaatgctgcagaccaggagagaggagagaggacacagtgagttttcattccataatcagctcagctttaacccgcgtgaatcttccacatgcctctgagtgactcccaaggaccctcgctgccgcctcctgcaactccttcactacttcatagcgtttttctctgggtcacttatttccgcctggtggctctgatagtgtgatttccaaggtgactatccttctgagtctcagctcatccccagtcagccaagaaagaagaaacagcaaggtttggggaatagcaagagtgcccctaacattgctgccagttccctttggaagccccagtctggagtcccaacacactggccaagacagcaatgtcgaggccgtcctggtcccagctgctctgggactgcctccagctcagctcaaaggaaagccatgagttaggttttatcatcaaagagtccattcccctcctccatccttttgtacaaaattatatttagttctgccaaagagatttctgagttgccataaattctccttgctatcagaacgagataaggaattgaaaaggggttacatggagggcagacttcaaagggggaaaataaaatagtctgaaatcacctctaccctctgaattcctccaggcaatagctttatgattctggcctctaccaatatttagaatatttaccaatatttcaaggtgtagggggagctagagttttcttagagaactccacggccagtcaacatgggcctatgctttctgtcaacttcctaaaataggaccacgttggaaagaaatttgggtgtagaggagatggaattcatagcgaggatcgttttatgatgaagagtcttaaaaacagagaagtaggtaagagggcatggttaggccgtgatggagtttccaccccacagcttctgtggttttgtttctaagaaggcttgcaagcttcttggctttttggaagaaactatgcatttaagcaattggagcaaagagttttgtagggctgttgggagagtttattgtgccatagtctgggtgagagccatgctgaagaaagtcttaccagtctttccaggaagaccagctttcatggcaggaagcctcaggcgtctgttctgatgtccgattcagaagcctctaccccattgggaagacattaggtgactgaggggagatgaagattaaaaatcgtagagtacaggggagtgagactgatgaattccatttataagatcaatgtaggggctagttctcatgcggtggagccccgtgggggcacctctggaccatattaagctgtgttgtaaggggagtatatgccctggaactctgcctgctactctgccaggctcgagaggcagcaggttcaggtaatagaacgagaaggaacaggatgaaggcagggggaaggggagtgcggggccacaggctgccaggccagaagcagccctgcagggcacaaggccagcaccagcaaacaggtgacctgagagtcaagaccacctcccactgctccccaccccgatcatggcagacacaggctgcctcagaatccttctcaacactgggtgccaggaggtccctaccagccaatcaggtagtcaggtgaatccagtttacaagctgaaatctaaactagttccttatgtgacaggcaggaagacgtggttcagagaattaagtggctgtctttcatccagggtccagcctggatctggagttccctttctctctctctcatggaggaagaggtagggagggaagagaaaagaaggaagcaggcctgaatccgccaccaccttcttccatcactccctccctcaccacctgtccctgctctgtgctcctcctgctctcacagacttcctgtcactccttccctcttgcctagccggtgcttcatctgagggccaagggggctgagtttgagggtcgattgtgttgtattcttcttcaaagaaagctcagattttatctcagtatagcttctgcatatttctccctctgcgtctaaatatcttaaaattctcttttcccctcctgtgtttccagcccttcatttgttcccttgatgaccttgtgtcaggtaaactgaacacacctgtagaattctagtgggtttcaccccatttggtccagtgccaagcacagctggacactgcaggaaaagtcaaacaaattagaaggtggtgttcaggtttaccaaaacattcacacggttttaaacaatgaacactgatggctctttattctgtaggagttcactggcatataaccatttctagaatgtgtccattgtgctaatcaatgtccacctgtagcatgaaaccctggctctgaattatgcagataacctcatagaaattgtaataaggtgcctacagctatgtttttttttccattttgcatatgaagaaactgacccttggggcacatactaggcttatctaagggcactcagaaaactagccacagaagcagtataaggactccaggccctctgattcccaggccctgccctctagaggaagggaagaagttgtgtgtgcctggtttttgttcattgaccccttgggcttggctccaaatgcctatcccagcctatgtcccttcttgatttagtgcccggccttgctaatttagcatcctggctttctgctatatacccaagtgcttagaaaagtgtctagaatatagtatttactcagtaagtatttagtgaatgaacactgtctttggggaatctccagaaagagagataaggaggaggtagtcactgcagtattggcaacttacaggctttcatggggccttccttcccttctgtcatgaccaggcaccccttgaaggggctgaggtatgaaggacctgggggggactgatgggtggatagttggacaagcagtgccatagaggagatgaatttggtaagttggttaacagggctcacaggtggcccacacaggtcctgggaggaaaaagcagcccccaaaatggaagaggcagaaggcatttgggtaaaagagtcatagtccaacacaatggttcttagccagcagcgattttgcccttactacctcctgctgaggacatatggcaatgtctggaggcatttttgttgtcacactgggtgaaaactgctgctggtatctactggatggaggccagaaatgctgctaaacatcctacaatgcacaggacagcctcctgcagcaaagaattgtgcagcctaacatgccaatgttgctgagactgagaaactctgtaaatatcaccaagaactaggaagagcaaataactcattattccaactggagcattttgagaatgaaatgggcattattaacaaatatgctgggatactggtcatcacctgggtacaccttggcaaaccagggtgtattgtcaccttgccaagaatcttggggtgaaggagaatctgattggggcctgcaggacacaggagcaatagaagaggggcaggggcaagggatcatgtttatgttcattgttatatgcagtagatggggagatgctcgccaggtcaggtggggcctccaaaatgggaaagtgatttctcgatgtagaggagaagcagagccgggaaatgaggtctttacagagctgatttggtatcaccaaggtgggggtatgacccacaagctatagataaacagagagattggtgtctgttttgctaaaaatggttcttttcaaaatagaatggacagatatgtggcttgtggtcatgtaaaagctaaatatctccgccacatctccttctaggttggggttagccaatcggtttcctgtacctggcaactctgatagattgcatccacttggaaggccccctctactcagggggaaatggtatagtggttgattagcaatgtctgtcacaggccccccaaaaaatagtgatgagttagtggcccacatacatgccatcccttcatagggtcttattcttggtactcctcagagccgggaatgaaagggatgagctctgagttaagtggtctcaaatgtatttatggaggccagctatacccactgctctgctggctgctgttgggggtaacagaaaacagaagacataacctcagcctccaataccaggacattcttgtggattaataagataacaatcacgtaaacaaaaccactggagaacagggaacagtgtgagactgcagtaacaagtgctccctgcatggtggagcctctgtcctgcagaagaccagacagaggtgaaaagaacttgggctcagatgaggagtgggggcaggaggaagtgggtttggagaatggctgtagagagggtgggaatggcatggaggaagacagcctcaggagagtgagatgatacatatgggagcccccatggtccaactgacgactctttgctgtatttttccagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaaggcatctgtgacccccatgccagccctaggccagcctctctggctgtgaccccagagacttggcgtatttacctaggcctgcttcccttccttgccggcaggagttaatctttgccagccacccactctgggcaccctatgcagaggcaggtgggctgggatctcctgggcagagggaagggagggagagaaagagggagggagaaatgctctgtgctccctgggaacctgctgagctggcacttgttgctgcctggttaccgtggcgatgtgcttaatgcagcgttgaaaatacagaatactgactcctctgtccctcctggccccggactccctccctccctcccttcctcttctggagcgtgaaatgagattggtcaagataaaaaaggaaaagattcggttatttttttaagagtgtggataatggggcctctcaatcaaaatcccagtctccagtcggttccccccattccccttccaacccctccaccttcccctgccgcctgcttagaggaggaggaagaaacataaagcacaaggcttttctcttaattatgaatcattccctgagggcaggcccagggcaaggggttcctggggcccagagtctgacctgtgaggtagctagaaggcttgagcctctcatcaaagtcccccaggttgtttccagaaagaatcctgagtgggttctgtgaaaaagaaaaaaaatagcacaactaggacactgactgcaagtgaaatccacaaaggagggaccttgccctacacagttgggctcccagtgagttccatgaaaatcagttttagaaaatgcaatactatttaaatgaatcacttggttcctaggaatggcactgtgcaaatgaattcttaaggaaatttttttgtggaaaaattctatgtccgtctcttaccactgcttgcaatctcccagttggttgaatggggactcctgcaattaaagtgaataaactttcatcgaacacctactgcattcatgttaggtacatgataaatgcttaaagcaaggcatgccaaagacattcatcaatcaattgtgaaaggaaggaagtgatcacttattatgtacttttgcatgtctagccattcaaatatgtataactttatttctaattttaccctgaccataagactaagaggctaatactatcccagttttatggataaggaaactgaagcaaaagcaaagtggtgtgctcagggtcataatcatactaagtggctgagttatgcaaacacggatttttcaatttcaagtctaaagctctttcctctacaccatactgcctcctaccataccagaaataaagacacaagctgcaagagaggagcacaggaaaagggctaggacagatttcccttgtctattcaccttctgtttctattttattttattttattttattttattttatattttattttattttatttttttattttattttattttattttattttttgttttgactccattaacagtcaatgattctcaaccagttctagagcagaaccagcagctccagacacatggatccatccagtcatctatctttccactcattcatcttcccatacatttttccacgcatccatgcattttcccatctatccttctatctttcatcatccatcccgtcatcctccacctttccaccgatccttccatctttccatccatctttctttttttttttttttttttggagacggagtcttgctctgttgcccaggctggagtgtagtggtgtgatcttagctcactgcaacctctgcctcccgggttcaagcgattctcctgcctcagcctccccactagctgtcactacagggacccaccaccacacctggctaatttttatatttttggtagagacggagtttcaccatgttggccaggctggtctcgaactcctggcctcaggcaatctgcccgccttggcctcccaaagtgttgggattacaggtgtgagtcactgtgcctggtccctccatccatcttttaattcatctgtcttttcagttatctatcatccatctttccatccatccatctttccatcaatccttttatttttccatccatattcattcgtccattcatcttttcatagaactatcctttaatctgtctttccatctatcctttcatcatccattcttccacccatccctcctctcctatatccatcttttcatccccttttcaatctattcctccattaatctatacatctttctatatatacatccttttatctgtccatctttccatccatcttttcacccatccatcctttcatcatcaatccttccatcattcacactttcattcatccttccatccttccatccatttaccactttttcacttaacaaatactggttgaaggtctactgtataggatgctggggatacagcagtgaataagtcagattcctttattcctggagcttataacctaatggtgaagacaaatggacaataaataagtcaatgaatgaacataataatttattgtctgtgaagacaataaaatgggatgatgtaataaagagccacagggagaggagataactactttagattgggctgtcaggggaggcctctctgagaaggtgttcaaagtgaccattcaagtgataaactggggcagaccatccctggaccaaagaacagcaagggcaaaggacctaaggcaggaactagtttagcatggtagcacaaaattgtagtggctgggtcgagttttaaaaggctactctgatttctaggaaaatgaattgtacatagtcaagagagaaagcacaaagaccagttaggggacagttgcagtagttcttgcaagagatgacagtggcttgagttagggaattagcagtgaaggagggaaaaagagaccctgaaaatatattttggttgcaaagccagcaaaccttgctggtagattggctgttgggatgagaaaatagaggaaacaagaatcatttgtaggtttggggcatggatgatggtggcaagtatatatatggcagaccaggaggggaagtgatgtagtagatggcaagtggaaatcaagagttttttgggccgtgttatgattgagatgcctactaaatgtccagttttaataagtcagcaggtacatcatgtgtgtctgaagccaggaaagaatcctgactagagtataaatttcagccattgcacaaagctgtcatttaatgacaagactactagaaaccaagcctggggttcttcaacaatttagagctctaacagagaaggaacagcaaggagaatgagtaggaaagacaactgagttacaaagcaaacagaagactgggcatcacaaacccaaaggcatgagacagggatgagctaaaaggtcaagggaattgaggatatagaagtgaccattggtatgatggagttagagactgtggggacttgaggggatcagagttggcctgataggaagggataagaaggtgaaggcagagaccatggggcagagaaaggcactggtagctagagaggaatgtggggataggaagaggattttttaaagacagaagatagcagaatatgtttgcagggtgaagggagagactgatgaaacagaaaacgggatcattggagcggccaaatccttggaaaggtgagtagggtgggatgcagagcaaagaggcagggttggcctttcatcggggcagagacgtttcatctgctgtgactgcaagcaggtaggcacatctgatgacgggaagatgccacacccaggtgtgtaccacctaccgagctccatcccctgccccaggttccatgtgactgaggtactcggtaaatggtagttaaatacataaataagtgggtgagtgagtgaatgcatgaatgagtgacaaaatgagagggtaaacacatcatgttttccacctctctcccttgtcctctagagctcactgtgtttgccattgggtagggtgtggtaaaaggtgagagggcccttgctgtgtggccagtagagaatcggctgaaacccgggagacctgagttaaacaggaggcagttggcactgggagatgcaagagagagtgccattgtggaaggacggggccagggttctagttctggctttcactgaatatgtgaccttggccaaatgtctttacttccctatgtcacagctgtgttatctgttaaacagatgtttagagtagattatttcttagtttttcatctgttaaatagatgtttcgattagattatttcttaggtttttttttctttgcttttttacttctttacccccttcctttttttacccatgttttttgcttgatttacgttagacttagtctctgcccctaaggaactttcttactgtgttctcagtccgtcattgacttcctagacaaggagaggatccagtagcctttctctgctttaggctgctcctcttcatctctcttcttcctgtataaatgcctacttgtctggcaataaagcagctcccactaaccccaacccaggccttaagactggttggatgactgatttaagcctccattgagctttattttcgcacctgtttaatgggaaaataataaaagcttagatttattgagcactccctgtatatttgaagcatggtgctaagcatttaatacatattttgtcatttaattctcattaaaccaaatgagatagggataattatttggcccattttacagataaggaaaccaaggttcacctgtaagtcactcactcagagaggctaagtgacttgtccaagtttacataaccaggaaatgggaagtaaggatttgactctagacaggtcagctccagagtcagggagtttcgagcaacccctccaaagagtctggggaaggagactcagaaccacatagctcccaatcgtaggtgagtttctgaaaggctgggtggacattcattgagtctcagggttggcaggaatctagctttgtaaatggaattatcgcataagtgaataaagggattatctgcaatttggagtcaagagccctaaggtcgagttctactctgacatttaacaacagtgtgatttgaggcaaactgcttaatcatgctgcactccagtttccttttctataaattggtagtatccatgagtacctcatggggtagtcttgaaaataaaagatcataatgtatgggaaagtgctttacaaactttaagctctttaccaagcaccggtagtagctgtggtgatcagtttgactttgtttttgttatgtaagggaattcttaagtaatttcttcggtaaataattcctttggaaaactcaagaatccattaacagaaggaggtgatctgatttactttgtgtaaatttatacgttgagtttgcttaaagcggcagactcaggatggaacaacaaactactccaagtcccaggacacagcttcctgagggtgtgtgccctctggggctctccctcctctcccatccttaaccctcacacctcccctcagccccccatgcacacaaacacacacactcatacctagcgaggctaaaaggttcatatatatggatgtcctctttggcccctaaccccatacccctgctgtggggccctcccagaagagcccttctccagaaggtccaggcagcagaaggagcagttagtccctgggccctacactcacagcacagtttcccagctccaccaaaccctccagctctgggagcttccgcagatcccagaggctcagtttcttcatctggaaaatgggggtagttataacatctaccttctgggcctcctgggagggctgtagtatgtcaagccagtgcctccagtacctacggaaaaggacactgccccaaattttccagatcgatgggttccaaaagggatgacagagggaccttctgagctccattgtccctgccgtggctccaactgtctcccccaccattcctgagcttgcccattgccagccctgcagaccttcccacaccccagccctgcattgatgcccttcacctcacaggcctctcccctgtgtgcctccaacaggaagtgaatactctggcaatgcctatggccacaccccctactcctcctacagcgaggcctggcgcttccccaactccagcttgctgagtaagtccctggggctgcccaggcctctgctgggcaggatggatggagtggtggggggcaagggtgggtcaaaggttacctgaaagctgggagtcctcagattatacagagggcctgggagatggtgctgtttgtgatggaagaaggcagcaggagggcagtgtacctggttgtttggggaaagagggcagaagtccagaggcttccaggcattcgtttccctcctgcttctcaagcccatgtcttttaaatctttgttttgtgtaagattcagggctcaggccttgaaggggaggacaagggaggacttgagaaaagcctaagagaggacctcctgcctccacggcttacagtcccacagtgcagacactgacgcagggcacccgccagaatgtaactgccctccttcctgggagccagtttcaagaatgccatcctgttgcccccattaaccatctaagtggctcagaaatactcatgattcagcaccaaacccttaaacagaaatcttttgttccaccacattccccatatttagcctgagatgaagacagtattcagggtcgaggtccagagagtgagcttcagcgagcttccaggcttctcttcacccctctcttgtcctggggtcctgaactgggaagagaagcttttcagcaaagcaaaaccccaccaatggggggacttgagggatcccactagagcctccctgagtggtggccttgggtgtatcagagcaaaccggagccagacagaagcagtgatccaaggatggccaaccccacaggcaccattgcaggctaggaaccatccattccccaagaccccctctcctcccattacctctttgtattccagaaataacttgaaaggtggcagacctgggccctgtttgccagatgagttcaactccaacccagctttccattcaatttagccagaaaagacgagggcaatgagacatgccagggttcaggcaccttcccactgagcctccccaggctgcccatcctgcaggtgtgcagagcctcaccttaagggccgtcaagcccagatcccctttgacccctcagcagtctaatctccctgggtcttaagaaagaagactctctgtcctggcactgtttgggcaaggctagggaggatcccaatgacctctcagtgcacttgattctttggggttccacatgcaattgttttctattgccctctccctattgcaacgagggtgttgaaggtcaaagcagccatagggggaaggggcaagaagccactgttctcattctggccagaaactcaaaggtgaggccagagaaggaggaaatagggctggagaggagttaatcttcgatgatcagataggccagagaaatgaatgattaacttgtgttgtcttaaaggtcagcagatgcagggaaggctatggtgcaattttcctttctgaccagcagtgttgttgttatttttttttaatgtgtccaggttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggacc

SEQ ID NO: 15218 - DNA, 32379 bp, Human; identical to SEQ ID NO: 15217

SEQ ID NO: 15219 - DNA, 32379 bp, Human; identical to SEQ ID NO: 15217

SEQ ID NO: 15220 - DNA, 32379 bp, Human; identical to SEQ ID NO: 15217

SEQ ID NO: 15221 - DNA, 32379 bp, Human; identical to SEQ ID NO: 15217

SEQ ID NO: 15222 - DNA, 32379 bp, Human; identical to SEQ ID NO: 15217

SEQ ID NO: 15223 - DNA, 32379 bp, Human; identical to SEQ ID NO: 15217

SEQ ID NO: 15224 - DNA, 32379 bp, Human; identical to SEQ ID NO: 15217

SEQ ID NO: 15225 - DNA, 32379 bp, Human; identical to SEQ ID NO: 15217

SEQ ID NO: 15226 - DNA, 32379 bp, Human; identical to SEQ ID NO: 15217

SEQ ID NO: 15227 - DNA, 9641 bp, Human
agtcaagaaataaaggctgaaataggttggctaagttacgtttttaaagacagctttatgacttgtgaggcaataaaactgcaccctttggagttatcttttctatcagacaggaataatgtgtaatttatcaatgttctcttagttcatggctaatttcacagagtctgagacctaattagtaagtcaagcaaagggataggtccagagagaacttattgttggtgaggcctgtttgataatgttttcatataatattgacagtatacacagtcatagtttcattttacttattatttatttatttattgaggcagagtctagctctctctgtcatccaggctggagtacagtggctcaatcttggctcactgcaacctccacctcccaggttcaagcaattctcacacctcagcctcctgagtagcttggattacaaatgtgcaccaccaacccggctaatttttgtgttttcagtagagatggggttttgccacgttggccaggcttgtctcatttcatcttatttctactgtcattccatttggtcaatttgtaatttaataattttgtacaaggcagtttctacattaattttatttttctgaaaagtgtctatcatattagtggcattatgaaaatcgtagattattttctgtgttttgaacaacttgatattttatttattcttgaacacttgtaggacctcttggctcatatgtctgaataccatttctttaaaatgtacgctttaacatgtatacatatgtaacaaacctgcacattgtacacatgtatcctaaaacttaaagtataataataataataaaagaaaaaagaaaaataaaacttaaaaaaaaaagtgtatgctttaacaataaattattaataaatagttatctgtgttattcaagatataattaaattgttttttgtgcactgacccttacctttatttcagatccatcacagagagtgcatggaggtatttaaactgcattaactgtttcacaattaagtattatcttatcaattaggtattcaagaaagatcacttacagaattatagatggcatgagctagattttactttctaaagaaataaccagatacatgagcaaagatgttaatacaaagatgtttgtcacaacatggttttcaatagcaaaaaaagagagaaaaatatataaaagacaaataacagtggataggtttcaataaataatgttacagtgatacagttaaatactatacagctattgaagcatgtcattattcatatttagtatggaaagatattttgctattttgctacatgaaaaaatgaggttggaaaaagtataggttttgtgaatctgttgtatgaaagctgtctatagttacatgtgtatgtgtgtggaggaaaaagtgttgtcattggttttctgatgatgcactcagaaaagacaagtattcacattttttcttgtggctgatctggattttcaggtttttctacaatgaacatgtaggctgaacattccctaagcaggagagtcccacctctaacatctcctgtaggcctggcaatggcaggcaggaaagacagaggaaggaaggagggagaagggaaggagtgaaggaaggagtgaaaaaggtaaggaagaaagggaataggggaggaagggaggaaatgggaagggaaagaaggaaaggaaggaaagagggagggaagaaaggaagggaaaagggagggagtgagtgaatgaaagatggaaagaaggaagaaagggagggaggcagggaggaaagaaagttgcgcttcccttgagctgccatgggcactgactcttagggtctgaaagcccctgagatgcaaaagcctagtgctcacaaagagctggaaagcctcaaggaagttcttcaatatttctggaaggaaactgtctccagaagcttccctccccacgacagataatgagcagcaagtgcttctggcgacttagggtgatgtgaaatcacgctgggaatcctgctcctcctcaggtcctggcagtttcagggcccctccctaggccttacttaaaaggctgaggcatccttggaggaacaggcagactccacagctcccgccaggagaaaggaacattctgaggtatgctctggggcgctggtggtaccggagctctctcctgaccccagacccagaatctgctccgtggaggctgttcacatgctggggagctcggtgcagctgcttgctccccagaccccagccaactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcattgctcttagagttttcccagcctttttcaaataggggcaggactggggcaggccatctcacaaggggtccctgatgctgagggggacaagtgaacctcccagtctagagctccagccaagtctatccaaggtgggaacgggggccaggatccctgctcagagctccgccattgtcccccatcacagtgaatggatgtaagctcacccactctgtgcccctacctccctgctactctttggggataataataaaacaaaaaccattaccatcagtcagtctgtccacccactggcatgtaccaagccagacactctgccgtgttctgggcttaacaacagaggatgagagtggtcctttctctcagtctaataaagcacttcccacgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactgaggttttctgaagtaaggcaacttgttgaatcgtatttagctatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcatagatggggcaagaacctagggctctgactcaccgtgcagcttctcttccaacaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctgatgtttcagaatgaaggactcggcattgaaggtgctttatctgcataataaccagcttctagctggagggctgcatgcagggaaggtcattaaaggttggtgatgaaacatgacccactttccttggtctctatacactctcaggggagggggcctgaagagggcttagaatagtcatacagattagcataggcctacagagcccaggcattagggcagcacaaaccaggctctaagcaaaggcaaataaaatactacacctctcagcaaagtgaagacacacgctctggggccacctgaagcttctgtgcagaagtgggaatgttttccaagaggcttgtcttgtcattcccttacaggtagatttaggtcaagcattgcattccctgggagccagtaagtaccaaggagagaactaacgtagattctctataccttttttcccatatgggagtgggtttctgcctctccaccctgggtcccctctgctctctgaagatcctcagtcacttagagtggagggacccagagaacaggtggcattgttggacctcctgcttgctcactctgccccatgcactgcaacaggtccctctctaaaatagtttgcacctgcccacctggggcacccttgctgagcacagatgccaggtagatccttcagctaggccatatgtgtatgtgtgtgcttactggtgtatgtatgtgtgcatgcaggcatatatgtgtgagcatatgtgtgcatgcatgtatctgtatgtaaccatgtatgtgtgagtgcaggtatgtaggtatgagcatgtgtgtgtatatgtatatgtgtgcatgcatgtatctgtgcatgtatgtatctgatgtatgtgggtggtgaggggatgtacagagaggaatgagaccctcttttgctctcagcaacatcacagggtgtagaaagttgtccaaacaattccaaaggggggcttattaagacagggttcagaaaaaggcctgagacccaaggggcattaaaggagggggttgagtctattttgggttgtagaggcttgaagatttgaccctgaactagagggtggagtggaggtggtacaatgtgcttccatgccttgatgtccactctgggccagtggacaggagaagccatgtcatgacagctgctgagaagcctcccttctgcccagcctgggggcaggccgtctcacagcagtcctgtgccctagagcccaggacaggggaagaaggagggaaaggcatccagggccctgcatctggcctctttcccacaggtgaagagatcagcgtggtccccaatcggtggctggatgccagcctgtcccccgtcatcctgggtgtccagggtggaagccagtgcctgtcatgtggggtggggcaggagccgactctaacactagaggtgagacttggggcatcctcactggggactcagccacagatgctgagcctactgaagccgggcagcccacagccctggtgctgtgggacaccctagcaggattctgttgatggcagctttgcctcctccctaaggatcctgcccagccctccctctgcccctgcttctgccctcacctgacctcccctcctctgccggcagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaaccttgtaaaaaccatgtggggtaaactgggaataacatgaaaagatttctgtgggggtggggtgggggagtggtgggaatcattcctgcttaatggtaactgacaagtgttaccctgagccccgcaggccaacccatccccagttgagccttatagggtcagtagctctccacatgaagtcctgtcactcaccactgtgcaggagagggaggtggtcatagagtcagggatctatggcccttggcccagccccacccccttccctttaatcctgccactgtcatatgctacctttcctatctcttccctcatcatcttgttgtgggcatgaggaggtggtgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttatctgtatttcctaatttttctacaatgaagatgaattccttgtataaaaataagaaaagaaattaatcttgaggtaagcagagcagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagacgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaatgcatttgttttattattgcaattttctccaatattttttattttctttctcacaatgaacaactatccttcatttacccaaatattctatttaaaagctaataatacagcatttgttgagtcatctggttctgcaagattgagatcctcttgtcctatgtgccaggaatgaactccagtgtccccacccaaaccctggggaatgggagcagaagccagaggaggagcccatatctgagccccaggtattccacctgcacttcacctgttggaccagcttggtggttgagagtccactgaggcactggcaaggaggtggccaggacagacaaggctgcctctatggacctcacagctccagcccagattcagctgaagtcctcaggcaacaggcagcacagctcctaccccaggcctctcagggctgccaagaacatgagctccggatgctaggctgtgtttcagaccctgttcacactctctttgtccatgggcccagacacagtcttgtgctgctccctctgcttttgggtcctccatccatcctctctgcctagataaatctctcatctttcaataccctgctaagatgtcacctcctccaagaagcttttactgagttgagacacccccagctatctgatctggcaatgtttgtatgcacctccctgcactgtagtaccttaacttggagtctgtggcccctgggatgaccttaaggttagggacatataagtttgtctcttagcaccttgcataatgcttggcacataatggaaacccaatgagtatataatgtagaaactatttctccaccctggaatattctctccttctcctccacccatctaaacaggcccacctctaagggagcagcttaaattccacctcattcttgaaggtttctccagcctgaatttgttgcttcctcatttgtaggatgacagaactcagaagagctttagccatgatgagccgacacaagtcagtagtaaaagaaggaatataaaatgcctccttcaggaatgtacaggctggacatcatgactctacaagtgaaaaagagttagtggctttagatttctgcaattttggtataaatcactggcctggacctgtatttacagagatgcaatactcacatcatgtggggtttgtacaaattgcagacatcgaggaacagagaatgttccaagggcaggctgtagggaagaggctacgatgtgggaggtattatcctgaaaaaagcaatgcacagggagccctcttcaagcacttaaaggcttgccaagtagaagaatgtgcttgttctgtgtaattccagaacacacaagcagaaccaatgggtgcaaattatgtggaggctgtttttcctatatgacccccatattttaaccacaaggaccacaaacattgatagggtttcttcaagaggttgtgtggtccctgaccctggagatgttaaggcagagcctaattaaccaatttctcagggatgccatagcacagatttctccaattggagggaaactatgattccatgtctatgagatggagtttcactctgtcgcccaggctggagtacagtggtgccatcttggcccactgcaacctctgcctcccaggttccagtgattcccctgcctcagcctcctaagtagctgggcctacaggtgcatgccaccatgcctggctaatttttctatttttagtagacacgaggtttcaccatgttggccaggctggtttgaactcctgacctcaagggatctgcctgccttagcctcccaaagtgttgggatacaggcatgagccaccatgcctggcctaaagtcctttcaattctaagattttttttttgcccaaggagcttatctgccactattgtttccaacatgtccttggcccacagcttagagagtctggtcttcttaattatcttttcaagtgtttatgacttagttcctcagctagactgtgaaactacttaacaacaagga

SEQ ID NO: 15228 - DNA, 4587 bp, Human
cattctaattcacatatttctgaacattaaaactggtcacactgaattgtatgccacatgagcctcagcccacggggaggtcctggagttctgggccaacatctgcttgttttttccatcacagttgggcaacccaatggtttggtggagaaaagtagagccttttgaggggatatatgaactggtggccactgagaagtgttgttccttggccacctccctgtattgagacccctctcaagtggaaaaaagtagcgaaatgcaaatttccagaaaggttctttagtatggagcaacattttcagactgtctacttaccatctatctttgggctatatctcttcctatatttccataatgcgtacatatagagagagatataagtataaataggggtagtttgtacatttttcaccctgccacaaataaacaaacaatcaaatttcaaggaaaaacttctctgttcctaaaaagcctggctaatgagatattataaaatgctttgctttttagacatcaaaaagatatcattctgaaatttaggtaagaaaggtattaggggttaaggagaaatagctcaaaaaaggtcatcagtttcttggtattggagttgtctgaaactgacacctattaataaaagatttttcccctaccagagtgggcaagaaaaacaaccataaaagtggcctgcttagtaacatgtagtctttctaaggttcattaagaaagaatataaacatataaaaatcaagaattggttcctacagcggctgcatatcatatagattagataaatgacttataagcagaatcacaaggtttagaaaataaaaagtcttaagtctacaaattaggtctaatcaaggcattgatatcctttacaaaacacctttaggagacattgctatgaagatatctaatttaatactgaagtacctcatttttgagtcaattccacaatatgtatacctcacaaaaattatacaattaaaacacataagttctcaacttaaattattgcttgtttacatataaattggattttatgtaccttacaaaacttcggcttagtcagcactgctaaaaaacaaaataaaaaacacatggcagaggttaaatctgtcgtgatatctgctatcaatttaaacacactggcgttttctcccattttggaggccagagttgctggggaacagaataaacatgcttccaaagcaggtatccttagctcgattggtatcaagccttaactttgctcttctccttgccagtaaatgcattttttttttctgaaattcaatacttagcaattggtaagtggctggcaaaacatttaaggaaataaagggcttacctggtttctgtagcttatattattttttaaaaaaggaatgaaaatagggagtatggggaatgagagaggggaagggaagagtcaggctgacagggaagaagagatgctgattcaagctgtctgatcaaactaaaagggacttaatttagaaatgaaaattatttcttctcaattcatgattcaggtgaaccagtttggttttaacaaagaaaaaacaaggaaaaaatatttgctaatgttaacagccctctcacaggctccttttcatctgttcagtaactggagactctttccaacatggtctttagagctttctagagatacgactgtgactttgttggtcttcacgcactgggtgtgtctgtaaatacagcgctgtccacggtgtctgtcctgcttccatcccaaattcaggctttagcttaaaacatctttagtttaattttttaaaaaattcttttctttcccccagataaaatcttaatcttttgcactagactgttagccagggaaaacaaagcaagaaaccagtgtctggaaccgaacaggaacagaacaagagcatggttctccttaaatacatacatttaaatacattcaatctgacatgggtatgaaatttgcctgtcaacatttacttttgcaggagagatctaagttgcactaaggtgaatgcagtgaacagactgagcgactgtctggatgcgagcttcagactgtcaagagaagaggcagctcctcctgccacagccgagtggacgccaccctgggaaccagggccaggcctgtctgctctagcagaaccggctggcaggtcagttgggttgaaacaaatagacacagctctccagactggaagtgttttgagcaagtgagcccggtcagctgaagaagcaactggcttcagcagtgtcagcaatatttctgtaggaaaacagataaaaagttgtgaaacatctttgaggttttgaaaaaaacatcataaagcccaccacaaaaacatcaaaattcctgactgttttcaataaagcaaatcacagaggccgcatctggatgagtacattcgatgtggaggtgaacaggcagagggcgccattcctccctccacacaacgcttccaggagccaaggaggagcccagcgaatcctacatgctatttctcgcaggccatcgtctgcaaatggatgatgaatctctccttaatgaccgctctccaaccaacaacatcctagctcaatttcatttctcccaccttcaataaagatgacagaacaattcacccagctgctttttggcagcatccgatccagaaggggccactgcttcctaattcttcctcaaattcatccagtacaaacccttcttctataaaatggccctcctgattttccctaatcagatactcccaaggttctctgggtgtgttctccctggcttcagcaagctagatcatgatgggttttgactcctggggttttgtatttttagtagagatggggtttcaccatgttggccaggttggtctcaaactcctgacctcaagtgatctgcccgccttggcctctcaaaatgctgggattacaggtgtgaggcactgcacccggcctcttggggtgttcttgctggtttttggctgctatgtgctgatgatgtgaatgactgaataccaaaggttatagtgagcaaattatgtggcgttgtttctttggttggtgcaaatatatctgtcaatgattttctttggctaccgactatcttccttccaaaagttttcattcacttagcaaatattaattcagcatctattacatgctaggtgctgggatatatccacaacaagacattcttggtcactgctatcacaaaaattgcccgactaggcaaggctgacaacactggagattataattgtaccttgctacaaatcaaattattacaaataacaacatgatctgagtttggttagtggaaatactgtctgctttgggaacaattgcttctgggatttagatatttagacacagaattctagcccatcagggccattagaaattatctaatttaagtaagattagagaggaagccagctccaaataatctattttaccttagcactccaaaaagagagttctggggaaagtattgccagatcatgagttctagtggccaaaggtggaattacattagcccctgatcaggtgcacaattctcctaagcttaaaaaatgagcttagaatacctgtgattttacttctcagagaagaacatttagcatactttataatataaagctgaatagatatgtattcctaacttgtgtcacttttatgatttcatataaaaacactccatggtgctgattaaaatatgaaaaaccctcaattttccagttagtctagaaaaagtctactgagaagtatttatttatttatttatttatttatttttgagacggagtttcgctcttgttgcccaggctggagttcaatggtacgatctcggctcactgcaacctctgcctcccaggttaaagcaattctcctgcctcagcctcccggagaagtatttatacctattgcgtttctgaggcttagaaactttgtaaggcagtattctctggcatggactaacatcaatgagcagccaccggccagaatcagtttgatgaaggagaatgctgtgctccgcacacacctctggagtcatgctgcctggggtgtaccctggctgtgtcactttaggggtggggtccattatgtacctaatacttctaggatggttgtaaggattaaacaaaatgatgcacatgaagtgtttaaatagttcttggaacatcataagtgctcagtaaatgtcatcaccactatcaccatcatcatcaactaaaagccgaccctattagtaatcaattttcataacactagtaaatacaagtaattacaagagaaccatgctgctgagcagtaaactcaattttaatctatttaaatatatctaaaatataaagaaatactgtaagttcttataaaaggaagaatcttctggttaggtcaaataactgcccttctctaaatatatatttttggtaagtcaacggttgtacatactagctctgcttaaagcaaggtaccattataatttccaattcaagataaatggaacagtcaattaaaaatggatgacagggccaggcgcagtggctcacacctgtaatcccagcactttgggaggcc

SEQ ID NO: 15229 - DNA, 26174 bp, Human
ccatgtgtctccagaagtggaaagtataccttcacatctctgcctacaggcaaaagaaccagttttgaagcctatttctcttgaatagaatttcaggaagttcacagaatcagataataagagttgggatattcatgagaaagttccgttgagcataattctactcattgctcttttgagctaattcccactataatctctgctgtgtgttgccaagttcctgtacctcttattaggtaaaatgctttgccctaaactccttgcagattgtgcctccctatgtactagaaaaataagattacattcttactacagcatgcaaaaaatagatgaatattcatcaaattagagaagattttaggatggactgacaaaagctacaaattaattctggaggctccctaaggagatggcaaataatcatccagagcagctgaaactgttatgagaccttactatccatgttgtgttactatcatggcttgtacaggaccaacatgccatgatagtaagacaacatggacaaagaaaacaagcctcaaatataatattttaggctaagtgctgcacattgcaggcattgatttaaaaaaatcttagaattggccggggatggtggctcatgcctgtaattccagcactttgggaggccgaggcgggcggatcatctaaggtcaggagttcaagaccagcctgaccaacatggtgaaaccttgtctctactaaaaacaacaaaattagccaggcgtggtggcacatgcctgtaatcccagctacttgggaggctgaggcaggcgaattgcttgaactcgggaggcagaggttgcagtgagttgagatcacaccattgcattccagcctgggtgacagagagaaacccctgtctgaaaaaaaaaaaaaaaaaatcttataattttatttttttgagatgggattctcgctctgtcacccaggctgaagtgcagtggtgccatcttggctcactggaacctcttgggttgaagcgatttttgtgcctcagcctcccaagtagctgggattacaggtgcccacccagctaatttttcgtatttttagtagagacagggtttcaccatgttggccaggctggtcttgaactcctgacctcaagtgatccacccgcgttggcctcccaaagtgctgagattacagacgtgagccaccgtgcccggctgaaaattttaaacatatattcaaataacaagatgggtataatgaatttcatttacctattaactgagcttcaacaactatcaatgcatggtccattctgtgttactgaaatccatcgccctgcccaattatttttgaagtgctaaatgccatttcattaaaaattttagtagtaagcattgatttttaatccattgagttctcatttaactgcatatagtgtgcatgtaggtgagtagtagtagcgacttatttattattttttgagacggagtcttgctctgtcacccagactggagtacagtggcgcgatctcagctcactgcaaactccgcctcttgggttcaagcgatttgcttgcctcagcctcctgaatagctgggattacaggtgcatgccaccacgcctagttaatttttgtatttttagtagagacggggtttcaccatgttggtcaggctggtctcgatctcctgacctcgtgatccacccacctcagcctcccaaagtgctgggattacaggagtgagccactgtgctgggctagcagggacttatttaaaggtgcttaaataactaacaatgctataaatggcagcttttattttcatgtagtctagttttataatttggggggttttacactcagctttcctcctgattggatttttggtcctggaaaggtgaatccgtgtctgggtgttaattttcctgtgcactgaaagaggaggttgaagtcattagatcatcgttgaggttccattcagctttgaaaggttctgatctgtgaacctcatcatgtgaccatgggttggcatcttggccagtaagttctgacaaatattcatatgtatgttaacctgaactccaggctctgagttttcattggaatttgaatttccctgatctgggatttgtcattcccataattacatccctaaaccagtctgattttaacttctgcctggatactcttattttcctgcatattgcagctttgtttcatgtatctcccatcctcaaagaccactaaaggccttttgagaatttccctgcccagctttcaaggcctcctgtaatctgctctcatgctacaaaatcaactgtattttccacttgaatccaaatttcataactaatgctacaaattgctaccccagttgatccatatatatcattttaaatataagtaacttaaaaattttcagaattttacaattagtgtaaatttgtgacccattcaaaactgaaggcaacaaatcagtgtgttgcgagtgactgataacctactgaaacactttttttctccccagttggctgaatgtaaatcataataagccaatcagtcaccagtctggcattaagcccaaggaagaggctattctttgtccactccttgggtgttaaaatagcaaatagctgtgaatctagaggactgactctacactatcacaaaaagcccagctttcttttcactcaatcttgacagtaggtgaattaatggatttcttcttcttccacgttaataggcaactaagattctttaagttccagggtacgtgtgcaggatgtacagatttgttacataggtaaacataagtcatggtggtttgctgcacctatcaacctatcacctaggaattcagcccagcatgcattagctgtttttcctaatgtgctccctcctgctaccccaccccgtgacatgccccagtgtgttgttcccctttctttgtccatgtgttcattgttaagttcccacttatgagaacatgtgatgtttggttttctgtacctgtttgctgaggataatggcttccaggtccatccatgtcccttcaaaggatataatcttgttcctttttatggttgcatgatattccatggtgggtatgtgccacattttctttatccagtctatcattgatgggcatttgggttgattccatgtctttgctattgtgaattatgctgcagtgaacatacgtgcatgtgtctgtgtaataaaatgatttatattcctttgggtatatacgcagtaatgggattgctgggtcaaatggtatttctggttctagatctttgaggaatcagcagggaactaagactcttatcactgaaacctgtggccagctgggagggcacaaagtgatacatgcacttgctgtgacccttttaattccagtggtttgagtaacactatggtaatattggaagacacgccacagtgcaagtgtcagtcatgtgatgtgtatgcgatcattagaagtgacaggaggaaatgccaggctttgacttctgcacctccgcccaggcaaatgcagaggtatgtatggtgtatttatggtggctaagctaaatatgaaaactggttttaatggatgaaatgtaaaaactctaggtgtattccatactggttacctaaatgagtactctagcatctattataactgactcaacttcagtcagcctgaaatacctgtcccatcacagaaatggtctcccactaaataatgctgacaaagctctaggtacagagcacttcacagtacagagctatgtttgaagtttgggctgggcgcggtggctcatgcctgtaatcccagcactttgggaggccgaggcgggtggattacctgagctcaggagttctagaccagcctgggcaacacggtgaaaacccgtctctactaaaatacaataaaccagtcagtcatggtggcatgtgcctgtaatcccagctactcgggaggctgagacaggagaatctcttgaacctgggaggcggaggttgcagtgagccaagatcgtgccactgcactccagcctgggtgacagaacaagactccatctcaaaaagggaaaagtccgggttgaagtgcatattctactccaatagcagttttctagtctgtgcgcctggcatacttgagtttagtaagcatttgtgaaaatactattcaaatgttagctgtaatacaaaataaacatacctgaatgattatcctgccctcttttgggaggaaacatgtattactgcctctgttctcaaaaaggtttatattctgtccttgattgttttttcatgtacctagagctttgctcagcattatttagtgggagaccatttctgtgatgggacaggtatttcaggctgactgaagttgagtcagttataatagatgctagagtactcatttaggtaaccagtatggaatacacctagagtttttacatttcatccattaaaaccagttttcatatttagcttagccaccataaatacaccatacatacctctgcatttgcctggtatgcatttgactatgtaataggtagtagtggaggttaggaagggaacatggaaatacatgcatagaatgaattggaagatgaaacaattttattttctttgtagggacagtctatattggccaggctggtctccaactcctggactcaagtaatcctccagtctcagcctcctaaagtactgggattacttacaggtgtgagccaccagtacctagccaaagttagttttaatgtgagagtcaaggactacagtggcatgctgaggtaacaactgcaggagcatcgaggtaacagcaaaaatcttttactccaattgggtcaatccagttaaccatgtaagaaactcctcacctagggtcagtatgttacttctgtatttctgcaagcacaatccactgacataaaagtctaataattagactttattgtaagtctaatgtatcttgtacatgataaaatgtatgaactttggatcaatatggcaagctgaagacacctgtcatgtggggggactattttgtttgggtttttttcccccttcctcatgttacctggtctaagaaggaaagttttttggttttgtttttgctatgattgtctaacttttcctaatcaagttgtacttgggtttttttataccaatgattaactttggttttgtattttaaaaagcaagggattttcttaaaaaattccatccagagtttggttttgcccctgctgatgctttcatcaggtaaagttacaactgacaaaacatgactttattgaaataagcattctgaaagggcatcatgttccttgcaaaggaaatgggaaaatgcattatctaatatcttcatattgctaccttaatagcttcaccagttattactcagagttttaaaatgagtttattaaagaaggttcttaggaaggcaacaacttttgtccttaaaaaaaagttatggtttttcatgctgtataataaaggtgatgtaagaggctacagagttacaagtttctttctactggaattctctggtatagcacagtgtagtcatttctgcaattctagaataaataaaaagtctcttctatgcttctcttcaaaagcaatgaataacagaagatggtgtaaaaaagtcatattttttctattcattctgtagtattggagccagtatctaggaaacaaaagagaaagtaaagtaaagtaaattcaaggagcaatttaattttacaattaactattttaagactatcaaaaatgagaacacaggactaatagtggtggtggcttgcagggtggggaagaacaggaggaaaggtgacactgtaaatatgttgaacttcagtaagtttccttttaagcagagatacaaacatgcttagctcctcatattcatactagagtaaaactaagttgaactacatttggttcacataattgttacataacctttcttcccccaggtcctttactgtcccaaattttttttttttttttttgagatggagtctagctgttgcccaggctggagtgcagtggcgtgatcttggctcactgcaggctctgccccccgggggttcacgccattctcctgcctcagcctcccgagtagctgggactacaggtgcccgccacctcgcccagctaattttttgtactttagagacggggtttcaccatgttagccaggatggtctcgatctcctgacctcgtgatctgcccgcctcggcatcccaaagtgctggcattacaggtgtgagccaccgtgcctggcaatttttttttaaagacagagtcacactgtgttgcccaggctggagtgcagtagcgcaatcccagctcactgcaatctccacctctcgggtttaagcaattgtcctgcctcagcctccgcagcagctgggattacaggcgggtaccaccatgcctggctaatttttgtatttttagtagagatggagtttcaccatgttggccaggctgctctcaaactcctggcctcaagtgatctacccaacttggcctcccaaagtgctgggattacaggcgtgagccactgcacctggcctactgtcccaaacttctaacactgcattcttttctgcagatacaaagtaaatggaatacaatttaagctttccttgagtcaacaatcttctcactaaagatcaattactacaccgtgctgaagtgtgagggaaaatcctcaaaaactactgcaataaacaaggccaatctgctacttctcatccactgaagtttggaaaacaatcttgtatagtaaagagaaacacactctaaggactaccagacaggagctcctatcagtaaaatacgtatctttacatggattctttgatattatacaccagtatttattctgttcagaggctttatttactgattttctggttctcagctatggttcaaatgtatggttcaaatgactgaaactgacactctactagtctacatctgttctgtccaatatggtaaccactggctagccatatgtggctaaattcaaattaataaaattaaaacattgagttaagttcctcagctgcccatacccacatttcaagtacaacagccatgagtggctattggaaaatgcaacagaacatgtccgtgctaaaaaaaagttctaagcagtactggtgtatgtcattaattcattttgatagagatctaggtattataaattaatccctgaattctacagactaataaaaataaatataacaagggttacgaggatgctgttaccttaaatatgaaaaaaattgtacacaatttcaaatatagaaatgttatcttgtgattcaggaaacagcaccaccttcacaggaatttaaaaataatgacaaagatgtatctaatgactataataaaaagttaactatgcccaaagttcttagaatgattattcctaggtaaccttctgaactataacaagtccccaacaataacgctgctaggttcagagactttctgatatctggaagagactatttctttaaaaagggcttaaggtgtaattttatatagctactaaaaatcaggcttaagtgcaggggctcacgcctgtaatcccagcactctgggagaaggaggtgggaaggtcacctgagcccaggagtttgagaccagcctgggcaatacagcaagactcttttttttttttttaaggcttaagattaagagtagtaaactcaaaaatacatttactaatgtctacatatacatacatttttgcaaaaaaaagttataacaccatcaggtagtgttacagagaacgtttttcttccatgtgcttttttgtattctctacattttttcagtgattgattgattagctatttctttggaaatgcaaaatatataaaacaaatccgactcaaacagggaaatggagggggttactttctacatatctttctcttgcttttcaaaactccctgtgtcaaagagcagcagtcttttctatttactttctggaatagctgctcttaacacaaatggttcagattatgaagtatatttaaaataatataattagcaaaaaggaaataaactaatcatgaaacagaaattaggtgtatagtttttgaaacatttaaggacctgaagaagttcctaggtctggtgtgaaaagttcacttgcacatgtcatatttaacagattagatgaatatttaccatcatgactccaaagttcttatggctaattaaaatcctgtttaaaataactctttaaatatatgggtctccagcaacatagaaaccataggattgtaaaaattactccttaaagtaaaaggtgtctgaaaagcctgataaacacttaaaatttgtaatggaaatagggaacaaatgcttattaatttgcttattttacccacacaaatccaacctgtgtaagcagtctatatgttattaagtcacaaagtaagagcactgtttgagatatgtaatcagaatttagtggagataaaagcctgggcttatctgggaattgatcatagggccattttacccgttaggcttttcatatggatgcagatcttctaaaggctcataaaaacaaggtttcaagtagctttcacagaaataaggcaagcacttacttttaccatcacaggctacaattttcactttatccactttaataagttctgtcacctctctgaattcaacatcattcagtacaaaagtccacacattatcgcagaatctgtacgtatttagagagccctttaaaacaaaacatttagaaataccgtgaaacgttttttcccctcacatttttctccaaagcaatttaagagatcttagctaccaagaacataataagtttaatgcttagcttaagattttccttaactttaatcctagctattaaaaaaacaaccaccagacaaatttgctaagggaagatttcaaaaatattttagttggcagactgtatttttagtctgcattgcaaattacttacctgaaatatgaagaaaaaataaaaacttgcgtttgtatttctattgccctcatgtggctaagttatgaaagttcattcaaattatggaaatatttgttaaaagttacatattttattgtgtatgttaattctccaaatgtacaaaagcagggatttcttagaaacactaaattttaatcctgtgacttggctcagatgcattactgcatcggtcactaagactacaacattcattgtcttgtgcaacttataattttttatacgttttcattttatttttttgagatggagtcttgctctgttgccacgctggagtgcagtggtgcgatcttggctcactgcaacctccacctcccaggttcaagagattctcctacctcagcctcccaagtagctgggactacaggtgcctgccaccacgcccagctagtttttttatttttagcagagatggtgtttcaccatgttggccaggatggtctcgaactctgacctcaggtgatccacccacctcagcctcccaaagtgctgggattaccagtgtgaaccactgcgcctggcctatataattttttttttttttttttttttttgagacagagtctcactctgttgcccaggctgcagtgcagtggtgagatctcggatcactgcaacctccgccacccaagttcaagctattctcctgcctcagcctcctgagtagctgggattgcaggtgtatgccaccacgcctagctaacttttgtatttttagtagagacagggtttcaccacgttagccaggctggtctcaaactcctgacctcagatgatctgcccgccgtggcctcccaaagtgctgggattacaggcatgaatcactgcaccagcctattttaatatttaaaaagaaatagagacagggtcttgttatgttggccgggctagtcaaacttttggcctcaagcaatcctcccgcctcagcctcccaaagtgctgagattacaggcgtgagccaccatgcccaggacacattcttataattaagaaaaaaaaattgtttaaagtaggaatatatatatacttgagcatcaaaaggaaatttttactttttttttttttttttttggagatggagtctcactctgtggcccaggctggagggcaggggtgtaatctcagctcactgcaacctccacttcctgggttctagctattctcctgtctcagcctccagagtagctgggactacagggcgtaggccaccatgcctgtctaatttttatatttttagtagagatggggtttcaccatgttgtccaggctggtctcaaactcctgacctcaggtgatctgcccaccttggcctcccaaagttttggaattacaggcgtgagccatagcacccagcctatttttatttttttgagatagagtctcactctgttgcccaggctggagtgcagtgctgtgatcttgaccaactgcaacctctgtctcccaggttcaagtgattctcctgcctcagcctcccaagtagctgggattacaggcgtctgccaccatgtcagacttatttttgtatttttagtagaggcggggttttgccatgttggccaggctcgtcttaaacttctgacctcaggtgatctgcccacctcggcctcccaaagtgctgggattacatgtgtgagccactgtgcccagccggaaatttttaaaaagaatgtgatgaaagtcgtgcatagacaccaacagaatacaattaaaacctgagatatacacatgcacacatatagtcacacaggaaatttagtaggcaacacttaaatgcctaaaatcttcaactcagaaaccaccaagcatgaaaatgctccttgcaatattattgtaatagcaaaaatgggattcattctaaatagtctatcaagtgagaatgactaaggaaactgatagctatgaatgaatgaatataataaatgagtaattactgtgtgctagactatgctggcctctgaggatacaatggtaagcacagctccctgccactggtgagctgagtttagcagggagatcattaaaacaggtaaatacgtagtataacagtgctatgaaagagtaagttactgggtacaatgagagtacagcaaaggcactcaagagtatggaggacacaaggcagagagcttctctcaaaaagtgaagtttaagttgagtcctaaagaataagtaagagtcaatggagaggagggataatggaaaggaagacaaacacttggaatggggtggttgattccagaaaacagaacgtgtcaggaggtcctaagataaaggagaaccttggaaaacctttgccccatcctaacggtactgggaagtcagtgaaggatcttaagcataagagtctgatcagatttgcatttttggtgatgacataatgggttagacaggagtatgactaaaggaagtaagaccaactatgaagctgatgtctgttagctgggtgaatcagagaggtgaaagtggctttactacagtaatagtatagtaaagggatcaatagaaatggagagacttttaaagtaggaccggtaggaatggacaactataaatatggtggggttgggggacagagaaatccacggtaactcccaagtttctgacttgaatgtcaatgcattcacagaaaaagctggttggggagtaaagttaaatttggaacttgttgaatttcaggtatatctaagtcatgatgtccaataagtaattggagtataggagaaagcatgtgatcatgatattcagtttaaccaaagccagagggttggatgagaccaaggacagcggacgcacgctgtaaccctaagaaataccaacaattaaatgataagcagagacagaactacagaggagtctgagagcaacaggccagggaatacgagaaaagctcacacagtatggtttcaagggaaataggggttcaaaaaaacaatcatcaatagcactacaaatgatgcattagatttagcaaaagtaactcggcaacagcaatttcagtggagtgataaatatactgaaagtcacccatgacgttaagggaaaaagacacaaaattgtaagcctataaaatatatttaaaaattagatctcctcgtttgctacagtctgaacctctggaaagctaaacagctagatgccaaactcaacgttcatttccagcatcctgaagttgtgtgtaatccacgatcttaagagtgtgtatattactggccgggtgtggtggctcacacctgtaatcccagcacttcgggatgctgaggtgggagggtcactgaggtgaggagttcaagaccagcctggccaacatagtgaaaccccgtctctacgtaaatataaaaattagacgggcatgatggtgggtgcctgtaatcccagctactcgggaggctgaggctggagaatcgcttgaacccaggaggcgggggtcacagtgaggcgagatcacaccattgcactccagcttgagtgacagagtaaggctccgcttaaaaaaaaaaaaaaaagtgtgtatattactttttttgttttgagacagagtcttgctgtgttgcccaggatggagcacagtggtgtgatcttggctcactgcaacctccaccacctgggttcaagtgattctcctgccttggcttcccaaatagctgggactacaggaatgcgccaccacacccagctaatttttgtatttttagtagacacgggttttaccatattggtcaggctggtcttgaactcctgacctcaagtggtctgcctgccttggcctcccaaagtgctgggattacaggcatgaaccactgtaccttgccttactttctcttttaaaaaatgtgtagtcttttatccctcgccaccctcccaccctttccccaaagttcccaaagtcatatcattcttatgcctttgtgtcctcatagcttagcttgcagtaaattactttcattggataatgttatgtaaataatttaaacaaagcaagtccttgggatttatgagccagtatgtgagtattcactttcaaatataaagcattttagatgtagattggagtgaaaaatcttaaatatcatatgctgaaattccattagttgcagtataaatgtatatgcttcatttattttaccacaaaaataaaatgctacaaaacttgactgaaagatattaaagtatattaaatgccttccaactgtaaatgaaaattgacaattaacatcatcaaagtgcacattagctacgtaacttctgagccaacaaatgtttttaaaaaggtaaacgtaagaaataatataatctttttagaataatttgaattagaatctctaacatgaaataagcttttctgtatataatttttacttatttaaatatcttgctttttcactgatttgaaagtcagaatccatttagtatcttaagtatagtataaaaacgatgtttatatatatgtatatactatatatacatatactctataatgatagaattacaaacataatatatacatgtctttcatatatataatttatatgcgtgtatacatatttacatacatatagttttctgaagcagtgtctagctgtgtcacccaggctgaaatgcaatggcatgatcatggctcactgcagccacaacctcctgggctcaagctgccctctcacctcagcctccccagcagctgggactatgggcacacaccatcacacccagctactttgtttgttttgtttgtttgtagggacagggtttcactatatttcgcagactgctcttgaactcctgccctcaagtgatcctcccaccttggcctcccaaggtgctgggattacaggcttgagctgcagtgccagataattatacttttcaaagtgtaattttagatttattctttaaattcaaaaagtttcttctataagatatttggctttggtcaaatattacttttaacacttaatcatttggccaaattgtatcttcaatgcacttttaataaatacatttttggttttacatgtatccacaatggggcaacatgtttttgtattttttttaagatacagtctcactctgtggcccaagctagagtgcagtggcgcgatcttggctcactgcaacctccgcctcctggattcaagcgattctcccgcctcagccttccaagtagctgggactacaggcatgcaccaccatgcccagctcattttagtaaagatgaggtttcactgtgttggccagtctggtctcaaattcctgacctcaagtgatctgcccaccttgacctcccaaagtgctgggattacaggcatgagccactgtacccagcctaaaagaacatcttaaaagttatataataaatgtttgttacagaaacatcaaaaaacagggaaaaggaaactttcagttttgttagaagggctatttttcttgatcactaaatcttatttttggggggtgtggcattaaatcttttaacgcttgttaattactgttcgaggctcaacactataaagtaaccattacttttatctatgggcatatgttctcccaaaaccatacaatggctctttaaaagcctagttatggccgggtgcggtacctcacgcctgtaattccagcactttgggaggccgaggcgggcggatcatgaggtcaggagttcgagaccagcctggccaacatagtgaaatcccatctcttactaaaaatacaaaaattagctgggcgttgtggcgtgtgcctgtaatcccagctattcaggaggctgagacagaagaatcgcttgaacccaggaggcagaggttgcagtgagccgagattgcgccactgcattccagcctgggtaacagacttcgtctcaaaaaaaaaaaaaaaaaaagaataaataaataaataaaagcctagcctagttacaaatactacttcaatctgaattttctccctaaaaattaattaagttcaagctccatggtacatatgagttttttactaataaattaaaacatataaatgattaaaaccttagctctcatacttaagaggattttctcctataacactctactaaataatttcacttatattgaacccataaaaggatttaaaacaaaaaacaggccgggcgcagtggctcaagcctgtaatcccagcactttgggaggtcgaggtgggcagatcacgaggtcaggagatagagaccatcctggcaaatacggtgaaaccccctctctactaaaaatacaaaaaattagccaggcgtggtggcgggcacctgtagtcccagctactcggggggctgaggcaggagaatggcgtgaacccgggaggcggagcttgcagtgagccaagatctcgccactgcactccagcctgggcgacagagcaagactctgtctcaaaaaacaaaaacaaaaacaaacaaaaaaaactaaaaaacaatttaacatgctatataggattattctattcttgtaaaggatgcttactcattgctaggtcagcaaattatacataaaaaatatatacctaaatttgatctagcaaaatggctctgaaaattaggtatttctaacacattatcttttgtcttggccatatgctacactaagctaaacagaatgttatttgcaaacattctggatttaaaattgatcaagttggctgtaacccaggagtagggtgataaaaagcgtgagttagaatagtagcagcaggaaaataaaaagcaagaatggaaaagttctgatcaaggctgagagcaattatttatagcttttcgaaaatagacaaactcacaaaacactatgcaagataaatgtaaatgtcaaattactttaactctagctaaagaaatccaaactagaaacctacaataatgcacctagaagatgactagttaggccttgtgaactatcttgcctctgataagtagtccaccaaatttcttattagagcaaaatttatgtattaacatggatcatctgggcagacttctgcatatgggtatataaaaaaacacaaactaattttggcagaatcattactgttaaaaattcatggatccactggtcaaattatacagtcttgaaggcatattttactccagataattttttggcacatgaaactgatatatgagacttatttatattaatataaaatacatggagattttatccttcactaaaatttaagtcaaatggggctttgtctatcttgttcatctctgagtatctagaacatgcctggtatgttatcttttcatctctgtgtatctagagcatgcctggtatgttaacagacactcaaattgtttactgaatgtttaagtaccaaatgaagtaggcagatgttaactaatgatcaaattttggttgtaaccatattttaaccttcttttgactatatttctacaggttatgccttataatacaatataaacataaagttagataaataataagcaaacatcatcatatattatatgactccatcaataccataatgtggtaaaattatttctgttgcaccatgactctttcaatgggcacttaatctgaagttatcaggaaattgagagagataattttattcagctttggatgactactgttcaaagtataagtgactgaagtgagaccaagctaccagaatagactgttatctaccattagagatcaggtttttatcagccaagttacctaagagtcggagggaggcaacatgaagtttctagaaataactctacttccctggaacggggaaaggccagactttgaaaaccataacagaaccttggggattactccgccacttacctttaatcctgcagataatatttcaggtgtttggaatctcagtaactcttcagggaaggtagccaaacatacaaaggctgatttgtgaaacaatgaaataaaaatctaaaaacatctctgtatctcacattaagtggatcaacttagtttatagttgattgaaaagtataatttagttactataaaacaagttccaaaaattgactaagccacctcttcctcttatgattaataaatatgtaggggtcctaaaaaaaaatcagtgttttaacaaccattggtacaggcttctagattcaggaaaatatccttaccctgaaattgactctgttcctgaccctctgagccagtgctgcatttatagccttatcaaactgaagtagaacttgaagggcaagttggggggtgatctgttgagactgagaaaaggtaaaggtcataaatcccgttaaggaagaacattaaagacaaagtaaataaaaatatacaaattatcatctaaaatttaactgaggttaaccaaagcctctaaactagaattcctttatctcctttgccataactgatgatgaagcaccaagcttgaagacatcttttgtactatcttgacacaaacaatcttgaagagaaaacatgcagtgatgttacaaagccagaacaaaactttgtcaattttcccttacagtggctggaaaggagaagatagacaaagaggtgtttcttttaaatacacagggcctatattaacaaacaaaaaacctattaaattttattgaatctcataaaatataccaacaaatggaaatacttaatatgttttttttttttttccttttttgtgagacggagtttcgctcttgttccccaggctggagtgcaatggcgcaatcttagctcaccacaacctctgcctcccgcattcaagcgattctcctgcctcagcctcccaagtagctgggattacagatgtgtgccaccacacccagctaattttatatttttagtagagacagggtttctccatgttggtcaggctggtctctaactcttgaccttgggtgatccgcctgcctcggcctcccaaagtgctgggattacagtcatgagccatggtgcccagctggaaatacttaatatgtttttatttgggagaattatacagaagggttaattctcttaaaattgaaatataaattcagacttgtaaatctcagaagacttaaattgcacaaaactatcttaaagctaaaaagtatatgactttcttccctaaatttgagaagggggaaaccaacaatctcaatttttatgttgaacaaaaatttttgaagatttaactttatttatttagaggcaggatgttgctctgtcaccaaggctggagtacagtggtaccatcatagtgcacttaagcctcaaactcctgggttcaagccatcctctcacctcagcctcctgagtaactgggactataggcatgcgcccacaccgaactaatttttttattttttgtggagatgggtggtgctatgttgcctaagctggtctcaaacttctggcctcaagcgatccttccaccttgtcctcctaaagtgctgggattagaggcatgaaacactgcatgtacccagatttagctatatttaatgatatcattcaatcatgttttgtgtcctgttgtcaggacagtgtaataaacaagaatttgaggtaatttaatcagtgttactgacttgctgggtcaaacagtccaagatattttacctcatatctctttgcctaagtgatatgacaagaattactgtaaacccatcaagataaaaatgtttgatttttaattcagtctcccacctgtatgagctcatctaggctctcctgaagactgtttcccaaagtagtatttctgtataactgatatgccatggcttaggaggaagaatttgtttttcttattcaagcttgcattgatgtcctaaaaatttaatataaaattgttaaaaaagatcatactgtaacatcataaattatgtatataatatcatctacctcaaatattctaatatagaactaggagaacgcttagtggttgcacattactagataatcattttagaattacaaggaattgctacaaatgattttccagtttttttccccatgattttgacatgggcatttatactcctttatgcagtatagctgttatatttattaaaatgtctttaccatttccttcaaatgtctgccttctgacttagtctagaattttccatgtactgtcctttctacctgctgtcaagtcactggtaaaatcttcagctcatgtttgcatgtctgcccctttattttcctgttctctctaaattcagtatttacagagtgcctaccaagagaatggcactgtgacaggttccagagagaagatgatgattaaaggcatgctcccaatcctaaaaatttatactctagagaatgtaacaaacatacaaaaagataagaactgggataaagatacaaagcataccatggaggctgcctgtagaagtgagctggctcagaaaagcttccaggttctttaagctagactttagccaagcagaggagggaagtcattccagaggctgacagaatagaataagtaaagccatggaaggatgaaatgtttgtggggaaaaacataaactgttctacattatcagggcataagtacgaatagggagtggcaggagatgaagctgaaagagacagcatagatggagttgtttggcaggataggtgcaagcagtcgggagtcactgaagaattttaggcaggaaaggtcagacagctgggcttcagtgcgtgatttagaaacagatgagggatgggggctcgaaaagggtggcagcagtacacagtcaataaatatttactgagcttccactacacgtcaggtgtaagatcttgacctcatggccctttcagtctggagatggatgggggaaaatacatttgaggagcaatcatcagataaaactcagcaaaaataatggccagccatcagtccttacatttcacaccttgctagcactggattcaacagatcatttctgccttcttgaaacatttctttggctttgagacagcattctcagttctcatgtcactggataccattgtattttttattttcttttgctggttcctcctcagctccctgacttgtaactgttgaactgccctaagttttcttgggtcctctattttccacatactttactctcttagttacctcatccagacttacggctttaaataccatctactatctggtgatgactctcaaatttgtatctccagccctcaattctccctttgtacccatatataaaactgcctgcttgacactggataaaaatatcaagtaggtagctcaaattcaatttgtcaaaaaccatgtttctgatgctactcttgcaaatatgctctgtcctcagtcttacccacctcggtaacagtaaacatagtcttcctgtaacagctcaaaaacctgagtcaagagtaacttctctttttcttacctggcatccaatccatcagccaacctttcagctcgtccttctaactatagccagaatctgacagcttctaccatcttcaatgctattaccctaagtcaccatcatctgtcactaaagttaatgtgataactcatggtctccttatttccagtcttgcctatcccaaccccaccctcatagtagccacactaagactttaaaacataaggcaaatcacatcactggtctattcaaaaccaccaatggcagcatcccatctcagtgaaaaccacagagtccatggcttggaaggcctatgtgatttgggccccccagtgcctacttccctatcttcgcccactcaccctctcactctgctctggtcatactggtcccctgctgttctttgacaggggaagcatgatcctgcttgagggcctttgtggtggctcttctttttgctgacagtattctttccaaatacctgcatagttcactctctcatttggttcagatctctgggtcaaacattactccatcagaaaggccttctataatcaacctataagaaagaattaccttccttcttcctcacactgctttattttcattcataccaataactgaagctaacatatatatgcttattctgtctccatctactaaaatagatgacacactgaagacagggacttctgttcatttacatatttaccaactagaacaacgtatgtagtatctattaagtatctgttgagtgaaatacttggtagtatgttaaagtgctaatatattagaaatgtatctgagtatgacacaaagtattccacttcactgaggaaactgcagcaataacttccagactcacagccacatccagctacctaccaatagctatacaggttgaacattccttatctgaaatgcttgggacctgaagtcttttggattttagaatatctgcatcgtatatacttagtgattgagtaccccaaattcaagctctgaaatgctccaaagagcatttcctttcagtgtcatgttggtgctcaaagttttggattttggagcattttgaatttgggatgcccaacctgtacccatatactctccctccctgtcactatagttgaactctatacctatttttatctaaatccaatccttctacctttgtatcaggcattgtcttctaattcactcaaggatattgttctgacaattcagttgttacttctctccctcaccatcaaattttccctctctgcggatcatttccattagcaaacacataggtggctacttctcccaccttaaaaagtaaaacaaaacaaaaacccctcaacccaaatcccctgccagctacatcctatttctcagttcccctttgcagcaaaatcccttagttttgtctgtattcactgtctcccaattccttttttcctattttctcttaagctaatttttgcctctagcactctaaggaaacaggttggtgaaggtcatcaatggcaatgctaaagctaattctctagcctcactcagaatattggacacagctgattactccctcctctttcgtacaggatcttaccttggcttctgggacactgcccttttcggattgtcctaactcacaagttcatccttcttaatactgtttgctggttgatcccgttttcgctaaactcttaatatcacaggacacagtccttaggcctctgctgctttccgtctacacccattccttacggataacatttattctcatggtttaagtaccactgctgatgatccccaaattcatatagcatagaacttctcactcctgaatctagctgcctactcaacatctctatttgttatcttttgcatcgtggcttaaagaactccatacttctacgagcttgggcaaaacctttgatttcatcctccactccctctatctcactctccatatccaattcctagcaaatactgtaaggcctaccttcaaaatgcattcagaatccaaccacttctcaccatccctacggttatcaccctgacctgggccactctcgtcatctggattactgcaaaaatctcctaaatgatttccctgcttctacactcacccctacactctaatcacaactcacagccagggtgatcttctaaaacttcagttacaacatacctctcctctattcaaaatctcccatggcttctatcagcctttacaatgatccggctaccatgatctctttgactttatcttcttgtccctccacccccaaaactcttgctcatccctctccagatacactggcttccttgctattcctcaaacatgacaggcctaaaagcatttgtattggctttcctatctgcctgaatgctcttcctgatatttacttagcaaattttcttaattccttcaagtctttgctcaaataacacctactaaatgaggctcaaactgaccaccgtcatctttaaaataccagttcccacctccactctggaactttcccgtactcctttatatttctctttttttttttgatggcaccatcactttctaacaccattatatattttattttctgcatcctctaatagaatgtaagctccatgagggcaaagctttttattttgttcacttaagtaaaataggcgtctagaacagtacctggcacacaataggagccaaaaaaaaatctgttcagtaaacgaaggcaaatatcagtaagtataatatgcgtgtgggaggggagagggggttaaaaagggcaagaagtcccaataggtagataaaaactccacagagtaggaatacagaatcgtgcatcgtgtcccatttgacaaatttttgagtttatctagaaaatagccctgcgttaaacgtttgttaaaagtgctgatttcaatgttcttacattctttaaaaattccttgttaagtgttctaatcttttagatgtggtatcagccacagaaatttattgttcccttcttgttttgcagttcagaaaattagaagtcaaattcggaagtaactcgtcctagcattttttgattaaaccaccaagtttaaaattcgttccttttgtcggagttcgcacgaagaaagttggaaggcagacttcaaacaacaagctacaaagcacaggaatgagacatttaaaaaatgctctccgaaattcggcaaaactcacagggcgctagtggatgctttaagacattcacctggctgaaaatacggtggtgggctgaggacctcccctaggtgggttctgtgggcgccccgtgaacgacgagcctcccgccacgggacgcgaccatccccgccgcctcgccgcccttctccggtgccggccgcggggccttgccggcaacggtcggtaacgggcagatcccaggagcgaagggccctcagagactaccccaccaacgcactccgactccgggggggcggcagggagcgcggccctgcttccctccctaaccctgccctccctaacccactacctgtggggaaggcgcttccctccgcggagcggacagaagccgccacgagcccggcaggaggttcctacttctccgaccacctctccagccgccgcagaaaccgcagaactgagctgacgacccggaagtgctcgcggaacctggaagtgacaccccgcccgagggccgggaggccccgcccagccctgctctcgcccgccactcaagccttgtcagggaagggcgtggagagggaaggaggggcgtcgggctggagcttgaagccttaaagtggtggacaggcgctctgctcgagtaattcaccaggtttactaaatcgttcctaagggaattataatttttagagactaatcttctccattgttagatgcacaatttaagaaatgtagggcattcatatttcatgccggaagtgtgttcagggtaacagtgttgaagaccttgcagacgaattctgaaaagattatagcaggggccgggcgcggtggcgcacgccttaatcccagcactttgggaggctgaggcgggtcgatcaccggaggtcaggagttcgcgaccagcataatatggtgaaatcctgtctctactaaatacaaaaaattaggcaggcgtggtggcgcatgcctgtaattcgagctacttgggaggctgagacaggagaatggcttgtacctgggaggcggaggttgcagtcagctgagatcgcgccattgcactccagcctgggaaacaagagcgaaactccgtctcaaaaaaaaaaaaaaaaaaaaaaattatagcagggtaagcagggtatcttctttacccctcgaaacagggctgcaggcaaagtttttagtttgtgaccagttcatgaagaactttaatttggaagaagttatatttaaaatttgcatctaatatgcaagataaatacttcactataaatttcaagtttgcaaaatcacaaattgttttaggtgtcagggtgcatggtacactaactggcttaaacccagcagtcatgtgtagagcagtttatcctacaaaatagctgaatagtgattaaagagtatgtgcaaaacaacaacaacaaaaccacaaaaaacaccaagtggtatcagctggaacctctgagcaggtctatgaactaaacaagttcttcttatttaagccatgttttcggccaggggcggtggctcatgcctgtaatcccagcactttgggaggccgaggtgagcgaatcacctgaggtcaggaattcgagaccagcctcaacgtggagaaaccccgtctctactaaaatacaaaaaaaatttcgctgggcgtgttggtgcatgcctgtaatcccagctactcgggaggcggaggcaggagaattgcttgaacctgggaggcggaggttgcggtgagccaagatggcgccattgcactccagcctgggcaacaagagcgaaactgtctcaaaaaaaaaaaaaaaaaaaagccatgttttcattttaagccactcatggtttcatccttggattccccattaattaaaaaaaaatctcaactatgaaacacaaagtttcattattgttttgatgttaaaataaagcaggctgaactctctaatccccaaagaatagaagcacttagactatagaaagggaaacaagtgtaaaggtctgaaattatttaagaggtttataggataattcaaagcaaaaatttagtagcataatgaaagaaaaatgtgataaaaagacaaagacgaacgttccaattaatttatttaaattcattaatgttgcaaaaaatatgatgtgcaacaaatcaagacacaagttatattcctaacaggtcaaagaaaatattacatctccttagtaaatcatgaccaactctggtatttcttacagggaccacattaatatcttgcacacacagacatcagaactgaatttctgacagtactaggctgggcaacatcatcttaagagtaggaaaatatcacagtacattaattttgtctaaatgacagcaatgaacctgtggtaacaaaagtatttttggaatagatatcaaagtgtgttaatgtcttaacaaactctgaattgtgttctgtgtgaatagtgctccaagggctgtgcaagtcagtggccctgaacatcatcaatatttactagctaggtttacacaaataaacaagcaactgttaaacggacattaaactttacaaagtccacatacaaaaagtgcagtgtagaagctgatgaatgttattttccaagttcctccttagccaa

SEQ ID NO: 15230 - DNA, 8084 bp, Human
tagtttataggttatgggtcatttgacatcacaaattttaaataatcaacagcatttctattaaattcagaaaaatgcttttgtaaaaatgggaatgggttggccaggcacggtggctgatgcctgtaatctcagcacttggggaggctgaggcgggtggatcacaaggtcaggagattgagaccatcctggctaacacggtgaaaccccgtctctactaaaaatacaaaaaattagcggggtgtggtggtgagcgcctgtagtcccagctactcgggaggctgaggcaggagaatggtgtgaacctgggaggcggagcttgcagtgagtggagatcaggccactgcactccagcctgagcgacagagcaagactccatctcaaaaaaataaaaataaaaatgggaatgggctgttaattaacttcttgtcattgaaagggagaaagcccaagttctgccttgtggaaacaggattagatgtccagtgttagaagtattccaagtttgagaatcaccagatatggatacctgcactcagaggaagttttacctatatgacctgttccttttaactaagatatgattttataattacttttttacttattttccatttttaaaacaatctatctcaaatcttgattctgatatgtctatgcaggaaaaaatctatcttttgctaaaaaatgcagtaacttaaaaaaaatcacaacttgaagggtatacaaagactcaaaatgaaaaatcagtttaaaagcaaacatgcttacatacagccaggatctaaagatcatgttgtaacaaaatgttcaaataattatattgctagaggaaactctggattttccttttagcctttgtaaaactgaaaataaaactaagatatgatattgaaaagactatctggggctgggtacagtgactcatgcctataatcccagcactttgggaggccaaggcggacagatgacctgaggtcaggagttcaaaaccagcctcgccaacatagtgaaactccgtctctactaaaaatacaaaaattagccagacgtggtggtgtgcgcctgtagtcccagctactcaggaggctgaggcaggagaattgcttgaacccaggaggcgaaggttgcagtgagccaagatcacaccactgcactccagcctgagtgacagagcaagactctgtctcaaaaaaaaaaaaaaaaaaaattatctgagccaaggcacagtggctcacacttgtaatcccaacactttgggaggccaaggtgggaggatttgttgagcccaggagtttgagaccagcctaagcaacatgtgaaaccgcgtctgcataaaaaaatttaaaaattagctgagcacagcagcacatccctgtagtcccagctactgggggggctgaggtgggaggatcatttgaacctgggaggtggaggctgcagtgagctgtgattgtgccactgcactccagcctgagtgagaatgagaccccacctcaaaagagaaaaaaaaaaaccccacaatctgaatgtgtcaattcacactcattcctaaggttcctgacacaaagaacataattctcatgaggaaaactgccacttgatttaatcagagttcaggggctttaatgggagttctggtccatgagctaactcctcccactccttggcagagagttgagggcagtgggagagaagcaccaagctataaaaagctttatgttttatttccttctaaggcatcctgagtcattgggtgctccagccccccagtgcccgggaaagttcagcttgaatcggaaatgtgtgtgtgtttttctaaaccggagctgctgaaaaccagatgatgtcacttggactgaatcccttacaggcccagtggtagcctcctatttccgtcctgggagaatggaagtcacttaacaatcagtttctctgacccaggttccaatattacatcacgtcttaatagcaagcttaacctccactccacctccaacatgaagctggtgagaatttttaaatcccatttgtcatctcaaaggacacagcactcctacacaattttgcctcccatcctttaggctgcaatttcatctatctaaacacaaagtgatgccaaaccaggtcggtcataatcctagaaagccacaggcagaaggtaccaagtccaatatgatcttaccaaggaggataccaaggcctgggaaaggtaaagaacctgcctgaggctggagggacagaaccaaatccagaagccaggtctaaagcctcagagcagagggccgtctccacggtgatgaccatgtccttatagtcccagctcctatgtgcaggaggggctctttaaatgctttctggagatgtgtctcaagccttctgtcgaaagcagggccttatcccgccccgcttttcagccctctcactccttctgggcagagtgggaaacacacgaggcagctggaaaaggcctttctggaagcaaagggggcagaagcaggcagcctctcctgctacatctaagaaccagggtctgggccagtgttgactaaggggaaggcttcaatgccaaggtcctaaattgtacttgcatcccaccccactttcctcagctgtcccgctcttgacatgaaccaaggtatcatcttggttgtcatctaaaattcccatcttattgaaaaaaatgtatttctttatacaagtcctaaagaggcttggattggggttaaaaggaaactaatccttatggtgtaaattttccgcataaaaagcaagcatggacaagttaataggctaagagaataggttaaaatgtcagctattaacactcaaactacttaaaactagggtaagacggttgtgggatgtgtctacggttatttctggcccctcactctcacagtactagagacccagtgaaattacatctgagggcaggtctatcttgttgagagcaaaaggaattgaaagctatgcaagctagaaacctacacagttcgcagttagagatgaaaggctgcagaaatgtttattgaatacagtgccaggtttataaataaaacgtatttacaatttccatagagttggtcccccatcagagaggtggttaaatctccaaacagtttatctcaagatttacagaaacgtccaagtacatctccttttcaaatagccatggtgaagggcaacttcagtaacaaaagaactaccaccatctttgctacagaagtgtttaataaacatcataatagatttggagaaagaacacacactccacccatgccactaccttcttactccaagggatacagacagcaaagaatttctgtctcctacaggacaacttcaggggattaaaaaaacagtaactgccagctggagggatagattaagacacattagtggaaatctagtcactgccaaaggagaaatatatttaggatatacaataaataattcaaatgcttaaaataattgaatgaacggaagagtagacttgaccaaatttacattcgttgttcaggaagagattcccagtatgctgaggggttcgtggtaagctattcctctgacgagacacagcagcgctgggcctactgcacagccgttcattacaatattgttacaagtacaatcagacatgcatttataaagagaatataaaaatatgtacaatagctcattttcaatgtgtgtaagttgccgaaagacaccaatgaaagtgtgcaaaaattcatttgtcaaaaaatcagaaaaagccttccttggcaacagtgcatcaaaagcccatctgaaatatcgagatccatttgcctcgctcaacacctaccccaaacagatggagaacaaaactatgaaagggtttgccaagtactcagcagtttcttatggcaagtctcaggctaaagcaggatgccagttcaactaatcactttatatataaatatatgtatatatttatagagtagttagaagtaggggcaagagtttacaggaaggtcctaaccaacttcaagggcactgccaggacacccagctatttcctctcacaaactcatgcagactaacacccaacgcctgggctggtcatccccccaaataccagggcggaaggctacagtggattctgcctcacctctgctcaaaactggaactcagcattccctggagggggagggtgtagggtttctggttcccagacacgatcctggccatacaagaatcctgtttcaaaggtagtcttttaggatacgctgcaggaccactaagagtccacccagcttctaaagacttgagggttagaaggctacatttcgaaaaaacaagtcaaatatccccctccagccccctttgaaactaccgagaggtcatcgaccacaggcctgagactgggtcagcaatcaggctctttgaccaccccctgccacaagaaatatccaggacattaacttactcaaaccaggaaccctatctcaccagaagagaaaccccaaggtaaccttaggcattcctttcagattcaggtaattacaaaagccaacccttagctcatagtgtcaacatctcctctaccaaccacccagcccaaggaccagtagcagaagcacatgggcgatgtctcccctccactgctctgacccacccctctggcagaaaatctaacaagctacaaaatgccagaaagacagggagtaggagaaggagaagccaagggtctctataaatcagccctgaatgcacccatttggctgccaagagcttctcactgccttgctagcagcctgccactgttccctggcaaattgaaaccacccacgcaaacactcaaaaccccaatctccttgctaataagatacaaccagttaacaccgtgaaaaatgcacatctccagccttcatttcaaaaaagagctctgtactaaatgcaatatgcttttaaagggggttttacagggaccaatctcaatgcaaagaccagtaccagatgtctgagttttggttacaggtttataattagacacaaaattcactccacactggagttttactttcaagctggaagctagcattagttctacttggggggaaaaaagcaaagtcaagtcaacttgggaaaaaaaaaaaaaggaggaggaggctaagtataatcataaattaaaagtcgcgaatcaaaggtgactggtagtgtcttttaggcatgaagagactggcttacaaaagtgactactgcttctaccacacacagcgaagattgaattacagacacactaaatcatgtctcttgcagatggtctcaagtagttacataagacaggtaatcagcagcacaattgagaacaacccctaaatacatgcttgagagaaagtgggttttttttttccttaagagctctactgcctgaatagatcattaaaagttaccataattcaccttcccccctccccccagtgaaaatgcaactagacctacatgtccataaataggatgaagcaatcggtatctgcttgttttcaggcaaggtcttgggctcagaggttggtgctggggccttgggagggaaacccaatgctgggctgtgggcatttacatgtacactggcctcccctccacctgccttgtccccatttagatctcagctttacaaagcatttaacaccactttaagttaatggtctttttattggaaaaaaaaaaaaaaaagactagcatttacaacttggaatggacgtaaactgtaatttctttgaacagcaatgttgatggttgtgctgaagtccacagccacagcctactctgccggctccaagtcatggttcagaaggttttaaaaacagagagtccaaagatgctcccttggtaaatgtttcttattaaaaatttgtgtgaacagtgacagcctgacacctgtttcactctagaacaatgcagacaacgctaaaccaacatacacgggcatgccaccagggtgtgtcatcgtcaccatgggtcggagcacacgaagtacaagaggaccatcctaccagtggggccacgtctcaacggtttatccttcacccatttttctgcacgtcatcctgaggtaaaccaattttaaatgtgtttgttttcagtaaaccagctatgacaatttatactaaacaaattgaactagaacccatttgaataggttttgaatttgttttttcatttttcatttttaatacaaaggcctgactgtgctcaatcgtcaagctgcatgcatgaaaaactggccagcccaaacagtgtattaatcattagcaaatggaactttaaggagtccttatcattaaggtagtacaagtatttatattgtaaaactgatgtgtagcttgatctttaggggacaggaccaccaaccaatacatgcagattttgtgtgtgtggacagaaggtacttttgacattcagttttgctatatagaaacagaatgaataaatgaacttttttcttttttcttttttttgcaagaggtaagtaaaagattcaatttgattcttctagaggggggaaaaaggagttgaaagtaggtcttcattttgcagtcatcatctgtacgaattctgaaaagacaaatataatagtaacttttggttatctttgaaaacagctttaatgaacacaacatctttactgtacataaaataaagtcaaaggctgtctagtgaagcagttggcttgcttacagatctaaaggtaagactatgaaacactgagctcagagaatttagttttaccttcatagttgacttgtccgtctccatcaatatctgcttctctgatcatttcatctacttcttcatctgttagtttttctcctaagtttgtcatgacgtgacgtagttctgctgcactgatataaccattgccatcctgtgaacattcagcaattgttattgctaatgatgtagtgtggggaagtaggtctttgacttagctatgccctctcaagttactgctaactctgctgccataaacaattctctgatctctagttcccacctctaacctactaaatacatgcaaacagctaatgcagaaaacaggatttgcaaaagctcacaacaattcaaagtaacagtcaagaaacatggtccaaaattcctatttattatgcctaccctcccctgatacggttaccataaggaggatttttgaaagtgagatcagaggctcaggcagttagatttaagtcttctgtctataacattattatagcttttagaagtgaaagcggaagaagccatacttaagtaccatctgctatgtagatgctggattaccttgtcaaagactcggaatgcctcacggatttcttcttcactatctgtatctttcatttttctagccatcatagtcaaaaattcggggaagtcaatggtgccattacctcgaattaaaaaacaaaaagctcatgtaaagtaagcactccattaacgctgctctgcagtaatcatttcagaaccactgtacggaacggtaaacatgtactaggacaaaggggcagactatcttactaggttcaatcatctgcaggtctaaaacgttcaaacacttcacagggcaatttcacataatttcaaactcatcatcagtgcccaggatagtatttaattatacaaaggaaactgcacatctggattcaagcccatggaagggtcatgaagggctgtacagttcaaaagaaaaatagcatacaccactccgcaggctgaatctttccactccgagggaagaaagcgcccccgactgccatccctgagttagggaaatcactcaggtctcactctgccttggttagtgacagcagtaacacaaaaaaggcctagaactgagctgcaggttaagtgtataaagtgtttcagaggagaaaagattatgagagaggaacattgattctgttatgccatgcatgggccatgaagtcttaccaagtcttctccaggatcatttcttggccacgctatgatggttagccacctgttttcttccaactcagtatctttatttcccattaagggaaaagctcaggagcattctcacagctcagactagtaacacttag

SEQ ID NO: 15231 - DNA, 75799 bp, Human
tggaggctgattatatgagtttgtgaaatggtttttggtatggactttcctaatcaaattatgtctagtagaagtgaggccagattttggcttgtaaatagacttgagttgggggagctgtacagtggatggtggctgagtaaaaacctagtatattggagaatttaaaagtctgtaattgatactttagcttaaggttattagttataaaatttagttctattgctagtaagaggcctaaggtggtcacacctagggctgtgagttttaggcgaagtggcatagttgtttagggggatgaagtgggaacaatattattggtaatgaggaatccagcgaagatactgccgattattaggtgcttaattgggttaattaggaaagggttatttctgttaataataatcagttgtgaagcgaggttgtcctatcagagcgaagaaaataatttgggtactatagacagctgttagggaggttgcgataagagtaatagaaagggctcaggcgttggtgtatgatgtgtttgcagtttcaataatgaggtctttagaataaaagcctgtgaggaaaggcatacctgtaagtgtgaggctgccaatgataagggaggaggaagtgaggagtagagtcttgaatagtcctcctatttttcagatgtcttgttcatcactgagattatggatgatggatcctgaacatatatagcttttaaaaaggcatgggtgcagatataaagaaatgctaggtgtgattaataccaattgtgactattataaggcctagttggcttgaggtggagaatgctacgattttttttttgatgtcattttgtgttagagcacaaattgctgttaataatgtggtgatgcccctacacataatgtaaaggtttggattcatagattattttctattaaagggtagaagcagataagtagaaaaactgtacaactatagtgctagagtggagtagggctgaaactggggttgggccttctacagtggaaggaagtcagggatgaaggccaaattgagctgactttcctgctgctgccaggagaacagtaattagtggaaaggaattgggggtaagatttagaataaatatttgttgacgctctcatgtgttggaaaataagaggaatcatgctatagctaaaataaagccaatatcgccaatcgtttatacaggaccatttggagggctgctgtattagcatctgctcggccatatcatcagccaattagtaaaaaagacacaattcccacaccttctcatccaataaaaagttggaagagattattggtggtaactagaattaatattatcgtgaggaaaatgagtaaatatttgaaaaattgattagtattagggtctgagtttatatatcatattgagaactctacaatagatcaggtaacaaatagtgccactgggataaatattgtggaaaagtagtctagtttgaagcttagtgggagttgaagagtttgaattgttactgtcagtttgagataattatttcttgatctatgaatatgtatattgttacagggatgaggctagtaataaagacacatgcaatagatatttttacgtagtatgggtatcaatcttttttgcaggggttggctaaggtagtaataattggtaagattaagggaactagtgtttttataatagtggtataataagagcatgagttagcagttcttgcatactttctcagtagataagaagtttcagacttctgttattagatccacaatctaatgttttggttatactatatttacagtatgcaaaccccataataatcttagggtttaaggataatagaaagataggtgcaaggtatataagtattaatgtattttcttgtgtaaatgagcatttaatactgttaatgtaatacacaagtgtccctcattgtgttgtgattagtatatgtagggagtaaagatctgtaattagtatattaagtcttataagcataatggtgatgtttgatcaagagaataaagccatagtgatgaagagttctattaaattaatagtagggggaaaggcaaggttagtaagacttgctaaaagtcatcaagaggctattagtggaagcagtgtttgaaggcctcagataagtaatataattcggctatggactcgctcgtagtttgaatttgctatgcagaatagtaaagatgaagtgactccatgggcaattataagggtgactgcacctgtaaagcttcaaggggttcaaatgagaatagccataataacaagtgctatatggcttatggaggaatatgcaatagtgattttaagtccgtttgtcatagacaaatagagcttgtcataactatttcccataaggatatgaggaaggggtaggctatatattctgttagggggttgagggtaagggtaagccgtataataccatagccacctagctttaggagtacctctgcaagtactattgagccagcaataggggcttccacgtgggctttggggagtcataggtgaagtccatatagaggtatttttgctatgagagtcataatacatgctagtcatataagattattagatcaggaagttaatagttcttgggtggtaaatattattattattattatgtttagtgaacccaaggtattttgagtatgggtaagtgtgataagtaggggaagagaactattacagagttttttctgtgggggtgactcattggaaaggtgatgttggcttgctagaattacaagaggtaataggttgttaagattagaaggggtgatgttagtgggtcagaggagaaagttagtgagaagttagatgaattatcatttaattgggtaagatatagtaatgaggctgatgaataggttgtggatagttatgttaattcagattatggagttattacagagtcatgttggtggtaacagtataattgttggaataataacttttagcattgaagtaaatttagattttgtacataatctaggctgtatgtgttggagattgaaactagtaaggcaaggcatactgtggcttcgcaggccacaaataataggaggctaatgggattagggatgctagagtgaaatgtatatttaaagttataagaataattataatgagtattgataatactataccttctaggcataatagggatgatgttaagtgggattgatagactaatattcccagcaatgctatggtgtatgttaatataatattgatataaataaagggcatttggtaaatatagtctatcataatctaatgagtcgaaatcatttattttaacttaaactatctaccaattcaattcagtctaatcctttttgggttcattcataagtcaagcctaggattaaaatgataattagtataagggctgtgctgattattagtgtcaggttgtttgtttgaagggctcatggcaggggcagtagtagagcaatttctaagttgaacaggagaaatgtggtgaccactaggaagaattttctagagaaaggaaggtggccagaggttaatgagtcaaatccgcattcataagggctggatttttctatataaatattaagttatgggagtcaaaatgtaattgctagtaaggtgtcggtcactagggctagtgtaaagctaattactctttttcaaatattatcaaagcttattgattggaagtcaatggtattgcttatactaaaagagtaggatcctcatcagtagatagagacatataagaatagtcttactatatctatgaagtgtcaatatcaggcagcggcttcaaagccaaagtggtggttagatgtaaagtgaaattttagttggcagaggaggcagatagtgagaaatgttgaccgaataatgatgtgaagtccatgaaagcctgtggctataaagaatgttgagccataaattccatcagagatagtaaaaggggccttggaatattctgaaacttgtaggagggtgaagtatatgcctaaggtaattgcgatggcgactaccttccatcaggctgtggtgagctcaagtaattgaaactcctgatgcaagaatggggtaaggccacagtggagtgggtctgaatggcaaatgcccctctgagacagggcatacgctatccatttccctgcaaccccaccatgcccacatcactcatatgtgttgcctgttcggtctcacttacctttggagctgttgactcctgtcttaaggtctgggaagaggaaaccattaagcttttggtgccagtgatttcctggccttgcagataccatggtgataacacacctgggctgggatgcagtcctagctcctggagaaagcatctgtggctaccatcaaaggaaggactgcctataggcaaaactttgtctaaggtggtggccatagtgtttccaaaaaacacaatccccattcttgagaagggagtcatttagggcttaccagaggcttccctgctcctataagtttgtaactggagaggaaggagaatccatggcaatctgtcagcacagcactctctgcaaaccttggccctccagcctgtgctataggtgtgtgttagagaagtcccccatccatcctactccacctgtttattccctcctattcagcttatgtgactatagccttttgaacatatgaagataacaataataccaataacaactaatctatattgagtaaattttgtgagttgagcactttccatgcattagcccatcagtcctcacaatgacctatgactaaggctctctttctgtctccattttacaaactaggaaaccaaagcttagagaagttaaaagaattgctctcacattcccataagtggtacgtgctggggccaaggtttgactgcacatgattttgaccagcaataggtgaaggaggaaacattcacatggcatttgcgccatggtgaggcactctcacgcactttacttctgtgagtcctcccaatacttcatccccagttaaaaactgaaagtctgagtgacttgatacaagacctatattgctaataggtgacagtttctgaatctggagccagattctttcattcccatcccagtgttcctcctgtgacaactgctgctgcctctgtgggtcagcctgtttcctttattagcacagagtacagatttatgcacagctttcctgtcagttagttttccaattgcaaaataaaactttctcagtcataacaaaaacagtcacaaagaaccaagactgaaacctggatcttctggctaaaaataaaatatgtggtggcatgcagcctgacagaatatcaggaagaggtcaatcacccaagaaccagctgtacttgaaaagaggcgatattagggcaggctcataaaaagagaggaatctgcaatttgagagccaggtgaatgggaacatggccagcctcagtgctctccaagtagaaaaaagcaccaagaaccaactcagagctcagaaaggagaggtgattgaactccactatctctactgggctgaaaagaacaatgctctccttttctgacctcaccaggcattcacatccctcaactcatcccaaatgctgacctggatgggaacttgatcaccatcccaaggaccagaataagaaatgaatgaagcatttattaattaagttgtgtttgcatcaggataactgtgactctgagtgggctgtgtgtgagtgggggttgctgaggacagttctccctctacccacagggcccaacagtgccaaggccgcctcttgtcactctcaacctgggagatctctgcatatggaggagttctgaggactgatgtgtttccagggtctgcaaatctcaaagtatgtttcacagatcattagttccattagatgctcctcaaaaaaggggtttgtggttaagtagagctgaagacagctttacattctgttcccctcttagagatttacagagaacattaaaggctctgataattcctgcagttgagaaaactgcttattttggtttaacccagtgtttcccaaacatatttgggaaggaccacatgtatttttttcacttaattcttgtttgcatcttttggaactagtgtttttcagaacagattttgagcaactccctacaaaaatgctttgaaaagacatactctactgggtgagctctctcatggggaggaagggggtgaagaaaatacatatgaatatgtacaagtttttaaatttcaaaagggtatactataaaatataagaaatgtgtttccttccaaccccagattttaaatattattctccacaggtaactaatatcaatacttcctggtatgttgtcaaaaagtgtgcatgtgcctctgtgtgtgtgcatgtatatgtgtgtgtgtgtgtgtgcatgtgtttatacaggtgagggtatttaacacataccatttctgcctgctttttctacttgaatagcttagagtatttttgtattagcatgtaaaccttctatttaatgggtaaataggagtcttgcatagatgcacccccatttttttaaccaatcacctgttgatagaagcatagggttttcgggaggtactctcataagaaagcttgaatttccagaaagactctaaggcatgtgcgctgagagggactaagccttcaagtcgtttatggtcttgactgactgttctaggctcacatcttagcatgaccagccaagctactgagatggagaaaagggcaaggggcagggccggcacactttgctggcatagtttctcttaaatcacttgctttgcttagaagtttcagtgaactcagcaatcctgccccagacatgaaattagatgcctgctggaggtataatgggcacctaatttcttcacggttgaactgcttcagccatttgaaccatctgtgggttgttaggtcactttcacagggctgatgagtaaataagggccaacttctgctctcattagtatgttttcctttctcgtcaagtaatgagaacatgttgcaatgggattcgtcactaaagaaaaactgacgaaacccacttctggaaagtagaaaaaaaaaatacttcccctttgaaagtcaatgaaaacagtgagttttctgggtaaaattaaaattcacaatcagaagcagaatcctgtttggcagaatcaagtttggctccaggagtctgcagcccttagatcagtgatccagaacggacttttctcccaagcgccttgaaactgtaagatttcccaggtgagcctggtcctccacgttcattgctgatagggggaagtctgtaggaaaattctccctcagctgctagtgactcaaagtctaaggatgtcaaaagagctggcctcatttgtaggaagcacgaggtctcttagtcatttacggtcacagttgggagaaaggtcacagagtgccgttcttttgggagagtgctcttcaacaggcacctgcatcccccaggcttctcttttcagtttgccactccacagcaatcatttctggctggcggtatacctggggaacccagcagaagcaaatgcaaacctgctctggaagaacaaatccacaccttaggccacgtggaattcccacagggaaaaataaatctccctgaagaatttataatacagatgtataaaacactaaaggaaaagatcctttatgaataagagtcagtagataaaataggcagaatgattcactcccccgcaactcgagacgacagaacaggtttaaaatattataaatatattaggctttggtgagttaaggaaatgaaagaaataagcacacaagaaaagaaactaaaagaaaaaaagaaccaaataaaacatatagaaatgaaaagatagtgaaactaaagactcaatgaacgtgttaaacagaagattagatagaaccaaatagggaattggtgaactgaaagatagatttcaaacagcaactatacaaaattcagcatggattaagagaataagagaagaaatatgaaaaaaatggttgaggcataaaaaaatgacagagtcaacatgcataccaatatagtaggagttctaaaaggagaaaacagactgggggaaaggcaaggtaataaagaggaaaattttccagaattggtaaatattataaccctttaaattgaagatgaaaaatgagttaagaactagaaataaattcacctctaggcacataatagtgaaatttcaaaataaaaaaacaaagtgaaactcttattagttaccagataaattcagattattaaggacaaaaatgagacccagagacttgtgaacagcaataacagaggcattggaaaaatgacagagacacctgaaaaatgccaagcaaaaataattatcaacctaaaatgtatcagctaatttatcattcaaccttgagcatgaaatagacacattcagacaaagactgagaaagttcatctgtcacacacccttcctgaaaaattttctaaaggaagaactgcaagaataaggagacagaacccaagagaaagtagtgggtgtatgcagtaatgattagcaaataaaccagtaaatgataggaatgcatttttaaataagcaaacaaaaatatttattttaaaacaccagtaacaacaataataatgagggaaaaatttaaatattagacaacaatgacatgtaagatagagtggttgattggagttagaattttttaaagtttttgtgttgttcagaagaaaaattgatttactttaagttaaaaaatatatatatatatgggtaatttttttttttttttggacacaaagtctcattttgttgcccaggctggagtgctttggcacaatctccgcctcccaggttcaagcaattctcctgcctcagcctcctgagtagctgggattacaggtgcacaccaccatgcctggctaatttttgtgtttttagtagagaccaggtttcaccatgttggccaggctggtcttgaactcctgaccttaggtgatccacctgcctcggcctcccaaagtgcagggattacaggcatcagccattgtgcccagcctaagggtaaatacgttaatagaaagggcacacagaggagaaaaggcaagaataaagaaagctgatcaactcaataggaggacataaggaagatcaaagcagaaattactgaaatggaaaacaaacttctttttaaaaattgaaaagaggatgtcacctcaggtatagtagagtttttttcttttatcttttttttttttttttttttgagatggagtctcacttcatcgcccaggccagagtgcagtggcgcaatctcagctcactgcaacctccaccttccgggttgaagcgattctcctgcctcagcctcctgagtagctgggactacaggtgcatgccatcatgcccagctaatttttgtatttttagtaaagatggggtttcaccatattgaccaggctggtctggaactcctgacctcttgatccgcccacctcggcctcccaaagtgctgggattacaggcatgagccaccgcgcctggccagacctgtaacttttaaagaaatttttcttgtcatctgtccatccctctcttttttcgtgcacatgctgagtaatcttcaagaaatacataactcccattttacaaagtgctccagaaaatagaaaaaaagggaaaattttgattcatttcatgagtctaatataaccttggtaataaaagtagaaagacaacaacaacaacaaacaatgttctcaacaacaaaaaaaatggtatatgaggtagtgcaagtttggacaaacagatcaatggcactgaatagtctaggcatagaaccacatatgcgtgtgaacaggtgtatgataggaatgtcatcacaatcagtggagaaaagatagacagtcaaaactggccttgggacaattgtctatccttgcagacatagataatagaccccaatcccacatcatacaccaaataaattctaattatttaaagacacaaatatgaaaagcaaaatattaaacctcaataagaaaacacaaaataccttaatgtatggatttaaaataaatataaatatcctataacaattaagaaaaagtaaagtatcccaaagagaaaggtgcagaggctgtaatcaggcaatttacaaaagaggcacctaaacgtttagtaaatacatgaaaagataatcactgcactggaattgagtacaattactagtgaaattccatttttctctctctcaaattagcaaaatataaaagttggatgatatcaaggatggttgagtatgtgataaatgggaactcatgtcgctactggaagtacaactttgaaatcactttggagagcaattttataatacacataaagttgaggatgcacataccctaggaccaccaggtcctcttctaggtatatactccagagaaactcgtgaacatgtgtacaaggagacatgtaccaagatgttcaatgtagcagtcttggtgattgtaatcaatagtgagagggcgatgggtacataaaccagtcatacatgttcccaaattaataaatttcagaaagtgtctctgggaaaaagtctcaaattggagaagatgtataagctatgaagctatatatgtaaatttttaaacatataaaactataatatatattcttataggcaactgtagtaaaacttcaaaagcatatattagaatgttaactgtagcgtggttaagagaaactggagagatttgattctaatctcagctccaccacacacttgcttgtggtcaagtgacttaaacatactaagtcctaatttcctcatctataaaatgagagcagtatctttacctcattagatttagtttagatttagtttaaggatcaaagtgtctggggtatagagtatgcttagtgttaacctcctttgccctctcttgtcctcgtcatcatatttgacagaagacagcctcgagtctttaaactcttgcttcaaggcaaggatctaaggagaatccccagtgtttagcacttctgcatgttcagatttagaacctcagacgttcttaaagggacagaactcccaagtacagaagtaccaatccttgaaggactgagcattgaacataaatcataataacaagaggcaggtaaaactgacggtagacatcctctgatgttctgctgtggtggaaagagcttttgataaaatgctgcaagactgtgggtgtctgttctctcaattgaatgatgcaagagtcaggcaacagagaccatcttattccaaagtttctgagcgagggcctgaggatggtgcacgacttggacagacaaaccacccacaggcagaatccagggcactgctgacagtaggggcttctgatctagcatctgttggccaactgacagctctagctccatgtgaccctcagtcctgggcaccctagacttggagagatggatggttttgtaaaatagcaagctagaagaaccaagcatggaggaaacagagaaagaataggtggctgttgagccagaaagcaagacagagaagttatggggtctcttgaggcccactttcctataggtcctttgctctgaaccaaaagagtggtcttgaggaaaagctagaaaacagaaatactagaggaaaaacacagtgcaatgcttggtcaatgtgtttatcagagctgaagacatcactgagccacctcagaaccctggtgttacctgaggtttgaatgtgtttgtaggtggtgaagagatcccaagactctgctagcagatctcctgtaaaatatccccaccacgatcacgtctgttctgtaaaatcatcttttgacactgctaatgtattttaaactgtaaactttgtcaagttcgcttgggctttcacatgaaaggagttaattctcatcaaatgatggtattagggaatgactggagtcaagataccaagcccagctctttcattcaagggctgataagtctcttaattgtgttacacttgtctctccatctggcaaaatgcagttgatcgctctcctttctctctcttcaggaaacattcaaacaggaacgagaatttggacaagcgaacactctgtgctgctcaagggaagagcacagtggaagtccaagggcgagtgtgtgcccagggcagggcaactgggctctgggctgattcccgggatgcatgattacatcagcctgagctcagcttctccaccaataaaaagggccagtgatatctgcccacccttatctcagagctctcctgccagtacctgggcattccaaataatgtactagaccaaaattgtcctggattctgccctgcaaagtggacgtttcctttaatttggcttataaactttctgatttcactctaaatcctgaccatagattcttttgtctcaaaagctccctaagatagaatagacctacttcaagatctgaacaaactttgtaataataattttaaagccctagagtgtctataaccagcatgtctgattgagaatcctctcaaaatggagagacaaactctgtgaccccagcaaggagggatgatttctcacccagtcctggtggaaggtaggagcaggaagaagggaacactgcagtgtctgaaatttctcacatacaatcaaccatccctgtccttccttcctccttcctgtactgcccactcccctatttcctccatagtctgtgttccaggatagtttctttctatttccttcagggcactgaaggtaaagatcaagggtactacttttagcagaagtacttgcatttttttccattctaagagatgccaaaagttagacctctaatgcggaagcttgacagggtgagaaaagaattcagcatctgtccgactacacagtatgttatctactcaaaagtccagccctggaaagctgtccttccacctcaggaggaaatacagctgcttgctgggttgttcacttcagcatcttcaataagatgagctctgtatcaaagaatcctgaaaagtttgaagagagaggagaatatatagagtagtaggagtgagcatagtccctgtgagaaatgactagacatgactagagattctctgaagttcagcccaaggaagagatcagccttttgcattgcaaactttccccccacactagtaaaggtgaaaggcctacgtatcccaatgactaaaaggccaaattagagctagctttttggcttatgacttaattgttgttggttttagttgtagtttataaagaatttttcatggaccttcttttctcttaatgctaccagtaggccttatcagtcctttataccaactgttcccaaccttttagcaccagggaccacctgtaccagtccgtggcccatgtgttggggacccgtaatttataccatggtgttagattagtttgagatgctccccataagagcagtttttgaaaggagggaaaaaaaatagaaccagactcccaaggttggcggaaaaaaaacaatctcacatatttgaaagactgagtcctttatatcctctgccatcttttcgatgttccccttccctttgccttatcaatgtacaaagctttttactagaaaatacaaggcaaaatgcacattctctaataaagcagaaaattactttggataaactttcagcaaaaccatgtagatttcttggtttaaaaaaattgtgtttgtgcaggaactttttgtttatacatccccacaagctccaacaaaactgaagatgataatcaaggttgcagattttattagggttcactttagaaaataaatgtatagtataaatggaaattaaatatttcaggaaatgactggctttatccagaacatacaagttttaatttttcaacagacaatatcaagatgttctttatttagcccctaccttgcatagtggggaagacacaaggccagttgaacagtgaactgctgaaagcaaatttcactttcaacacagaaagcacgggattatgaaacaggttcttcttaagaaatacagagggttttaaactttttggttgcaaaaaaaaaaaaaaaaagatgtgtagttcatttcctcctctgttttctgcagagcactaagaattgtaactgaatttgcttcacttttctgactcactcgtcactgtgaggctgtaatcactctgtattgacaactgcttctttggggccagattgtcaagtaacatgacagaggggtctcagtctcactaagaaagattttccagtaagcagtgaccgggaatcataagaatcactgactttcatcttctctcttttatttcttttattttagttagaaataactacttacataatgtcttactacataatgtcttgctacattatgacagtgagtgtggtcagagcagccaggaatgaatgccaagggaagatgaggagtgcaagaaattgtccgtaactccctgaaaatactgtaacgaatctggtctaatgtgtttctcagagaccagaaaacttatgactctctcttcacattccactagttcaattttttgagttcacatttgtttctcattcttggcttagctgatgcattccaagcttattcttctaaattattatgtatttgccccaagcaaagaacttttaatgcacagagtttatgggctattctctataactttaaggaaaatgaaattatttatacctggagtaggaaatccttaagcaggataaaaaaaaccagttgaaatcaatagttgccacatgataatacatttctattcacaaatggcctggttccaggtaaaacttcaggatacagagaatgctagaacgtgcagcaaaatgaaagcccagaccacttaagtaaactttccagtctcttgttaatagctgagtaaatctctgggcaatcctcaagaggttcttagaagtcgtccctcgtttatatctagaaggttcttgtaattgtcttgtaaatctccaaagatatttagagattactttgctttaaatagagaccaaaaatgacacaaaactaaagctggactattgcctggtacactatttctacctagtgcaatttttaatttcttaaaaatcaagtgatctgacagcacaatacttgtcaagtacttgtcatactgagatgtttcttgccatccatatgtatatttttgccaactatatttattgactattgatgcttattccaggtggctgagtcaccccaatgcttggaggaagcaagcagggtacaaatcaattgatcaatgaaaacactaacgactgacttttaaatcacaaagccattttagagtataagtaaatacctgaaataaagaaggcacttcactcactccttctcttccattcccatcaacttttgtgggtaaatgcaataggtaattgaaaacttaatatcacaacccctaaatagtcaaacagcctctagtaacttgtttcttcctggaaaagatgaatctgatcccaattaacttaaataaaacaaaccaaacaaaactctccactaccagcctggcagctagggaggcattattgggtctgaatgtaggaaatcaggaaatacttacaatcaagatgaacgtgcccaagaactcagagagggtttctttcgctaagctgctcttcaagaccagtctctgcttgaagctttttcccttttctgctccctcaggctgcatcttggggcttctctgaggactcctgtttctaccaatacctacctgttgtggtcctcactttcacagccagatgaaaatggacgttttgacaatggctcacagattcctggagatgtctggtaagagtctctgactgtacaaatgccgttccaattagaggctgtggcttaatcgtcttctggtggaactgtcattccctgttcgctgctatttgtttgaatctgcgacttagaacccgaaatccccaaaacaatcccttttgtgcctgacagattaatcattacctttattctcaaggtacttttttctctgttggtttttttcaagagatgagaaaagagatgtgccagttgtgttgccaaatcacagtgacgggccctggtccagaaaagattttcatgttacacaattgcaggcttctgatttttttttcttctcattcagaagtgggtggttggggtgtagtttggaactgtcaaatcaggtgtagatatatccaatgttaacattcttttctgaaaaaggtttttatgcaaaatgaagaatttgaagaaaatatagatttatcatcctagaagattaatcactcttgttttcttctggtatcatttcagtggcttcatgataccactctgaggttagtaagaaccacataggccatcctagagatggagaaattaacatacagagaaaccattgcaagcttcacactgcaagtctgtaggacagatggagtcacctcttcggttatgaaactgggcttcacttgctgaagatactttaggatccaagaatcagaaagatggaggagtcacctttttggtgacttctgaagtttcttctgaagaaacattccagtttgggtttcttctgaagaagcattccagtttgaaaatagtcactcttcttcattcaccatgaaatatttagacataatacataggaaataaacaatagcagcttgaaattctttactgcatggagatgactgagccggaaagagatcaattagcgtgtatgtcattctaatcaaacgagaaagggagccagtacacctaaccgaggctcctaggttataccctttcaatttgataaattgacatccttgctggcaagaaactgtgtttgggagtagctccttgtcctgccaaatattcaagccttgtttttcaaaactggcttatctgaagaaatagaatatagcattagtttctaaatagcaaggcaggcctagtttctgattaccaatgtggactcatggaattagtatccatgctgtgtggttccttccagtcctcccacagggaagccagctctgcatcaggccctcccctagctttgcaaaaagggagggaggagaggacatggagaaagcagctggtgagaggccaaaggcagaaggagacttctcatctgtaggtgacatttagaatttagactttaaaaagttataacctgcctgaggccacactactgcagaaccaggacaaaacctcagcactttggctttaattcctgatgaagttatcataaataccattgtctagaagagttacctatgaccacaccattaccaagtcccagtggatggaccagagaaacaggactttcttactgtgactacagctaataacatgcaagagcgttctctggtcttcccattcactcatctaacaactatttactgcacactcattatgtgccaagcactgcacttaacaagagcacatagggttcttgtccttcacagagcctagagtctagtgaagcagacagatgtaagtgaaataatcccacacacataaatacaaaatcacaactgagatgtatgctgcaaagatgggggccatatttccataagcaaatatagcaaaaggatttgactttgttggagagatctctgatggcttctccaaggaagtcatgtgtggactgagatcagaaagaagcatgggattaactacatgaagtggggaagaaagtgcatgtacaaagtccttggtggctttgggggtaaggggtaggggacagcatgatgcctctcaaagaatgagagaaatttactgtggttggccccagagagagtgaaggagtacagcatgcaaaatgagccctgaggtgtgggcaagggtcagaccttactaggccttgtaagtggtagttagggctaaaagtgtaagtcattaaggtggtttaagcagaaatacgacatgatcagattagagttttgaaaagatcctccgagctgtgaggtggagaggggattggagggggcttggaatggtcataggcagatacatttgggggtattacagaattccagaattgggtggtagtttgacagtggagaaatggagggatccaagagttctttatatcttaaaattggaagaatttcatggattagatgtgggagatgaggaaaagagactgagaaaagttggttcctgagttcctaacttgctggggaaggtgctgctgagccctgggagaggaaatcctggaagaggaccagaagtgcagtggaagatcattaattctgcttgtgcaaaactgagcctcagaggcttctgagcgatgtaagttaggaagtgatatgggtccagatgaggaaggaatgtctgtgtgctcatagtggtgataactggagcctggagtaaagaggctccctagggagagagtttgaagagaactgagagtttgatatggaacatttcatgcttaggtagaggaggatggaatctttattatttctgttttactaccttcaattgacagtcacacttctcacctccatcaccacgaacagctcatcatcaaacatagcttactcatacaaaatattcactgaacaaaatgttccagccacctaacaaaatgttcaaaagcatcttaagaaggtaagcaatgaatagtattcctcctttattccatctgggagggagcctttgtcaaaataccctgactccaaagttctaactggaagcatgaggaagcttttaaatttcattcactcagaaaaagttttcattgaatatgtaccatgtgtcaggcacagcattaagcagtgggaatttaaaaatgaaaaaacaaaaccagatctctattattaaggaattaatagtctaagtgactaagatgtctgaatgaatacaccatagagtagaatagagttgtaagcaagatactgaaccaaaatttctgctgtcaccataggaacatctgagagctaactctgcatttgccaacatgcagaggaaagaatgagtatggtgactgctgtcaatggttctaaagctgatgagctttcctggatgcactgccatactgattctccagggctggcatatgctgttcttttattaatagttcccttggctctgccccttcctatcttctcttctccccaacattctattctgtgtttatctacttttgccttgggtaaccatctttgcctacactcacgcaatcccaagatagaagcctggtgtttataagtataaccgcctctcacaccctgacctcacttcccctacacctcctaattctaaattccagtccctcaaagccttcctttccacctaattattacctcatgattacccacgttaatgaagcgcttcccagcatctcaggttccattgacccagtgattttcttctacacccatgttgccaaagcccaactctgggtatgcctaaccatccattttttttttctcagactttctcttccctggctgctaaatgttgctgaagaaaatcataaatgtattgattaacgctattgcagataattgtgatatagcatcagcagtggccccatgttcttagttaaccttttatttccaagtttccagattttagcatgcactaaaatcagcttccctcagagactgattctgtagatctgggatggagcccaggaatctcacaagcatacttgataattcagagccgattctttgcccagcagcaaccacatactcttctatgcctccagctcacagtcccaaccctcccactcagatgattacttttttctccaaatccactgggaaagcataggtttcattgactgtaagtccttttatgcccttactcctaaaaaaattgccttagttttacatatgttatcctcttttcctttccttattcctaccgtttggcccatgttaatgttctattccagcccctctggaacccaggccaatcaacattcccttcactctcagtctctttccaacactggctttctcccaccaccccaggaccaaaacaaacacaggtctctctaatactgaaaaacattcctcaaagttgtttcactccaaattaccattttgtctgttaatatctccttcacttttttcttttccacctgaggaagaaataacctttttcccatgagtgtaaaatcatattacactgaaaaaaattagaagtatttaaattaaaatgttaaaatttcttataatccctgtcgtcagagataaccattattaaaaggttggaatatcggcagaatttgtttcagtaggctgggcatggtgacttacgcctgtaatcccagcactttgggagaccaaggcgggtggatcacccaaggtcaggcattcgagaccagcatggccaacatggtggaaccctgtctctacagaaaatacaaagattagccgggcatgatggcgcatgcctgtaatcccagatactcaggaggctgaggcaggagaatcacttgaacccaggaggcggaggttgcagtgagccgagatcgcgatcgcaccattgcactccagcctgggtgtcacagcgagactgtctcaaaaagaaaaaaaaaaaagaaaaaagaagaagagtttgtttcagtagatctaataatatataagtatctattcttttcttcactcgaaaaatagggttatactacatttactggatatttttcccacttaaaatttgctgtttagccttctatgccaatgtaaacttcatctttctaatgactgtgtaatattcccttgtacaaatgtgccataaattaaacaaactccttttgataggcaattggttgtttccaattattgttcattaaaacaactctgcaatgaacaaccttgagaatctatatctcttagcataacttcctagagttgaataattagagtatgcatatttaaagtgtgttaaaatatctgttttctcattttctttaatatcgggtaattgaaatctattaaatgtttttcccaatctaacagttaaaaaatattgttttagtatgtattcctttggctaacagtgaagttgagcatctttaatgcattagctattttttatgttttatttttatgtcctctgcctacttttcatatgtaatgcttagtttttattatgttgttttagctctttataagatatgaatataagtcttttatttttcagatgtggcatgtcattttccagttagttatttatcctttaacttatgatgatgctatttaattgcaatatagagatttagaaaattttatgtactcagttctgaaacctttttctgtatggtttctaactttgttatgtgtgctaagaaagaccagcactatcccaaaatgacaagaatattcaaattcgtcctatattttattctagtatttttacagtttcatttttatatttaaatcgttaatttttctagaatatattttgatgtataaagtggggctctaatatttttgcaatattttgatctcttatatataaaaacttcccagaagtaaaattgttattttaataccttgccttgctatatattttaatgactttctggtagatctcccctcattattttcaaacatatattagctagatgaagttaagaatcatttttttaagttctatctcatccctgctatatggataaagttataatattgagttttcataaccagaaatacagtccatctgtccatttagtcaaatcttctttatgtcctttaagttaagatacattattttctctgttgtgtcttccaaattcttattaagcttatttctgggcatttgatatttatttgtatttatttttgaagttaggttgagatctctttttttattctattttctaactgatcatcacgagcaaaactctatttctgtgtgtatatcttctatctgcccactataatgaactttctttatagtttaaaatgggtttctagttgatattgtggtgaacattgttagttttctacttggcatctattaaaacttctttctaatagaccaagttttcgtttaaatatctgactttctggccaggcgcagtggctcgcatctgtaatcccagcactttgggaagccgaggtgggcagatcacgaggtcaggagatcaagaccatcctgactaatagggtgaaaccccgtctctactaaaaatataaaaaattagccgggcatggtggcaggcatctgtagtcccagctactcgggaggctgggacaggagaatggtgtgaacccaggaggtggagcttgcagtgagcggagatcacaccactgcacactccagcctgggcgacagagctagactccatctcagaaaaaaaaaatctgcctttctttttatgcaactgtgggcttctggtggaagactgaccactctcagatgtaagggtaaacactgattagtctaagcctaccagaataaatttcccacccttgaaaccatgacaggttcaggacaaatgtgatttatttatttaaaggcaatacctctgtgtgtcatttagtaagtttctttttttttttttttttaattatactttaagttttagggtacatgtgcacattgtgcaggttagttacatatgtatacatgtgccatgctggtgcgctgcacccactaactcgtcatctagcattaggtatatctcccaatgctacccctccccctccccccaccccaccacagtccccagagtgtgatattcccctccctgtgaccatgtgatctcattgttcaattcccacctataagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatggggtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtcctttgcccactttttgatggggttgtttgtttttttcttgtaaatttgtttgagttcattgtagattctggatattagccctttgtcagaagagtaggttgcgaaaattttcttccatgttgtaggttgcctgttcactctgatggtagtttcttttgctgtgcagaagctctttagtttaattagatcccatttgtcaattttggcttctgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataagttgtaaggaagggatccagtttcagctttctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtatcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagctcaaggagattttgggctgagacgatggggttttctagataaataatcatgtcgtctgcaaacagggacaatttgacttcctcttttcctaattgaataccctttatttccttctcctgcctgattgccctggccagaacttccaacactacgttgaataggagcggtgagagaaggcatccctgtcttgtgccagttttcaaagggaatacttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaacgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctggtttatttgcatagaggtgtttgtagtattctctgatggtagtttgtatttctgtgggatcggtggtgatatcccctttatcattttttattgtgtctgtttgattctcctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttcccgctacacactgctttgaatgcatcccagagattctggtatgttgtgtctttgttctcgttagtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaactgtatattctgttgatttggggtggagagttctgtagatgtctattaggtccgcttggtgcagagctgagttcaattcctgggtattcttgttgactttctgtctcgttgatgtgtctaatgttgacagtggggtgttaaagtctcccattattaatgtgtgggagtctaagtctctttataggtcactcaggacttgctttatgaatctgggtgctcccgtattgggtgcatatatatttaggatagttagctcctcttgttgaattgatccctttaccattatgtaatggccttctttgtctcttttgatcttcgttggtttaaagtctgttttatcagagactaggattgcaacccctgcctttttttgttttccatttgcttggtagatcttcctccatccttttattttcagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttatattttggcatgattttgaagcggctggtactggttgtccctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttcagaatgttgaatattggcccccactctcttctggcttgtagggtttctgccgagagatccgctgttaatctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggccttgcttgctagattggagacgttctcctggataatatcctgcagagtgttttccaacttggttccattctccgcatcactttcaggtacaccagtcagacgtagatttggtcttttcacatagtcccatatttcttggaggctttgctcatttctttttattcttttttctctaaacttcccttctcgcttcatttcattcatttcatcttccatagctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggtagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgtcgccttgcagtttgatctcagactgctgtgctagcaatcagcgagattccgtgggcgtaggaccctccgagccaggtgtgggatatagtctcatggtgcaccgttttttaagccggtctgaaaagcgcagtattcgggtgggagtgacccgattttccaggtgcgtccgtcacccctttcttcgactcagaaagggaactcctgaccccttgcgcttcccaagtgaggcaatgcctcgccctgcttcggctcgcgcacggtgcgcacacccactggcctgcgcccactgtctggcactccctagtgagatgaacccggtacctgagatggaaatgcagaaatcacccgtcttctgtgtcgctcacgctgggagctgtagaccggagctgttcctattcggccatcttggctcctcccccagtaagtttcatatttcctattatcatgctttttttttgttaattactgagattttttaaaacagtaatgaatattgaatttttatcaaatgtcttgaatatttaatgagaagttttcatttaaaaaacttccatttttcttatgtcattggttagttatattacattttaaatgatctactgttgaaccagccttgcattcctgaaaatctcctgcttggttgtgatgcacatatattgctagatttagttttccaatacttttgatttttttgcttggatattcataagtaaaactataaaagggtagtttgtgttttacttatcagactttgatatcagactaacactagccatgaacaaatgaactggatagatttccatatttctctgccctatggaacagtttaaataggccaagaattatctgttccttaaaagtcaatgggttctatgtacgtgcaaatatgagccaatgtcctctttggctagtaaatctttgagaatattttaatatctactattgttactgtcatctataggtcttaggtacattttagtcatttacggttttccacaatttgttctactcaatctagaatctcagaattaataaaacagatgtagtgtataatttaaagcatgctttttcgtttcaaacataatctatttgtatttttctcttttttctccttggtctcaattgccagaagcatataatttttattgttatttttgaagagctgtgtcttgattttatttgtcaaaaatagttttgttttatttaaaatcaattaatatgtgatattccctgaattcccttttctgtgtatttatggttagggtgcaccacaagagagattcttgtgcaagacatgaaggacaggtttgaacagcagccctgttgtagcttacacatgccatcacctacctgcttgctcacctttgtggtgtaaggcagaaggcacacagcaggcacacccaggccttcccctgggtcctccttcagtttctctggcttctacactaggtgtgtacatgttcaacatcaacgtcaagtgttccagtttctgtaggacatgcataccataaaagtcagaggcaacaggaactgatacaggttttgacaggtgtcagtctaagacagccaagtataaagaggtccctggagaacctctgactggcctgcacactgggaggagtgtacactgaggtggagcctcgggaagtttgtgccgtttgcagggaggaggatcctggccttttctgttccagggtggtaacctggggattcaatctgtgatatgggggcttgttaacaggaacctctttccctttgctgagttttttcctttttgcccagtaaattccattttttttctcacccttcaaagtgtctgtgagcctaatctctcctggccatatgacaaggaccccgtttttagctgagctaaggagaaagtcctacaacaagtctgtcctcatgaactccagattgtgttggtaggttccaggttcttcttgttccccttcaaattacatccatcttctcttgactgaccgccctgtggacatcaagatcagcatcagacataaagacaatagtcttataagagactgctaaaccagctctcacaagtgtgtaaggtcaatcactgtaacagactcctttatacatatatacacacatatatgtgtatttgtatccatatgtataagacatatatgtgagaccctgcttccgtaattgaacgctaagtttttatgcaggcattttcacaacttccttgtgagctacatcttttatcaaagtaaattgttctttttgagctactaaatgcttttttgttgtatactatactttgtgtgctgttatattgtcactcctacttttgtatttgtttgctgtatctttgtccacccctcaattttaaatctgtagaataaaaattagatctgattatattttacaatcttttagaatcagctatttagcttactagcaaaacatcattttagaagaggctgatatgtctttagctattttcctgactctgagtgaatctctatgatctattttgtttatttttatttatttatttatttttgagacggagtctcactctgttgcccaggcacgatctcagctcaatgcaacctccgcctcccggattctagtgattctcctgcctcagcctcccaagtagctggggtgcctgccaccatgctcagctaatttttgttttgtttaaatgcaactagatgagtgaagtcatgataagcaggttaatcagtatatggttaataaataataactttgtattgccattataatttacagagtttgtgtataaatacaattttcaacacacattttcatacatgcttttcatttaacaaccattcatattctaaatgttacaaatcaacatccttgaaacttaaaagaaacctctcagtattgcaggaaagtttttgtcctttttagtaaaaaaagaaagccaaccttctgatgacaagatttagaataagaatagacaaaatttaaatttttgtaactatcagtagtcttccctgttagctagatgaacaaaggtgacctgttactccagcatttgatattctcaaaattacttatggcaaatttctgctactgaagtttgggaaatttggtctcaattttaatcaaagctaaattaagtatatttggaaattgtcctaatttatttctagaaacttttttagtgttttgtgtttgaatggttaaaattaacagtgactgggctcactatcgtcagactctccttctgttagactgttgtcaaccatcgtcttaatacatgtcattactcatttctcctcccttcataaactgcagaaaaaagtcaaaatactgtagggctagcatctgttgttagcataagatggatttctgaaataagacacaaaatgcacaaaccgtagaagaaaatgttgatatatttgactgcattaaaatgaagcaatgcctatttatcaaaagacaacaaaaaggagaaaaaagaagacatttgcatcacatatagcagacaaaggcctatatctaatatgtacataaaggaaaagtaggcaacccaatgggaagatgggcaaaaaacctgaagaggcacttcacaaagagaaaccccaaatagccaataaacatgaaaaatattctctgcttcgctagtaattaaacaaatgcaaattaaatccccaatgagattacattttataccaactggattggcaaaagcaaaaaaaaataaaaaaaaaaattgcagtatcaagggtcagtaaagatgtagaactaccacaacaccaacacatttctggtgacagtgtaaattggtaaaatatcttttgaatgaaaccaaacccaatttgccaatttggtattatctaataaattttcaggtgtgtgtacataatgatccagcaattttacacctaggaatacaccctagaaaaattattgcatacatatacctagagaaatatataaaatgattcacgaccacactatttctaataacaaaataactagaaaaaaacatgtgaatcaatggttcaatggataaacagtacatttttataatgaaatgccttaaagcagttaatggcttacaattacacatgacaacataagtgaatcctacaaatataacattgaacaaaaaaaagcatgttgcagaagaatgtgtgaagaactcctttgacataaagaaaaaatatgcaaaattgttgaacatatttttagagtccaagcatagatggcaaatctatgaagaaatgcaaaggaacaataaacaagaagctcaagatattagtgacctttgaggagagtgggagaagggatttgaggaaacatttaggggactgtaaggaaatggtcctgttggttgccataaactgaaaggttcccaggtgttaattgtaccataaattattatgtcttatatttcttttattaataaagagaaaaaaataaaacaacattgaaaaggtagcagaataaataaacttcctgctcatgatccaccttgcgtcaccttgtttgggggagaaatcttttaaaaacataatttacttagaatattctcttttttatttttatttatttatttatttagagatggagtttcgctcttgttgcccaagctggagtgcaatggcacaatcttggctcactgcaacctctgcctcctggattcaagctattctcctgcatcagtctcccagtagctgggattacaggtgtgcgccagcacacctggctaatttttgtatttttagtagggacaaggttttaccatgttggtcaggctggtctcgaactcctgacctcaagtgatccgcctgcctcggcctcccaaagtgctgggattacaggcgtgagtcgctgtgcccggccaatattccctttttaaaaactcagtgattcccctctatgtaataggtaatgcccaaactttctagactgatatttaagttctgccataaatctgctccttcatagttgcccaaatatgtatctcaatattcccagcatgaaacacttcattttatccgaagggtacttatagattcctctacaacactccttattcatttctgcctacaaggctttgcttgtgctgtatcctctcttctggaagactcttcttccgcctctttttccatccaaattgtactcacctcaccttttgaagaattggacttactaattcacttatgagcccttccctcacaattccattgaacagggaaatctcccacgatcaaatacatataccactcactgtatgaattacacagcccttaatcacatcagtttcttctctcttcttgtgtatttgtacatgtgtatgcatgcatatgttttctctcttcaaatagattataaactcttcccaagtaagaactatgttttgtggggggagggggggagggatagctttaggagatatacctaatgctaaatgacgaattaatgggtgcagcacaccagcatggcacatgtatacatatgtaactaacctgcacattgtgcacatgtaccctaaaacttaaagtataataataataaaaaaaaagaaaaaaaagaactatgttttatactttttggtatggtctaaaggggttagtacaggtaacatgtaatgcaaagaaacaaaatttaccagtaacttgcataacagacatgatatcttttccttctttctgtgtcccgagacccacaaatctatgatactctggtcaggggttgcaggagcaaggaaaggaattgtgtgtcttagaggctgatgagagatggataaggctttgggaaaggataagagaatacagtcacatccaggtggtcatgttaaatcttctgctttagaaatatcacctcatttcaatgtactccattttcatgaactaagaaaacctggaagattgcttttaccaaacacacaaaacattttcacaaaaaaatgataatcacagaagcacaatttaataaatatttatggagaatcgagtatggacagaatgctgggcctttcattaaaaaaaaaatagctcttcacggtttatcaaacatttgcatcaactattttatttgtgtctcaaaacaatcctataaagtaaaaggaacagatatagtgcatactttatatatatatatgaatttcttgtttcttgcctgtctctcctactacagtgtgagtgcctaaaaacaaatgttgactgttagactgttagatacttagtgcctaatttttttttttttttagacagagtctcactctgttgcccaggatggagcgcagtggtatgatctaggctcactgcaacctccgtctcccaggttcaaaagattctcatgcttcagcctcctgagtagctgagattacaggtgtgtgccatcaggcccagctaatttttgtatttttagtacaaatggggtttctccatgttggccaggctggtctcaaactgacctcaagtgatccccccacctcagcctcccaaagtgctgggattactggcatgagccatcacacctggcctggtgtgtaatctttaataaacacatgagaagttgtgaagcaaaccctcactatgcagttgaggaaactgaagctcaagaaagaggactgacctgtcgaaaatcatgatgcagttagtggagagggaggattcaaacctgcacctctggaatcctgttctatcacacctcctgccattggttaagcacaatggggaaatcccattgccaaaactgcaaggacattttgaacataactttttgtttgttatgattttttaaaaatgttgttcaactttttctaatttctttatgattgtgctattacatagaatgaatacactaaaactggggaaaggtaacttaggtagaactgcagctctctgtgagggtaaagctgaggccaagagcttggtctttgtcacttggcctgagtggactccacaggcctggccatatgcgtctcccaatcacacagctgatcacacaggttgggagtgatccagtcaaaactcatcttcagaactgaaaaaacacaaaggcctgtgccttgatgatagggcattggcaacaactgtgcataaggtgcctagtgttacaactgcaatgtcagtatttcaggagcctaaattatttaccaggttacctgggaattgggttgaggaatcacatttcccacacattaacagtggactaaaacatctaggacttccattctctgtaagtccctgcacttttccacttccattcccccactagcaggggtgctgaacacaatatcctgagaaaggcattgaacttaccctaaatttcttagcaatcgggacgggagtccattgcttgcttttcaagttttgccagtggaaagcctcaaagcctactgctcgctgaatattagtcccatgtactccccttatagttctgagaatctggggattccttctggtcctagcaactatcactctttcaattcgttatattgccattcatgtctatgaaggtgccagatcataaatctctccttccagaagcgactcaacaaatttccattccaactgctccactgagcaaagaggatgcaaaaatcaattgttatggctcctttcaatataaccctcttctcctgccgtcgtatttgtaatacaatggagagaaacagcaacggccactggtctcagttaggtgacctttatttcatcctcgggaaagatgccatgtcttttctggtgccaatatcctgtggctctccatagacttccaggagacactgaagcacataggcaaggaaagtttccctcatctcccaaaaccagcaagggttatattataatttaaaaattaatttgcaagctgttgaaaatatactacaatgacctgtagaaaattaaaaacaaaattatgtcatttcaaatataccattatctacgaagtcactgcagaatatgccattggtacgaaaacctttgttcttggtagtgaatgaaaggtgtgtttttaaatgccatatttcttgatggaaatacacgctcaaaaacactttgaaatacctctggcttaatgcaaagactttggagactgaccatgtttattcaggtagatcttttgtagatgaatctcagaataattgatcaaattcccacaaacctgagtggttttaacagttaaaataataaaagtagctaatcaattaataattgtataagcagtaggaaaaaaatttaagtcagctccattttgactgagcaatctgaattgaacatagtcatgactggatgtgtgctcgccaaggggttccttgactctgtgacttttatgtcctctgtgatctgagttcattgatcttttgggtacaaagatgaagaccatttgtttacccaaacatttgttcagggagaatttatttaagggaaagtgagttaactaaatgaagcaaggtcacttttgtttttgtttgatccatgatatcaaagagactgttgaaatttggtatgctactaaaggacaggaagaaaagcattgcaatctatttgaaactaaatggaagttaacaacacctttcaaatgagcattttatctataatttttaaatatttattatgtttggtacatgaaagagataaagtgacaccttgaaagtggtttaatccactatcttaaaacatgttgactgaatggacttcctatattgtctatattatatttttaaaaattcttatggactcagttcagttcggcaaacattatttgagtgtatggatgcttagcactgtgctaggtcctgaatacaggaagataaatgaaaagcagccctggctctcaagatgaattcaatccaattaagaaaacagttacagtgttggtaaatttggtaaatgtatagaacttctattttatcaaatagcccagggtgaaattagaacagagatgaggactcgctggttaataagtactcatccctttgtttagcaaatgcatttgcaaagaaattaatataacattgtctactctcttgcagagagattcgcaagatcagaattttagatttggaaaaaatggtaatatacacataacccaactcttttatcataaataaggcaggagagactcagtgacttccctggagtcagctcatgggggaccaagactagaatgctaggatcgagtatcctaatttcttttattcttttgtttttgtttttgagacagaatcttgctctgtcgcccacgctggagtgcagtggcacaatctcggctcactgaagcctccacctcctgagttcaagcaattctcctgcctcagccttctgagtagctaagattacaagtgtatgccaccattgcccagctaatttttgtatttttagtatagacagggtttcaccactttggccaggctggttgcgaactcctgacttcgtgatccacctgccttggccttccaaagtgctgggattacaggcctgagtcaccgcacccagcccctaatttctagtcctgtcttctttcttctagaatgtgctgtccctccttgttctgctactgatttcactcatgaacagtggggcctcagggtcaaaagtctggttggaagaagagcttggggacttcttggggttgtgttgaatgcatgatgtggacccatagaactgttttgtgaagatactttaaataagttttgaaaaatgtgagttacacacctccaaaattggtccattataattatatttggggaggcttgaagcaggtgatggaaattgggagattcctaaagccctacaagccacctcttggtgccgctactgcttgtaaaatataatattgtcatttaatttgcatgcaattgaattaaatgaactcttagtacatagaatttatggaacttcttgcccctaaaaagatgttaaggtaagactgattaactctcttacaaaaggagatatgattgtccttcgagtggaatcaactgagaccaaggatgttttcagcttcccagatctggaagcttaattttattgtattgcccaaatgtgactgagtcctggagaactgaatcgtgttacaatattcaccagatactgactaacaaacaagatgaccatttattaacttacgttgtgcagaacaaccatgattaccctgttggctgatcagcacatgcttccttagtagtaaagtctatcagagaagccaaattactcttggaatcttggaaaacatggattagaatggagggaatggctgccttaacaagtcactgttattactgaactgctccttccatccacagacaggttcccttcaagaaagaacttgcttcccattccactctcagggattctgtctccaggttccagaccctatgactccatctggtggctctatttcatactcccttttcctcagccaggttttcacctttgagtccatctgctttgggattgatatttctttagatggttcctagttctcaacctgactttcactcctggcttctgtccttcagataactcttggaaattgtccccatccattctgacatctagcccagcaaccagaatctttatgtgtcagaaaccctagcaccctcattcctatcactctgttccagaaaagattcagacagtaacctgattgatgtacctatttctactgtggggatctatctatggaaggaaccagaacattgtgttctttggtcatgactccatcacctgagtggtgctggagaccatttccttactcgtgagagagagaagagtatagggttgagttcaaaaacccccaaattagagggcttgggtttctattaatatttctctttcaatacttaatagctatgaaccttgagcaagctattaactgctttgcacctcagtttccttataggacatatgaatataataatagttcatacctcatgggactcttctgaggagtaaatgaattatttcatataacacagtccatatgacaaacaggaaggacataatacctgtgactcttctttgtctatactttttctagattccaagcaaccccttttctttatgacagcaccatgacctcagacatttcacaatactatggagtgggttacagtttcagagtaacacccccttgatctgatgtggaagtagattagatcagactagattagatagaatgttattgtggaggagcacaatcatattgtgtaacatctccaagacatactgcctagcagctgtcttatcaagggacaacagccacttcttactgagcaattttttatgtgtcaagtaccatgcaaattgctttatgaatattgttttgtaatcttttatgtgatggtcaatcaggtgtggccccaagaggagatacaggagaggctcaggtaaaaaaacgaagtttattatactcacagatcctagagacaagaggcacggcaggccatgctaccccacaaagtgctacatataagggaaagacactagggtggtcgggaggcaggtgacagtagcaaggagagggtttaggtctttttttcttttttgagatgagttcctgctctgtcacccaggctggagtgcagtggcatgatcaaagttcactgcagtgtccaactcctgggttcaagcaatcctttcacctcagcctccctcatagttgggattacagtcacgagccaccacaccctgccaatttttaattttttgtagagaccttatggaggcaaggtctcactacattgcccaggctgctctcaaactcctgggctcaagtgatcctcccaccttggcctcccaaagtgttgggattacaggggtgagccaccacagccctaaataaaggtttaggactgttttgagatttccaaaggaaaggaaaatcaggacagggtgtacagtttagcattggttattttgataatttcagtgggctttaggctatatggatggttgcgaattgcctggcacctggtcttttgatgattaaggcacagaaatcttgcttcttggggtgtgtggaccagatagagaaggtatggctctggattggttagtatatcaaagacgtgctcctacctgagccatttggtaatctttaagaattggctagccctgggggagcagtctctgctcagctagaaaggttttcttaagataccaaaaaatcataaatatggaagattaaaaataatttacaatacaaatattaccacacataatcttggcaatatctttgtaatgaaagatattgttattgcagttctaaagataagaaaactagacttccgggcattaggacatttgcctgggtggcagtaactggaggagtcctgatttgaatcgaggtcttcctggttctatgttgggaaaagctgagtgttgggagaagctgaggcagggcttgcatgtctgacataatgtaaaagagtcttggaacacatgtggggtccagggtctaaaaccctttgtggcctttggaacaccaaactctgtgctaaaaggtggaaggctaccctgacacaccataatctaagtccggggcataaaacccctcgtggcttggatagaatccagggctcttgactctggaatgtgtctagacttgctggctccttgctccttgctctcccaggattgattgtatcttgagttaaaagaacctgctctccactatctcaagtagcagagcatatgctaaaccatcacagctgtaaatcatgtgcttaatgcaacgctccctttcaaccccacattctcaccacctgtttctttgtttgatcaccaataaatagtctgagcttccagaactcggggccttcgcagcctccacactcatgatggcccgctggtcccactttctctctcaaagtgtcttttctcatttctttaattctgccggacttcgtcacccccacgacctggtgttgggtccaatcaccccaacagttctagagctcatacttttctccagaatgttctatttttttgcataaaatttagagtgaccctttccttaagctgtctacatattgtaggggtacctttttatagactcctaaaataatgacatagacctcgttgtccattatcaagttagaccagatatctggaatttcctgggacagccctggttgtatcttttcacattatgctgtcctgcactttgtttatttattttacttctgttgtttgttgttattttggccccaattctgagtcaattaactatatttttccatcttaacatccctctggctgaagaccaacttaccagtcttcctaggaactgaactgatcctggggttgaacctcaggtagcagtcagttattatattgattagaggaattggcgggtacagattgggggcatcatcctcacgcccacctctgtggcatccatgatgatccatttccagtcccttccctggctctactcaattccttgctgggggaactctaccccaagctctgttcttggcctctctcttgctcattctctcacgtttcttttcaagcctgagctctagcctctggtttgcctcacacaagtgttctccttgggggttctaggtcctgagatgaactgaagacctcgaatggtagcctctgtatcacaggctgtaccccacatttttcccggcaaactttcttgtcttcttaccttctccatctcttgttgacataacctattctcttggtctcccaggtttgaaatcttggagtcagctttaatgtagccctgtccttagactgcaaatttagccctctaccataatacctcttagatttacactgtcttttcctgtcttactgatacagccctaaacctttttattacatgtgttaagtatgaaaataacctgtcaactccagggtttattaacctgggaactaaacaccctctataaggtccacagatgagctttagtgggactataaaacccctgaaaatattttttaaattcttgtgtgtttgtgtacatacacgtatttcttgtgtcaaataatactttccatcagcctcttaaaggggcttgtatcagtttcctagtaccaccgtaacaatcactaaaaatttaacggcttaaaacaacataagttttttctcctacagttctggaggacagaagtctaaaatcaaagctttgggagggcttcactccttctggaggcttccgtttctttgcctttcccagcttccggataccaccagcatttgtcggcctgtggtcacctccttgcactagtccagccctcgcttatgtcgttacattgcctactcactctgacctcctgtctctctctgataaagacccttgtgattacattggccccactcaggtaatccaggatagtctccccatcttgagatccctaacatttgcaaagtcccctttgccacataccataacactaatgggttccaggaattagaatgtgaatgtctttgggaggccattattcaatctacctcagcagtcagtgccccaaatatgttgcgagccactggcttaactggtttctttaacaatccagaaaattatttctctaatgtcactcttatcccggcattctcctgctacatttacaatgtcttctcttacctatcagatcaatccactctctgcaccaagcattaagggccatcagccaatgagacccactttatctctccaatgtcatccccaacatcccccagctgggacattctaagtcattcccctgaaaatgcattgtcactcttaactctacacctgttcacactgttgccctgccaagaatgctctcttatctcactcctctccaccagtgtaatttcctcccttttatcaaagactttcttctgcgtaatttatcattcataatgttttcctttatgaagtcttagagttgttactgaccggtactataatcacttattattttgaatcatcctcttgctggggatgagtcaatattctgaggaaaaaagcttcttatacattccttggaacacctaaaggatcttatgaatggataattccttttcgtctgtttcatcttttctcagaaaacaattatctacctcaaaacacattgtgtccttcattctggcccttcttccaccatctgataatagctgttctgaaatatggtccaccatgtgacctgcacaaagaaaaaaacgttcaatgggacaaaaattttttaaagtattcaactaaaaatattaactttatttcaactcttgatatttaaaagcctgaaagatattttgcaggtattttctctcataaaagactgaaaatggcataacttagaaggctttagaaagtgagattaggactgcgtgtggtggctcacaagtgtaatcccagcactttgggagtccaagataggtggattgcttgagctcaggagttccagaccaacctgggcaacatggcgaaaccctgttctctgccaaaaatacaaaaattagccaggcatggtggtatgcacctatggtcccagctacttgggaggctgaggtgggaggattgctggagcctgggaagttgaggctgaagtgagtgtgattgtgccactgcactgcaggctcagcaataaagcgagatcccgtctcaataagtaagtaagtaaataaataaataaataaataaataaataaataaagtgagattatttagcctatggtacagatggaaagtgctgtttattaatagtgagctggaaatacactccatctgtcttttccgcttcccatcaattggggatgggcttggcaaacatgcctcaacaacttctcatgagtttctctttagaatcctggggaaagtctgtgattaataataggatccttctaccctcaccttctccatttgcttctccctttggccccaattgcaaattgtcttattgtctctcttctgagaaccgaatttcttttgtgactctattttcaatggttcattcttttatatctcctttcctacctgcatctctgggacaagagaaagagagcaacttacctgagtcctcactgtttgctcaactctcattcctttgaattccaaactctttggccacattgtccttcaccttttctaatttctgtcatgctgtggtcacagtccttatatgaatgtcccaagagcacctcaactcattcatataggaggtcaccctccttcctgtaaagccttttcttcctcctgtatccccatctccctaaatggcatcaccatgacccagtcatttcatccagacacatctttaaactcttctctctcctgcaaccctcgtttgcaatccattaacatgttctctcaatcctccattattcttctagaatgtttctcttctcttcagccccactgccacagatataatccgggctctcggactgtcttgcatgatttagtacaaagtttcctaatgaatcctctggacttgttctgctccagcctgtcctccacactgttggaagactgactcaccaaagtgcagactggatcatagaagtcttctgttgtcatcctccctgcccactcccctcaactcagttgtgagtttgtgtctcagttgagagattaggtcaagtaggacagagtggagtctatgggtgacttttcttgggaacctttcccaatcctttccaagtagaatacaccacttcctccattgtacctcctcccacacgtacactgtatattctcctaccatagcactcacaatactacaacactctatttgttcacatggctgtctctgcctactagaagaaaacctcttgaaagcaaggactacatagaaaatagtgtctatgccctgtcctacatccccatgctgacttctgagcttttctgcaactgcagatgatagttacagagcatgcagatgatagttacagagatagttacaccttcctagcttaagtgtgggtccacctgctttgctggttgagggctttatccaatgccatgggaacttgttctgcacagctgcagagcaactcagaagtgccaagaatgtattgcttccaggacaaatctcaaccaatgagagatagaaatctgtgggaaaatactgcagcttcttggcccttgttaagaccattctgaggcatgatttcttagaggataaccagaggaactgagccccagttgtccacaacaacacactcattaatgcatcctttgctagcttttatcccttccctctcttgatttccccactcctcctcctgtgcttcctgggagcacctcctgaataaactaactacaccctaacacttgtctcaatatctaagttagtggagattccaaactaagacagacaatttcttattcatcttttggtacattttaaatgcttaataatagttgatctatagacaaaggaatacagtaatgaggggtgtaatgattccagaagccagatggcaagttgtcttagagtcagggctgatgagctgggatggaacagtgggaagtcaacagaactttccaaaatttaacaagtagtcagaaagaggctagggacagagactttacagaagacagttcgggcaaaaatctgaaaaatgaaccaatagacaaattagttggatagttgaagattagtatgaaccacagggttctatttagactggaaggggtggggatcactgttggaatgatttctttgagcaacaaggcagagcagggcacactgtgagacaaggtctcttgtttataactgatgctacatgcattccacagcttacaacctcaaccttcatgaattgctccactcatctttctaggctcatatctcatcatttctcctaagaaccatgctctcagtccctgtacatctatagttaaacatatggtatctaactatgtcctattatctcaagcttccactctcttgcccatgtgatttccttggcttagaagagacttccccaactcaatcaacctagctaacttacaattgtccttcaaagctcagctctaatattatctcttccaggaagtttttcgtgttctcttccccactatctcacaaaactaggcaacgctcttcttgcacacatagtacctgtgtacagagccgagtgcaccctgattgtggtctgcttctctgtctccttcactaaactgttctctttcttgggaacttcacacaaaatctaacacatttggaatgtttaacacagaggattctggataaatggcagtagcagtggcaggatagcttttgtcttcctaaatcaccacataaaaatagagagtgggccaggcgtgttggctcatgcctgtaatcccagcactttgggaggccaaggtgggtggatcacttgaggtcaggagttcaagaccagcctgaccaacatggtgaaaccttgtctctactaaaaatacaaaaattagctaggtgggatggtgcatgcctataatcccagatatttgggaggctgaggcaggagaattccttgaactgggaggcagaggttgcagtgagtcgagattgtaccactgcactccagcttgggcagcagagtgagactctgtctcaaacaaacaaacaaacaaacaaacacagagtgcctagccagcaaaaccaaaaactcatgatcaacagttataacaaaactgagtgacaacatctccccccacccccaaaatataaacaggtggaataagccactaactgctacaaagcttgagtcttatgttcttctgtcagggaggaagcagaaagaagcaagaaggcatcaaaacttgaaaagagaaaaaccctgaatcagtcaacagatatccaacagaaaacatgggagaagagggatatgaagccagcagctaacactgggaaagttcagatcatctctaataataggtgagtgcaaggggcaaatggtgagggcctaggggacaggggaagtccagcccctcataaactctccaaactgacccatcagggctcccttcccatttaagttctgactccaggagaaagtgctaggagtggaatcaaaatagagatgaaggtttggataaaaatgagtgggaggaacagaaccaaaatatcccagaatgcaagcctttaaatattttttaacactacctgaaaacagcaagaaggagctttgtgaagtttaaagagctaactgaacttccttcttctaaatgttcatgaaaagaaagttggccaatcaaatccacgtaaaaattaataacagaaaactactgaggtcaaattctatacaaaatttgtataagaaaatgagatacccatttattagaaagggggagatagcaacttgacaatggaggaaataatgtaattgtggaggtaaggagtaatgcatacttgagccagtgatatagggtcagaattgaaaaactggaaatgtaagaggcattggagaaatataatttctaggatctaagagaaggactatatttggaagactaagtggattttaaatctctctcaggtaggtaatgtgtgataggaagggttgtagtgttgttgtctagagaattttccttttctctttgagataaggccttgctttgtcacccatgcaacctcagcctcccaagcagctggaaatacaggtgcgggccaccatgcctggttaatttttaaaaaaatgtttgtagagatggagtctctgtatggtgctcaggctggtcttgaacccctgggctcatgtgatcctactgccttgacctcccaaagggctgagattacaggcatgaaccattgtacctgacgtagagaactttctatgtgacaggtacttgcattaaacatgtaattaatattttgaaattcaaacgcaataaaaatggtatagtatatgtaaataataataggtgtatttattgatatatgtaaattttctattctaatagattttaaattattgtaagattattgcaaaaataatacataaacatattaaagtacttaattcattaattcagttaattttcacaacagccttaggaagtagatgctaccattctctctactttatggattataaatctaaggataaggaagttaattcatttacccatagtcacccagaaaacaagttgaagagctggatttgaacgcaggtagttttgctacagactccaaagaatgacatctggaacaattaattaatagttctgtgatctctggcaattgtagtgctaagtctcacttttctcattatttttataaagtgggaataagaatccatgcattttgtggaaataatgaaatgagaaattgtaggaaaagcagtgctcacaatctgtttgttaggtctccctgccagactcagaaaaaaagttctgcagacccctggtgttcctttgcctgataccccttcccctctctttttcatctatttaaagtctacctgcccttccacattattttcttaaagcttccttgactacacaagcactaaattatttatttctcagaaaatacagatcttagagtttgtgaagaatttagaaccaaatacttgatacttctgtatattaatctctttttctgcgtgattcaaactgatcagagcagtgccatatattgagcacaacatgataaatagagccaggtttcacacttgctctgtaatgaatgcacagtcccactgctaatcggctatctgattctgatcatgtaccaaataagtttcagtttcttcatctataaacttagaataaaaaccaatgccttgatgcaaataagttttataaagtataaattgatatgcaaatgtcaggtcatgactaaatgctgataacttatcaaaaatgttaaaaatgaggctgggagcggtggctcatgcctgtaatcccagcactttgggaggctgaaggggggtggattgcttgagcccagcattttgagaccaaactaggcatggtgaaacttcatctctccagaaaaataagtaaataaataaattagccagccataatggcacacgactatagtcccaggtactcaggaagttgaggtgagagggtcacatgggtccaggaggttggggctgcagtgagccaggattgtgccactgcactccagcctgggtgatcaagcaagaccctgtttcaaaacaaaacaaaacaaaaaactaaaaatgtttgttagtgaaaaagatgaaagaaggatctctgaaaattgtctcctctgtaaaagcaagaagaacagtggcaaagatggtcagaatcagcttctttcaggactctaaaaattaacaagatttgcagcaattcaggtaagcatttatttaagaaaaatggacaaatctcagtaagagcaggaggctttgtggcattttaatttggactattttcatcccccttaacagctgtatgatagtcttaaaaaccaacagtccacaatgatggtaaaaagcagcacctgatggccactagagatgggagaatggggttcttcaaagtcccattcccagaaaattgttatttgattttttctgtggttttctggctaactttgatgctctttacaagcaagaaataaagataaaagtggagttataacttttagggtgaatgttaaaggcatgccaccaacaaacatacagagcccctaggcaaagactgggagacttactggttccaggcatctctaaggaagtttatttccaaacaatggctggcctctaagataactaagcagagacttcaggtggccatacacaacaaataatatggactttacagaattagttcagaaaggttatcaaacaaaaaataaatattgacgaggggagataatctggtttccagaattttcacattatgttattttaaatgtccagtttgcaacaaaaaattattgaacatgcaaaaaaaaaaatcaagaaagtatggcatataaatgggggatagaaaagcaactaatagaaacttttccttatagaagcccaaacattagccttaccggtccaagactttgaatcagctatttaaaatatatccaaagaactaaaaggcaacaatgtctaaagaactaaaagaaaatgcgaaatgacatcttaccaaatagagaatattgatgaatataggaatgataaaaagaaaccaaatagaaattctggagttacaaattacaataactgaaatgaaaaatttacctggaagaatcaacagcatatttgagcagacagacaaggcagtgaactcagagataaatcaattgagattatccagtgtgagcaacagaaagaaaaaaaatgaagaaaaatgaacaaagcctcagaaaccagtggacacaatcaagcataccaacatacacataacaggaagtcaaggagagaaggagaaaaaggggcagagagaatatttaaataaataatgtctataaacttctcaaatttgttgaaaactattaatatatgcatcagagaagttcaacaaagtccaagtaggataaactcaaagagatccacatctagacacataattaaactgtcaaaagacaaagacaaagaaagcagcaagacacaagtgactcatggtgtccaagtgagtctcaaaaagattgatggctgatttctcatcagaaaccagggaggccaaaaaggcaatggaattacatattgaaaattctaaaacaaaaaaaatctctatcaactaagaattctttatctggcaaaaatatccttcaaaaatgaagaaaaaattaagacatacccagataaacaaaaactgagaatttgttgttagaagttatgccctacaagatacactaaagggaatcttgaatactaaaatggacagatactagatagtaatatcaatccacatgaagaaataagaaacgtttataaagtcaactaaataggaaaatataaaaggcagtatagatatattttttgtttgttactcatttttttcctatctggtttttaaaggcagctgcataaatcaataattaaaaatccatgttaatgggcatataacatatgcatatgtaatttctgtgacaataacagcacaaaaagagaagagaataaagctatacatgaacaaaatttttcgtttgctaataaaattatattggtattaatctgaacattattgttataaattatgatgttaattgtaatccctaggacaatcagtaaaaaataattttaaaatatagcatgagggaattaaaatggtacaatgaaaaatatctacttaacacaaaagtaggaagtaatggagggataaagaaagaaaagaaggcataagcatacagaaaacaaatagcaaaatggcagacatgaatcttatcagtaattacattaaaggtaaatagattaagcagtccaatcagaaggcggagattggcagaataaattaaaataaaacatgaactgtggctgtctacaggagatatactttagattcaaagtcacagataggttgaaagtaaaagaatgaaaaaagatacaccatgcaaatagtaataaaaacagagctgaagcaactatactaatatcagatgcaatgcactgaatgtttatgttcccttcaaattcgtatgttgaaatcctaacccccaaggtgatggtatcaagaggtggggcctctgagagttattagagcatgagggtagcatcttcatgaatgcaatcaatgcccttataaaagagacaacagaaagaaccccctcaccttttccactatgtgaagacccagcgagaagtcagttttccattttcaaaccaagaagtagactctctgcagacactgaatctgctggtgccttgatcttggacttcctagcctctagaactgtgagaaatagatttctattgtttatatgctacctagttttgaaatttgcagatactaggatgaaatcacttttttgttagagccccccacaaaaaaacaaagccaggagaacatgaagggggagaattaatgcttgcatgtctaaagtaaagtctgtttcaacaactttatacaatgaccccacaaaaagtatttctttagggctgtggaaatttagataagatgctctcaaaagaacacctgcccagtaacagcatctacactaatgaactgacaccaactctgcatttgagtattcaaaagcaataaactgtgtttccaagcagtttatgtgaacttccctttttgccaatcaaagtttttctttactctcccctcttcagacatatatggccttggcatagctgtgcatcttataatcctcattctaattctcaaataaattcaacatatttggagacatttttctctggtgttttttgtttgtttggttggtttttttggttcacacagtctaagacaatatattatagtggtctaaaaggactaagacattagagaaattagactttaaggaaaacttgttgctggagacaaggatactctacaatgatgaaattatcaatccatcaataagacataacaagtataagcacatatgtatttagcaatacagtcccaaaatgcattaagaaaaactgacacaattcaagagagagatacacatttcaacaataatatttgaggatatcagtacctcaccttcaataatggatgtaacaactagacagaaatcaccaaggaaataaaagacttaaacaacactatgaactaactagaactaacaaacatctatagaacactcaacctaacaacagactacgtgttcttttcaactggacatggaacattgtacaggatagacactatgtcaggtcacaacacaagtcagaataaatttaaaatgactgaaagcacacaacaaaatatgctcatcaaacacattggaatgaaattagaaatcagtaatataaaatatttggggaattcacaaaaattgtggatcaaacatacttctttttaaaattttcaacttttattttagatcaagggggaataagtccaggtttgttacaggggcatattgcatgttgctgaggtttggggcatggatgatcctgcactcaggtagagagcatagcccgtgataggtagtttttagccaatttcccccttcttcctttcccccaatagtctccagtgtctatttctcccatctttatgtccatgtgtactcaatatttagctccatttataagtgagaacatgcaatagttggatcttcaacaaagctgacaaaaatgagtgatggggaaaggactctgtattcaataaatggtgctgggataactggttagccatatgcagaataatgaatcaggacccctacctttcaccatacatgaaaaataagtcaaaatgaattaaaaatttaaatgtaagacctcaaattataaaaatcctagaagaaaacctacgaaatacccttctcaatatcagccttggcaaagaatttatgcctaagtccccaaaagcagttacaacaaaaacaaaaattgacaaatgagacctaattaaactaaggagctctgcacagcaaaagaaactataggcagagtaaacagacaacctacagaatgagagagaatattcacaaactatgcatccaacaaaggtctaatatccagaatctataagcaacttaaataaatcaacaaggaaaaaaccaaataatcctacttttaaaaacgggcaaaagacatggacagacacttttcaaaagaagacagacaagtggcaacaaaacacatttaaaaaatggacatcaatactagtcatcagagaaatgaaaatcaaaaccacaatgagataccatctctcataccggtcagaatgactattattaaaaagtcaaaaaaaccagatgctggcgaggctatggagaaaagggaatgcttatacactgttggtggtaatgtaaattagttcagtcactgtggaaacgagtttggagatttctcaaagaactaaaaacagaactaccactggacccaggaatcccggtgctgggtatatatacaaaggaaaattaattgtctaccaaaaagacatgcacatgtatgttcatcacagagctattcacaataaatagcaaagacatgaaataaacctaggtggatgaagaaaatgcaatatatatatatatatacacacacacacacacacacacacacatataaatatacacatacacataccatggataccatggactacaacacaaccataaaaaagaccaaaatcatgtctgttgcagcaacatatatgcagctggcagctattatcctaaacaatacacttctcaataatcaatgggtcaaagaagaaatcacagggatgttggaaaacactttgagatgaaggaaaaccaaaacacaacattaaacttatggaatgcagtgaaaacagaggaacttataattacaaatatcaacatttaaaaaagagaaagctttcaaattaataatttaactttccatcttaagaaattagaaaaagaagatcaaaccaaacatgaaacaaatgcaaggaaggaaataataaagattagagcaaaataaatgaaatggagaatagcaaaactagagaaaatctatgaaacccaaagttggttcttggaaaaaaaatcaataaaattgacaaaccattaggaagaatgaccaagagaaagaatcaaattactaaaatcaggatgaaaataaaatattattactgatctcacagaaataaaagtattttaatattatgatcaatcgtgtgccaattaattaggtaacttaaataaaatgaacaaattcctggaatgacacaaactaccaaaacttattcacaaagaaatagtaaatatgaatagatctgtaacaaatagagattgagttaggaaaaaacaaacaaaacaaaacaaaacaaaacaaaaaaaacctcccactaagaaccagatagcttcattagtgaattctacaaagcatttaaggaagattaacaccaatctttcaccaactcttctaaaaaataaaagaggagggaagatttctcaagtcattttatgacaccaatattatcctgataccaaaaccacacaaagacatcaagaaaaaaaaaaaaactatggacaaatatcccttaggaatatagacacaaaactcctcaacaagtgctagcatgttaagtccagaaacatatgaaaaggatttatctcaggaatacaaggtagcttaaaatattaaaatcaatcaatgtaaagaaccaagataatagaataaaagatccaaaaagctcaatattatctcagtagaggcagaaaaagcatttgataaaatctaacataataaaaatctttgacattttgtaataaaagcactcaacaaacaaggaacagaagggacagttatcaatttgataaaggacatccctgaaaaacccacagctaacatcatacttaatggtgaaagactacttagtttttccttctaagttcaggaataagacaaaatgtctactcttgccacttctattcaacagtgtactggacagtctagccagaataaccaggcaagaaaaagaaataaaaggcatccagattgtaaaagaaaaagcaaaactctctttattcacagataatatgatcttgtacatggaaaagttaatggattatgcactgaaaaaatctattaaaacaaattcagcaagtatgaagaatgtaagatcaacattaaaaatcaattgtggccaggagaggtggctcacgcctgtaatcccagcactttgggaggccgaggcaggcagatcacgaggtcaggagatcgagaccatcctggctaacacggtgaaacctggtctctactaaaaatacaaaaaaaagtagttgggcgtggtggcgggcacctgtagtcccagctactcgggagactgaggcaggagaatgacgtgaacctcggaggtggagcttgcagtgagccaagatggtgccactgcactccagcctgggcaacagagcgacactccgtctcgaaaaaaaaaaaaaatcggttgtatttctgtatataaactatgaacaatttgatgatgaaaaagaattcaatttacaatagcatcaaaataattaagtgcttgggaataaatttaacaagcaagcgcatgacttgcatattgaaaacaacaaaacaccattaaaacaaactaaagacccaaataaataggagagacattctacgttcataaattaaaagatataacattaagatggcaatactccctgaattgatctacagattcaacacaatccctatcatatccaggtttttttgaacaaaatttacaagccaattctaaaattcacatgataatgcaagtgacccaaaataggcaaaaccgttttgaaaaagaacaaagttggaggactcgcatttctaaacttcaaaacttacttcaaatctacagtaatcaagatagcatgggataaagatagataaatgggggctaaggataaggagaagatacataaatcagtggaaaagaattgagattctagaaataagcacatatatcatggccaattgatttttgacaaggatgtaaagacgagtgaatggaggaaagaacaggcttttcaacaaatggtgctgagacaattggatattcacatgcaaaaaataaagttagagtcctacctcactttgcatacaaaatgagtgatagaccttgatataagacctaaaactataataatcttggaagagaacataggtgtaaatcttcctgaccttgtattttggacaatgatttctgagatataatagcaaaagcacaatagacaaaagaaaaatagataaatgtcaccaaaattaaaagctttttgtatcaaagaacactatcaagaaagtgaaaagacaactcatagaatgagagaaaatacttgaaaatgttatatctaataaggatttaatatccagaatatataaataactcttacaaatcatcatgaaaaaggtaacccaatttaagggtctgcaaagtatttgaatagatctttctctaaagaaaatatacaaatggctaatcaatgaaaaggtgctcaacatcattgttagagaaatgcaaatcaagaccacaatgagttgtcattttactagcattaagaggatgatagagtttggctgtgtccctacccaaatctcatcttaaattgtagttcccataatccccatgtgttatgggagggactcagtgggaagtaattgaatcacggggggcagttaccctcatgctgctgttcttgtgataatgagggagttctcacaagatctgatggttttataaggggcttttcctcctttttcttggcacttctccttgctgccgccatgtgaagaataatgcgtttgcttccccttccattgtgattataagtttcctgaggcctccccagccctgcagtactgtgggccaattaagtcgctttcctttctaaatcacccagtctcgggtatgtctttattagcaacttgagaatgaactaacacagatggctataatcacaaaatggataataataagtgttaacaaagttatggggaaattggagccttcaaacattgctggtggaagccaaatgatgcagccctcttggaaaacagtctggaagttcctcaataacttaaacatagagttgccatatgacctgaccattccgcatccaggtctgtacccaaaacaattgaaagtatacatccacacacaaatttgtacgcaaatatttaaaggaacattattcataatagctgaaaagtggaaacaacccaaatgcccatcaattgaaaatggataaacaaaatgtggtatagtcatacaaacaaaagtattcagcaataacggatggatgaacctcaaaaacattaagcgaagtgaaagaaaccagtcacaaaaagccacatgttgtatgattccattgatatgaaatatctataataggtaaatccatagagacaggaagcagatcaggggacagggaagaggaatgtgagttgattctaatgtgtacacatttcttttaagagtgatgaaaatgtttggaaattaaggagtggtgacagttgcacaattttgggaatatactaaaaataactacattctatattttaaaagagtgaactttatggtatgtgaattatatctcagtttaaaaaaaatacttgttgatggatggcttagatcacccattactaattaatccacttccaaatatgtgtccctgaatgtccaaaggcaccttgaatgtctctgttccaatggaaaaagtgcctgttgtatagcatgcctttagaatatctctgagatcagaacctccctcccctctctctgtgagtttcaagtcaatgtctgctcagatgtgcaaccaaggtaagcccaaaatgaatacagagtaattggactggctgctatgggaacactgattgcccagggtcagatataggtggggagaaacacattaagcgcttggtttgggagtgtgctgcaagtccagtacacacctgtggctccagcagtcaggaaaccttgtcccagaggcaccttcctgtcagagcagggcaggagacagcaagccaaaacaaagtccaaaacatcactttactaaggaaggctagaagccagaacaatcaaagaaaaaacacttaggtaaatacagagcatgagggaaggacctgaaatgagggatgtggacagatgtactaaaaaccaaatgttatttaccacgggaaaagtacaaagaacactaagtttagagtggagaacctcttttactactaattttgagtagtcttaggcagtccacactgagcctcagttttttcattctgaattggagaggttggattaaatgatctctgagaattcttttagcctttcattactaaattacagggcatagacatgagagctagacagcttgggttcagtttgtgactcttccacttacttacatgtgtgaccttgggaaagtcacttaacttatctgtgcctcagtttcttatctataaaatggtaatggttataacacctataattgttgtgaagaataattaaataaatttaggtaaagcacttaaaataatgcctggcacacagtacgtactgggcacatattaggtattgttaattaccttctgcagttctacacgattaccctgccagaattaaagtagcactgaggacaactcaccttctagtgtgtttctttctgagacgtactgcaaagaaggtatatgaaagataaaggggaagtctctgttcccaaagcaccacgctgagagaggaccctacatccttgcatggaggaagagaagtcagggattcattatttgacttggagaaatatcttaaatcggtgtattttttttttttttttttttttttgagacagagtcttgccctatcacccaggctggagtgcagtggggcaatcttggctcactgacagctccgcctcctggttcacaccattctcctgcctcagcctcctgagtagctgggactacaggagcccaccactacacctggctaatttttttgtatttttagtagagacagggtttcaccgtgttagccaggatggtctcgatctcctgacctcatgatctgcctgcctcggcctccctaagtgctgggattacaggcatgagccaccacacccggccaaatcagtgtcattttgctaatagttctatgatattgcctaattattttaagaagccaattaccaatagacacaaaatttgattatagtaggaaacatgctaagtgaaatgaggtgtgaaaaaaaggactcatttcagggcctaagagttaaaaaagagaaagatgtctttgtatatggacaatgagggaatcatatccagcctttttgatcatagcctcagtggtcttgaattggccctgattttgttagttatgtcatttctgaccatggtttgagatctgagtcctacgttctggcttcttccacaaaatggtgaactgttctattcatgaacaaatcaaaaggaatagaagcccttgttataaagagattatgatatccttcttggattgagaaacagaaagatctcaatgacattattataaacctcagagttaagaagaaaatagaagaggcgtaagaaggaaacaaatgtatcctatgtctagaatactgtctttaggaataaattttgcttaggaagaaaagaatgtattatttgaaaggacttgacttgcatccagtctttgtggggactgaagtgatacagtttgggtaccttctctaagaaaaagaatacaaaattaatgccccaaagtgtttaactttgatggggtccaattgatcaatcttttcctttatggtgttgtatatcttgtttaagaactccttctcaaactttgaggtcattcctctatacaatcttcttagattttataattttgatcattaggtttttaatcatctagtattgatttttatgtctggtataggataggagttgaatttcctttttccccatttggacagcaattgtttcagcctcatttgttttcccactgttaccactgctctgcagtgcccctctgtcattcctcacgtagaggtgtttctgtgctctatagtcatttccaattgtctatttctttatccctgaacaaatactacaccaactcaattactatggctttataataaatcttgacttgttttcaagcaagtcctcccatcttgttcatcctcaagagtatctttgacttcctgggtgctttgcatctccggatacatttttagaatcagcccctcacgttccacaaaaatacttactgggatttttattggaatttcatgaatatgttaaccatgtggggcaaattagcatctttacaatattgtcttccaaagcatgaacataaaatatctctcatttaaatgtctactttaaaatccttcaataaagtcttataaatcttcctgaagtggtcctatggaatttttacttaaattattcctagtcatttgatattttcagataactaatagtatcattttaagcatttttaattttctatttgttgctaatctatggaaatatagttgattttgtatctatcaaccttattaagtctaatattttaatcataggttcttttggattttatgtgcccaaacataatacctatgaataagtaactttcaaacccttgtacattttatttctttttcttgattagtgtactgctaggcccacagaagccatctttttttttgctaatcgtcttaaagagaaagctttaactatttcaccattaagtataatgttggctctaggtactttttaaaaaatagatacactttttaagattaagaaaatttccttttattcctcatttgctaaatttttatgatgaatggatgttaacatttattaaacactttgtgcaactactgagatcgccatatgatttttctttaataagttaagatgataactttcattataccatttactaattttaagttagacttacattctcgggaaagctcaactcataattctttgaatatactgctatattaagtttgctaatattgtatctagaatttttgaaactatattcattggtgaaattgccctataattttgcacttttgtaatatggttttgggattttggcattaaagttacaagctcagaaaatgagtctttgtcattttctggaagagtcttttccttgaatgttatgcagcattagccatgggcctggagttttctttgaaatcattttttttaactactcatttaatttctttagtggtctagcaacgttcagatttctatttcttcttaagtcagttttggcaatttgtggggttttttaaagatatttatccactttatctacattttcaaatgtattgcaataaagtcatgtataacatattctgactctttaaaacctgcagcaactggagcgataaaatttttattattcctggtattagttatttgcatcttctctcttttttcttaattaattgcattaatggtttgtcaattttattaatcttttcaaagattaatcttttgtttttgctgactctattgtatgtttattttctatttcattaatgtctgctccaatctttactatttatttccttctattttatttgggtttaatttgtacacatttaaaatatttcttaagaaagatgctctctatatagttccagagcctctccgtttcctggtagcttcactgggtgggttcctcacatggtctttctagcaggagactggacattttaaatggagtctcagagcttcaaaagatgcaaaagcagaagtttccaggccttatttaaacttgctcccagagctggcacagtgtcacttacactgcattttcttgaatatagaatcagaaagccagggcagatgcaaagggaggggaatagctctacctctcaatgaaatgagtggtagctcatttgtgattaccttcagtttatcatatttctcatgcatgtattttgctgcacacgtacatgttattctcttgtgtatatgctcatactcaatatatccaatgataaggtatttatttatttaactctattaaattagactattctccaaagtgttgtattaatttataccattaataatgtttcagagttcctattgatcaacatccttaccaacacttgatagaatcagtcttttttcatttcagccttttgggtgaatatgtagtagtttgattgtggcttcagttttcatttccctgattactaatgaggctgattctcttcccatacgttaattagctatttgggtttccttttttgtgaaacgtcttttcaagtctgtgactcaatttttgttagatggtctgtctttacatttatttgtataagttcttgatatatctggatatgagcttttaccagttatgtatattctaagtatcttctttttattttgtggcttaccaatgcattgtcttcattgtgtctcttctgatgaaaagttcttggtgctagtgtatttccatttattcatctttataattaatgctttttgcccacatttaaatagtctttcccaaccctaatatcatgaaaatgagaagattttttatattgtcttctcaaaccttattgatttaacttacacatttaaatctgcaaacaacctggagttaatttcacgtgtaatgtgagatatttttcatcccatgtggatatctatttgacttagcactgtgtattgaagaaagtgttgtttccctccttgcttgtcataaaccaaatgtccatacagttattgatctgttatggttagaccattctcttccattcttatgttggcatatccttgtatcaagaccacaatgccttcatcccgtagttttaagtaagtcttgataactgatagaataagcatttaatgtcataaatttctttgtaggtacagttttagttcatccaaaattttttataacatgtatttttagttataggttagttctattagttactatttttctttatgattttatttgatccattagttgtgtagaggggtatttcaaatattaaaatgtaggaaatttttaaagttatttttgtgttaattgcagaaattcattactctctggtcaaaaagcatgatcataatatatctcatttaaatttgttaaagcatcaatgtgtattctccaaataacctactgatttttttttctggatctatcaatctgagaaattgagagttgtaagagagttgtgtcaaaatctctcaccatgatggtggctttatctatttatcttcatggttttgttaatttttactgcatatgcattgaagccttacttgtacatataattttggaaatgtcattttcccgatgaaatgaactatttgttggttaagctattttactctggctttttttttaaaagtccgttttgtgtgacattcttctcagctaaaaacccagcttccctttgatatttctctgaccttttttgacaatttaaaaaataatgattatctttccacaattcttggaaaattctcagccaatattgcctctttccagctctctgttatccttttatgaaatgccaatcaaacatgtgttagtccttcactttctaagcccatctttttacccctttcacacactgcatctttttgactctctaaactacagtcaggaaattttctttgattctatcttcaggtttactaattctctcttgatctatgtctaatctattatttaaacatcaaatattgaatttttattttcaattattatatttcttttccaaaattttatttatgtataattttatatatgtataatagtatttttaattagtagtatttttaataggtagcacgttttaattagtatgttttttatatatatgaaaccaaggtatgtatgtatgtgtgtgtgtatatacacatatacctacctataggtatatatatatacacagatacatacacacaaacttacctattccatgcaactggaatgtgtgtgtgtgtttatatgcacactcagaaaatattatatacatagtatcatatatatatgccattcactacataacaatgttttggtcaacagtgaaccacacatataatgataatcccttagattttgatatgttttcttttcattttcatttgtttaatttccatgtgtttgtgtattttttgagtttccttgttgttgattctagttttattccaatgtggtcagaaaagtacttgatataatttgtacttttatggcaatttgttgatcttgtcttgtggcctaaggcatggtctattctggagaatgttccatgtgctgatgagaagaatatgtattctgcaacagttgagtgaaatgttctacgaacatttgttagaactactgggtgtagtgtgtagtttatctccaatatttctttgttgattttctgtctggatgatctgtccattactgagactggggtgttgaagtcacctactactattgtatcatagcctatctctctttttagatttattagcgtttgctttatccaattggggcctcctgtgttgagggcatatgtatttatacttgttataccctcttgctgaattgaccctttatcattatatagtaaccttcctgtgtttcttttggtagcctttgatttgtagcctattttatctgatataagtatagctacttctgctcattttttgatttccagttgcatggaatatctttttctgccctgtaactttcagtctatgcatgcctttctagatgaagtgagtttcctgtggacagcatatagttgggttttgtttccacattcactctgtgtcttttaattggagaattgataagcaaagacttactattgccattttgttgcttgttttctggtggttttgcagctcctctttttctttgtttcttactctcttcttctgtggttaagcaattttctctggtagtatgttttaatttattcctttatttttccagtgaatctattatatgtttttgcattgtggttaccatgatgcttacaaacccatgtactttagtattgcctacacacaaggatatcctcccacatgtatgcactataaccatcaaaatcaggacattaacaccaatacattactactgtctaatcctcaggccccattcaaatttcaccacttgtctcagtaatgaattttataacaaaagaagccattctagaatcatgtgttacatctaattgtcacgctttcttagtctccttcaaatgggaacagtttcttagtcctttctggcgtttcttgatcttgacactttttaacattacaagccaattattttctagaatgtctctcagtttgtgtttgtctgatgtcttttcatggttcaattcagcaaggacacaataaatgaggcaagattctcaggctaagggtggaaagtgagctcaagagcacaggtggaaagacgagccccagtcccaaagaatggttttcttaggagatgaaagctataaataagattttaaaaataaatgttgagactgattacagggaagttagaggagcttgtgtcccatggcctcattcttcatggccaagcttcctgaaagacaactctgcctccacttcctcttcacccatgcactcctgcccccaccaatttagagaagcaattctctctttaaaggtcaccaaggaatttatgattgtaaaattccatagccttttctcggtattcatccttcttgaccttcctgcaataaccacattatttttttctttaaacagctatattgagataagattgagataacatattttttctttaaacagctatattgagataagattcacatattatccaatttatcaagtaaagtgtacaatttaatgccttttagtatacctatagaattgtgcattcatcaccacaatctattttagaacacttcaaggaaacactgctcttcttagcttccagtccccaattcctccacctgctccccagcccttcccaaccactagtctactttctgtctctatggaacattttatacaaaggaatcgtataatatgtggtcttttgtgactggtttctttcacttaacataatgttttcaagcctcattcatattgcagtatgtatcaatccttcatctttttatggctaaataatattccattgtatagctataccatatttgtttatccagtcatcactcaatggacatctgagttgttttcactttttggctattgcaaaccatgatatttctgttcatgttaaaattcttccttcttttggtgttgacaccattgtatgtcatctcactttaatgattttctgacaacttttgaggaaagaaagaaagaatgaatgaaaactagctgaccagcctgatattcagaaatctgcataatatggattcatttttctcttatctctgttacatattcccttaattagaggcaaaccgtattcagtgatttgaagcgtctgaatttttagatgttttttccatttgccattcttgccaaagatagatatcttttcatctttcatggactaaaatatcataccaaatatttgagacttatttcaaatgctaccaataacttttccataatccttctaaactaacttttactaaatgtttatgttctttgtttctgctactgctgtactctctttcctaccaaacagttagtccttgagggcatggattatgtcttccctttgtgtgtctaaagccccttgcaaagttgatctatttgaaatagggacccaataaatacttcgaaacttctaggggaaatcatataaattgactcaatgtttcaaaagaatatctagataattgggggaaagctatctggggattctgacttatacagaatctgaaacttcagttttctttaagttaaggcacgaccacagaaaagatgattattgtcttctgaataattcctattatattccatttgaggtaatgactcattgttttaaatatactgtgactcaacactaattctaagtcagtatctatatacatgaagcaaatggtgagtgacttaaaaaaataattgattcactagacttaggggcacataatttccaaaacggtatttttattgaaaataaacaacagcaacaacaaaccaatacagctacatacagcaggtaatgtaaagtcagggagttctatagtcaactgaatggaactaccaccaaggtcatgcatgatatgcctgggtttgtggcagagaaagatttctaagactgattttaaaatagtaaaaaatgcatcattattcatccacaaaagattgctaactataataccacttatgaggtattctggcctataaaatttgaacgtaattctaatcaagactctagatcaaacacccattttacatgaaatacagaagatagaggaacaattgaaacaaaactgtaagtaatcagctaaatcctgaatgtaaacattccataacacaaataacgtttttgtttttgaacaaatcaatgtcataaagaaaataacaagagattgaggagtatttcaaaacaaaaaaaacttacaagagttataacaataaatgcaatatgtgaaccttgtgtggattccaattccaaaaaattgactatagaagacacctttaagacaacagagaacatttgcatatggactgggttatagattacattaaggaattcctcttaattattttagatgaaataatgttctggtggtaagttagagatacatactaaagttttaacatgagacatagcttaatttttaggatttgctttaaaatactgcagaaaaaggccaggcgtggtggctcacgcctgtaatctcagcactttgggaggccgaggcgggtgggtcaggagttcaagaccagcctggccaacatggtgaaaccccgtctctactaaaactacaaaaattagccaggcatggtggcaggcgcctgtaatcccagctactagggaggctgaggcaggagaatcacttgaacccgggcagcagaggttgcagtgagccgagatcatgccactgcactctagactgggtgacagagagagactctatctcgaaaaaaaaaaaaaaaaaaaaaactgtagaaaaacagtgaagagaggtaaaatgcatttggtaaactgttgacaagtgttaaagctgggtaatgggtacactggggtttattataatttcactcttcttttgagtatgtttgaaatttaccataatagaaagttttctttaaaaaaagattactaatatgaaaaatttggatttaagtgaaatataccaagtacttattatgggtgagatcctgtgctaggtgtaacatttttatacatgatactttacataattttcagtataatcctgggagggagatatttctttccccattttatatatgaggaagccaaggctcagagagattaaagaatttatgtggggtcacagagttggtcaacagtggaattagaatgcagtcagccccaatgactctaaatccgaagctcacagctacatcacagctatttcataatcttttcaataatctgaacatgattttagccagaaaaattaaactcattattttcttatattattacagagagatagatcagaaaagaggaaatgaaaaaattgagggatgcacttctttctgtaagtggataaaaatcttacaaagaataaaaaagtgaagaagtagcaagtattactgatcaaaagggacatcaacttttggaaaggaaaatgttttaaggtaaatagtaggacaagaatgtgtgaagttggtgaattttggggaaacttcgaggaaatcagataagatcattttgaagattgctgataatgaactgcactaccccattgccctagttacacagcctctccttaattactaatatgttagtgagaaaagccacttgcaaattaggtaaaactttactaggggccaaccaacatgttatcaagctacctccaccttgggaaaggtctagggaggagtttcagaagatttatgccgtaggcaaaagatgaggtcaaaagaagatgtacttggtttgtaaataaaacgaacaataccataccagcaagtctgagaatgatttggttgcgtggttatgccacaccttccactaatgcagtcataatcagtttaaataagcttagtatttgtgaatccaccttatcccataggctaaaaatagaccactgctgcatgggaagcaattccagcattggaacactttctcctggtataccctttgaattaatttaggttatcaatagctgataaaagttcctttgtgtaaccttaggccattaataactaataaccagtgttagtctcctgccttaattgctaaccctgctgatggctgctaccaaggagagtcaagcccccaagggtgttacgacaggcagaggactgagtaatagaatgattagagtcagttgattaagcccaccgcaggagtttgtaccattatataaactttcttgcacatgtcagagctgacagatagagaagatatgaatcaaggctttccttgctctgtcatcccattcttagccattccttccaatcttcttccttttctttctattcaggtactctaatgactgtcttgaaagagtcaacttatagacattttcaagttaaatgatcagaaccctttgaagtgaaaccataggctgggtgtggtggcttgtgtctgtaatcccaacactttaggaagctgaaatgggaggaatgcttgaagccaggagtttgagaccagcttgggaacatagcaatatcctgtctttgcaattcttttttaaattagctgggcatggtgatgcattcctgtagtcccagccatttgggaggctgagatgggaggatcacttgagcccaggagttcaagtttactaggagctatgattgcatcactacactccagcctgagcaacagagcaagaccctaaaaataaaataaaaccacagaaaacatactgattacctttggtattttccagcagatccactttctgggtcccccctggttatatgttgcatatatgcatataggacaatgacaagttgcacaggtgtccttcagggctggctctgcttttcacttatcttcccctagaactcagcaatccagccgaaaagacaagaggattttacaggccaccatatttcaaccaggtgtctatgcaaatctcctcctgccacagacaatatccttgggtgatcctaggaaattatataacattagtgaaagatcacagctcccacccagtagacacatcaagataaaataggctaaataaacatgtctggactgaattgtgcccttcccttcaccttagttcatgtgttgaaatcctaacccctctatctcagaatgtaactgtgtttggagacaagacttttaaaggagtgattgaattaaaatgaggcccttagggtcgccctaatccaatctgactggtctccttataagaagaagaaatctgggcatatagagaaataccagggatgtacatgaccagagcaaagaccatgtgaagaggcacaagatggcagccatctgcaagccaatgagataagcctcaaaagcagccaacctagccaacaccttgatcttggacttctagcatgcagaattacgagaaaataaatttctgttgttaagctgtccagactatggtattttgttatggaagccctagcaaattagtacaagtcatcacttattttgcctactgaccatgatgatcaaagagagaaagagagtcttcaagtattcaagcatcagacaatgggaacccttaaatcttgactggaaaattaggctataaaagaaaaaaaaacacttatatatacatatatccacacatacatatacacataaatgtgtggtattaaattgccatactgattccataattatttctttatttaatttaattttatttattattattatttgagacagagtctcgctttgtcgcccaggctggagtgcagtagtgcaatctccactcactgcaacctccacctcctgggttcaagagattctcctgtctcagccacccaagtagttgggattacaggtgcccaccaccacacctggctaatttttgtatttttagtagagacagggtttcaccatgttggctgggctggtctggaactcctgatctcagatgatctgcccgcctcggcctcccaaagtgctgggaatacaggtgtgagcctccgtgcccagcccataattatttatttactgctgttagttctctggaattgtggtaataataacaacaacaataataataatgtctaatgcttaaatcgcatttactatgtgccaactactatatccacttatttaacctaaaagagagagacagagagaaacaggcactagtattatccacatttaaaaagcaaaggaactaaagcatagggaggttaaataattgctccaggtcacagaactaacaagtggcagagttagaatctgagcccaaatacttggttccggaatctgggttgttaagcatcacgacaccctgccaagttttcacgacctagtagagaaggattgagatctggggtagacccttgcacaggactagtgaaagcctgcccatattaaaagaattagcagttaagatctgaacagtcacccaaccgttagaatatgattgctcagtatgtcactttgtggataaaaaaaaatgcaatgattataactgtgcagtttgcctttaattactgtctctgtaaagctacggcctaaatccaccacattttctggcatatagcaaaaagaattctgaattggaaagtcaaaatatctagcctcaaggccctgatttatcattatgagccacttaaccttgaggatgtcacttaacttagattggggaaggttgtcttaactgtaaaatgaaaataaaaaataagactgtggacttgatgtgaggattgagtaagataatgagtaagattctagtagagagaaattgctcaataaattccagaaaagttgaataaaacatcctactaagatgaaaaagaatgcatgacaatgaattaatattttattgccaacgattcttaaatttagagatgagtctaatatttggtaggaagaataaaacataaatgaggtggagaaaaaatttaaatcattttctttttggcctgcatcactttcctaaatatcccttagatgtttgcactctaccatgtataccagacaattggtagcaattaaagagtcctgctctaggtggtgaaggctatcatacaattaacaatactttatgcaactaaatcatttgtgttaataaatacatggttattccttcagtatttacaatcatctttggtgtcaaatagtatgcagtaatgtcaaaggcatgtgaaccagaacagctccatcttgaataggagctgggtaaaataaggctgaaacctactgggctgcattcccagacggttaaggcattctaaatcacaggttaagataggaggtcagcacaaaacacaggtcataaagaccttgctggtaaaacaggttgcagtaaaggagccagccaaaacccaccaaaaccaagatggctacgagagtgacctctggtcgtcctcgctactgcactcccaccagcaccacgacagtttacaaataccatgacaatgtcaggaacttaccctatatggtctaaaaaggggaggcataaataatccgccgctggtttagcatatcatcaaaaaataaccataaaaatgaacaaccagcagccctcggggctgctttgtctatagagtagccagtcttttattcatttactttcttaataaacctgctttcactttgcactgcagactcgccctgaattctttcttgcgtgagatccaagaaccttctcttggggtctgaatcgggacccctgtcctgtaacgtgttaactatactatagaaccccaggactaaggttccctctgaacccggatgctgatgagctagatgaagcaggaagtctagataatgagaatgacatcatgaccttcaaacgtggggagaagaaaaggagaaagaaaccgattaagaggagcaggatttttgccactagacatcattagggaggaacgagggcatcaatagacaatagactgaaagtctaggatctggatataagggagcagaagaaaaggatgattctccacagtggggagtggtagagaatcagctcaagcattttgcctcttactttttggttacatgaaagtaaaagagttccaaaacaaaactgaaattaagaaaatattccttaaaaatggaaattgctttcctgccctaccatccctcctgcatggcctggataactctgacaacctcctctcggttttcccagcccctaagcagcccttcccccaccacctatttccatattgcaccaggtctgtctttctcatttgcaattcgtaggccattacctgataaaaaaacaaacaaacaaacaaaaaacaccttcactggttcctcaatgtttgttagttttaatttataaagaaaaaaaattatttctcccagcaagcaactccttgacatgacttgtatctgttatcttattgctgtgtaaaaaattacccccacagttagtggcttcaaacagcaatagtcatttattatctctcatgtttactgtgggtagacattagggcagaatacagcagggctgacttgttattgctctgtgatgtctgaagccctgcaagaagacctcacctctacatgaaggaatgtaagctccatactgtgggatggaatgtgtatccatgaggccatctttggaaaatacagtctgttacattaattacttagcagcctacgttttaagcatcatttccatctattctttaccattcattctactctctttccatatggaccttctggttgttgttgtttttttttctttgaacatgataaacttttccaagtttctgttcccttgtatatgcggcttccttcaccctgttaacacccaagtgaaaaacttcttatgcttcaagttcaaattcaattgtagcttctctgtagagcctcgtcctggcccagaggttaactatgccctcccctaggctcctatctatgttatggatatctccatcataccgtgttatctcttagaattgttatcctcaccagactgtgggcaacttaaagggaaggaccaggccttgttcatttttctacgaattcccgttattctctcctgaatgccaaatatttaacacagtgctttatacaggtactgctcattaaatgtgtgttgaatggctgaacaaaattttaaggcaatcttcggaaaaatataatttcaagggcaagttgggattcttggtctcctattacaaatattatttcactgctactgttatctgaaatactttattcttttaggccttatattaatacttaagacagagcggggggaaaggctggagagaacaaatactgagcccagcaaaacagttttcagtcaaagtatggatgacaaccgcagagacatttctatggctctagggaagaaaaggctgagcacaggagactctgggggaagaagaggcgaggctactcatgaggggagatagaaagcaaaaagggaaggctggaagcaccagggataagtactgctgggctcaaaaatttgcccttaggcagatcttgttcatcttcagctgtctctggacaaatagaagctggatgcaaaagtaccccaggctctgcttgatcctggttcctcagtggccacacagtccaggattttcctcccctctccttcctttcttccttcccactgctcaagagttgcagctgttgtggccccacagggctgaaggagtgggagggaggcactccactgccaggatcccacactcccaggagccccagggtgaatctcagatggggctctggcacagacaccagtgagatgatgataaggtctgcagtttcatccacagctattctgccttccagtctctccattctgattctggcccttattttctggacttctgtaactgatgtgtctcccaggatctgagtttcctcatctgtcataaaaggtgatggg

SEQ ID NO: 15232 - DNA, 35837 bp, Human
atcctttgctgtgatagctaatgcttgcaatcctgacatgaaatgtccatgaagttttatttaaacagtgagacatggcttcatatttttctattaaaaaattggatattaaaaatgaagtataaagtttagtctccttctttttcccatttctcttatccttcttcatcttctttactttttgtgcgtttcttaaaaagcacatgtaagcaaaataataaaaaagcaaccaaaggaagaaggcacaatagtgacaggtaacgcaactttcccatcacatttaatccttccatgttgttcttaggaggtgggccactatcagcactacctccatagcctttgtccttgcagtatgggggtgcccattcatggttgcagtgacagtgttgtttgttgttgcagattcccctcatgttgcaggtcttaggctgacaggcttgtgacagatgaaccatactggcacacttcttacggatgcagatcttttctggaccacatactgtgccatctttcacctcaccaatatcaggtatagccatccctaaatgataatcagtgccccagcaagtggtgtcattgaggtgaaactgctgcactgtagaatgctctatcagattgggaattactcccacattttcacactgaaccctcccacacatgatatcaggggtccaacattttacatatgttgtgcctacaataccacagtgaccgaaacggtttccttgggtgttgatttcttggtagcaactctgagatgcactccttgcatcttggccaaaaatctctttacattgtatatcatggttattacacgtcttttcatagcagaaggcattcacattacaggagatcccgtcctgcacatacacatcatctgggcattgatgggatgtcccattgcaccactctggaaggtcacattcaccaacttgttgtctacataaagttcctgatggcagaaatttgcagtctttgcaacatattccaaaagcacaagcagccccaggatgtagagtacagtttaacagacaacagggatcttttgcacactgccgtatggttccacagtcacattcctccccttcttcaaccactagattcccacagtacttcagtctaaatatattccctggatatggaggcggttgaatacataatccactactgatagtactgtcccaatattgggcataactgcagttgctaaatttagttgtcacctttctataggcatgcattatgcaccactgtagctcgcacacacaccactgggtgtcatgttgcatacccaaattatgaccaagctcgtggcccaaagtaattgcaaaaacgaccaacctgttgtcttcaaaaacatcaactccagtattaaaaggattctggcatattcctttaacataggcaacaccaagcttcatgccttgtgtgtcttttatgaaaagatgtgcaacatcatgttgtagtcgattattaaggttataattcttccaaatagaaaagtcctctaaaacattatctaggtctccactggtaggaagtggatttgatgcagtccatatatcaattccagtcaaaattacatcaacctccaaaggatgatagaaggaatccactatattgacaacgttaaatacttcatgctgcactgttgttgcattactttgagagaaaagatatctaatattatccacgaccactaccagctcaacaaaccgctgatgggtccaccagcccacaaaagaactttgcttcagagtgaaattatatgacaattgcaactccatctggtgtgctattttctcttctgttaacccacatctcataggtggaaactgtgtatcatcactgtctatcttatatactaggtgttcaaatgtggcagaaacactaattggcttgatttcataaacaaggtcatttatctgtagcattccaagaaagcccccagaacaggtactaagggcaaccaaggactcagggaccccctccacataaccatggtagtagcagtcatcctggatgaagggctgatcctggagcagggcatgctgctctgtgtaggtgaacacaggaaggtgtgcagcaaacaacagcttatttaccctcatgtggacaatgtatctctgtcccccaaaccgcaggctataggagagccatccaggagcctttgcacctctgcccctgctgatcaccttcaaagggatcaccacttctggagaagtgaaatactgggagggcctggcctgagagtggccagaaatagacaaaaacatcccaaaccagagcagcagaagagtgaccctgatgtgcaccaggggctcacccactgccattatgaagctgtcattatggagccatctgtctagagcagaagagaacaaggtgtgaggcactgctggtctggctcctccctctgagctgttcagggtgcatggctgacctttagggatctggggatctgtgtcctggtggagctggaccatcagagctgcagtgctgaaaataaaaactgaaagagccaggatggggtgggtgggatagaaagggagaaagagagagagaaaaaaggcaaagtgattcctgcatttggaccatatttgaagcaataaaatgcattaggattctcttaatacatatggccaagaagatttccagataggggagattgcacataggtgagttattaccaaattttcatgatggatacctaaagattcattatatactgttcttaaaatatgtaaaatggcaagacattttccattttattttaatgtatgtatttcttttattatttccttattttacagatggggtactgctctgttgcccaggctgtagtgcagtgacacaatcacagcacattgcaccctcaaagtcctagactcacgagatcctcccaccttagcctccaagtagaactgcaggcatgcattgcaacagccagctaatttttctttttgattttttttggggggatagagatggagtctcactatgttacccaggctggtctcaaactcctggtctcaagtgatcttcttgtctcagccttccaaagtactgggattacaggcatgagctgtcataccgagcaaaattgttcattttaaagacactggattctgacacaaatctttcttccaaccaaaaacctactggcaacctgcacattcaataagtatatggacaacacatccaaaatccaccattctttgttcctttattcatgtagtttgctccatctcccctcttctatcccagacattttatgtatacctaattgtgctctaaattgatagtcaaaaaagccccactaaaagggcttactagtattgagaaacctcctccaatcaagactttttaattttataatatattcttatctgcagaaaagccctgggcattctaaggaaggaaggcatgtgatagggtaacagggagtgaggcagctgttttgggacagggcacacagccaactagcatcatgatctctatcataagaggctcctcctggtcatgtcaatacagatttgattctacttttcacatggctgatgagttacctggatctacacatttcaatctcaatgttccaaagaaagcctacacagaggagcttaagcctagagtccattcattctaatgttcagaagaccacaatttgagtagacttaaaaacctcattactgttgaaaacaaattttggctcaagtaaaagctaactttgctcagttcctgactttcacttaaaaatgttgttaatgatttgctcatatttgaaatcaaaatgttaaaacaaatttggagacacgttgttaacacatactggtggcctcaatattctaagagcacaaatgagcatgtgcaacctccttagcattatgatgtcaagaaaacctctatccctccatgtgggtgtccagaactaatggatggccaccggatgccacaagaggaaatcaggatcactagatgagacctcttaggtaaagtatatctgatagaggtgaaatcccaatttagatttcctctccatagctctcctcataatatccttggtatgtgtcatagagtttggaacattaagatggaaatgggtgaattgagagaggatcatgacagaaaaagccttgtagagaagataaaacctatattacatatagtcagaaatatgatgaggttataatacaaaagtttattccaaagaatctgtgataggccagtccttgtcatcaatgcattactccaaagacaagtcttaaaggaacattgccttcccattaattttgtgaacgggtgtattctgaaggcctttcctctaatattactgggatttcaaccactgtgagaatcttcctctgcatcagtaattaactctttcttctaattccagtaacaatttaaaactcatcaacaccctatcttatgatctctcccctcactcacagtcacagcctaattttgtgtttctcaaactcaggtcacaaactgtaaatcaatgtagtgggccacaaccaaaggaaacacaattgtgttgaaaatatcagagggttttacacagatccttagcaagaccttcaaacactgtaaccagagtttatatttaattttctgtgtctgtgtttgtatctgcacactcccatgctcactgagtctcaatgtaaactaagctaaatttcttattgtgggtcacagtcaaaatccactggaagagcagtagccaaataatgaaaatgaaagattttggggaaaactctgtccctctttctttgctgaaaataaaatcctatctgaaactacagtcattcttatctctccctgggatcttggattcaatttcagtgaaagatgtatcttcctccagttccagctcatagcccctctatctgtgctatgaatcctatagccttacctacttgaagattgactcaactgtcagatttatcctcaacttttccttcattactttctctttatttccagtacatgaacatactcaaatctctactaaccttaaaatatttatcttcctttattctcacatactcccatggctaccaccttgccactagaactttctctctttaatggacaagaatcacttaccagcaaactgaacaattatgcccatagttcttttaatggccacgctcatcagtggtctgtattgccccctcaaaaaacaaatataagaactgacatctcacatgtcaaaagtaaacaaatctctgtagatctcacagaggattaagttcttaatctcgctgctcagcaacaaggtcctctcagttacagatcacaccatgtggctcttaaagtcaattgactctgcctccaccacctctatccagttttctttttctatccctcccctacatgcaagtgtcaggtcagcctcttcaaccccatcttatgagctccacacacagcatatgctcacttctgctttaggaactttgttcatgccctacccttatctaaatcatctaaacctttcctcattcttgaaccacattatagtatccttcaatgtttagattaaattcaacttctgctttgcatcattaatattctgtaaacttctgaataagcatcatatcctgtgtttgaaatatttatgtatatggtctgcttttttatgtgtggttctaccacatcaccagttaaactataatttggtagaaaaatatagcagaaatattgttattgatataaaatgttcatacttttggctaaagaaagcttagtatccttaatataattatgttaaacctgcataaaacaaaggtgaatgtgaagttcaatacaatattaaaagcaactgaatgatgatgcactcgcagtgggcgggggagtttggaacaacaattgggagacaattttatatctttgccatctactatcttcttttttagatatggttgtgaggaaatggatcagaaagtgaatagataaggatcacttaggtccatcttctaagaaagtccttttcattttcttttcatgattgtattaataactggatactttatttcttttcatgattatattaatcactggatacataggtttcccctaatgtatagggggttgaactgttccatatgtccaggtagaattggagaatccttcttaggatgtgttaaacaaaaaggtttcctcattccagagcttagtggagataatctgaccatgccagatttgactgacaatgatgaaagaaattgtccaagaaatgagaggcttgggaaaatacacaaacccaaacctggaaaggttttgacaaggacacagtagatgatgctatcaagaagagaaaactataaacaggctgatagatggccacatgaaaagagagaacctccttgagtctgacagaatgggcaatcacctggaacatctgtgttagacaatgactgaagcttcctaaagcaggtttgactacatcttgtttgtagtaaaaataatttcatatgcatctaaaagcaaaacaaactgttacaagagacaaaagatgagactatataatgataaaagggctcaatttatcaggaagatataacaattagaaatatatgcacccaacattggagaacccaaatgtatgaagcaaacattgacataatttaagggagaaatagatagcaacacaataatagtaagatattttgataccctattttcaataatggatagaacatccagacagaaaatcaatttaagaaactgacttgaaccatactatagaccatatggacctaacaaacacacacagaacattctacccaacacatcagaacacacattcttctcaagggcacacaaaatattctccaggatagttcacatattaggtcataaaacaagtcttaacaaatttaagattgaaatcaccccaagcatctttctgaccacaatagaatgagactagctatcaataatgtaatgaaatctgaaaaattcacaaatacactcatttatcacttaacaatggagacaaattctgagaaatgtgttgttaggtgatttcgtcattgtgcaaacatcatagagtgtacttctacaaacctagaatggtatagcctactatacacctgggctatattggatagcctattgttcctatgctacaaacctgtacagcatgctactatactgaatactataggcaactggaatacaatggtaagtatttgtgtatataaacatatttaaacatagaaacagtaaacatatggcataaaagatataaaatggttcacttgtttagggcactcatcatgtatggagcttgcagaactaggagtttctctgggtaagtcagtaagtaaatggtgagtgaatgtgaaggcctgggacattactgtacactactgtaaactttataaacactgtgcacttaggctacaatacatttatttttaaaaatttctttaataataaattaaacttagcttactataacttttttactttatatacttttaatttttcaacttcttgactgttttgtaataacacttagcttgaaacataaaacattgtacagctgtacaaaaatttttacatcgtaggccaggcatggtggctcacgcctgtaatcccagcactttgggaggccaaggcgggtggatcacgaggtcaggagtttgaaaccagcctggacaagatggtgaaatcctatctctactaaaaatacaaaaatttttatatccctattctataagctttttctatttttaaaattattttttcttacttttaaaattttttgttaaaaactaagacacaaacacaaacattagcctaggtcgtcacagggtgaagatcatcaataatcactgtcttctgcctccatatcttgtcccattggaaggggcaatagcatacatggagctgtcatctcctatgatcacaatgccttcttctggaacacctcctgaatgaactgcctgaggctgttttacagttagctaacttttaaaaaatatatgtagaagtatactctaatataatgataaaaagtatagtataggaaatcttttatcatcattatcaactttatgtactacacataattgcatgtactatacttttatatgattggtaatgcataggtttgtttacaccagcatcaccacaaacacatgagtaatgcattacgatgtgacattagatggctacaaagtcactagacaataggaatttttcagctccattgtaatatgagaccactgtcatatatgcgatccatcattgcccaaaacattcttatgtggttcatctgcagatggaaattaaacaacaccaaccattgggtcaaagaagaaactaagagggaaattagcaaatatcttgacataaaaatgaaaacacagcataccaaaacttataggatgcagcaaagcagtcctaaaagagaagtttacagagataaatactgacatttaaaaaaaaaaaagagagagagaaatctcaaataaacaacctgactttacaccttcaggaactagaaggaaagaagaaaaaactacgctgaaagtcaacagaaaaaagacataaacattggagcagtaataaacaaaatagagaatagaccatttaaaaatcaatacaaattggtatttgaaaagatcaacaaaattggcaaacctttaactagagcagctaagagaaaaacaaaacaaaaatcagaaatgaaaaaggagacattataactaatgacttagaaataaaaaggtctaaaagaaattactatgatacaaggatagtttaacattcaaaaaccaatcattgtgatatatcacattcacaggcagaaggataaaaattacatgatcatctcaatagatgcagaaaaagcatttgacaaaatccaacacacttttttgataaaaaatacttgacattctaggaatacaagaaaatggtctcaacattatacaggcatgtatggaaaagtacacagctaacattgtactcaatgatgaaaaactgaaagcttttcctctaagatctggaacaaggcaagaatatccattttatccacttctataaaacagtatgggaagtcctagccagagaaattagacaagaaaaagaaattaaaatgtccatatcagaaaggaagaagtaaaatgatctatgttcacggatgacttgatctgtagaaaactctaaagattctacaaaaacaaacctgttatagctaataaatgaattcaacaaagttgcaggatacaaaatcaactacaaaagtcacgtgcataattatatactaacaataaatcacctgaaaaataagaaaacaattctatttacaatagcatcagaaagaataaaatacttaggaataatcttaaatttaaaaaattaaagacatgtacacttgaaatcacaaaaccttgctgaaaaaaattaaagaagacataaataaatggaaagacatctcattcatagactagaagacttaatattgttaaaatgtccacactatccaaagcaatctacagattcaatagaatccctaacaaaatctcagtggcattattagcagaattagaaaaacaattcaaaatttataaagaagcacaaatggccccaaacagccaaaacaatcttgagaaagaagaataaagctggaagcctcatactatctgacttcaaaatatattataaatatacagtagtaaaaacagcatggtactggcataaaaacagacagaatacagagcccagaagtaaacccagacatgtatgaataaatgacctctgataaaggtgccaaaactacacaatgggggaaaaatagtctcttccataagcagtattggaaaaactggatatccacatgcaaaagcatgaaattgaacacttatacaacacaaaaatcgctcaaaatgaaataaaaacataaaaataagacctgagactataaaactttaaaaaaacacacacgagaaaatcttcacagcatttgtttttgcaatgatttcttgggcatgacaccaaaagcacgggcaataaaagcaaaaatgagactacctcaaactaaaaatcttcttaacagcaaaggagacaatcaacagattggaaacagatgggcatgtagtggcatcataattatttaaattaccatccaatgttaattgtgattaagttccctattgatgcaagtatgtagggtgaccaagtgactgctgtaattataagtacatcaaggatggaggagtgagatagctatacttaactatattggcattttacatgataaggcccaaggccctaaattcacagtggcctacatgacaggagaagtatttgccaaacatctatctgatacctgataagggttactatccaaaatatataagaaacccataaaactcaaaagcaataaattaagttttttcaaaatacaaagttgggcaaatgacctgaataggcatttatccaaaaatatatatatatggccaacaccatttatgaataatgttataacacatgaaaagatgctcaacatcactaatcatgagaaaatacaaatcaaaaccacaaagagatctcacctctagcttggatgttctgtacgctccaaatttcatgttaaagtgtgacttctgataccatctcatgccagttagaatggcaattattaaaaagtcaggaaataacagatgttagagaggatgtggagaaataggaatgcttttacactgttggcgagagtgtaaattagttcaaccattgtgaaagacagtgtggcaattcctcaaggatctagaaccagatataccatttaacccagcaatcccattactgagtatatactcaaaggattataaatcattctactataaagacacatgcacacgtatgtttactgcaacactattttcaatagcaaagacttggaaccaacccaaatgcccatcaacgatagactggataaagaaaatgtggcacatacataccatggaatactatgcagccataaaaaagaatgagtttatgtgctttgcagggacatggatgaagctggaagccaccattctcagcaaactaacacaggaacagaaaaccaaacactgcatgctctcactcataagtgggagttgaacaatgagaacaaatggacacagggagaagaacatcacacaccaatgcttgttgagggatggggggcaagggaagggagagcattagggcaaatacctaatgcatgtgggtcttaaaacctagatgatgggttgatgggtgcagcaaaccaccatggcacatgtatacctatgtaacaaacctgcacattctgcacatgtatcctagaacttaaaatttaaaaaaaaaaaaccctcttagaaaaaataacattcaggctgggcacggtggctcatgcctgtaatcccagcactttgggaggctaaggtgggtggatcacctgaggtcaggagttcgagaccagtctggccaaaatggtgaaacccgatctctactaaaaatacaaaaattagccaggcatggtggtgggcacctgtagtcccagcttctcaggaggctgaggaaggataatcgcttgagcctgggaggcagaggttgcagtgagccaagattgggccaccgtactctagtctgggcgagagagcaagaccctgtctcaaaaaaaaaaaaaaaaaaaaaaaaaacacacacacacacacacgcacacaaaaacacttaaatgtattaatcttatcctaaattattttatgttttattttatacttatagaagccttcccatgtatcacataaaattctcatgcttaaaaaatatgtgacttccaatgctggaggtaggaaagtaaaatggcacagctgctatggaaaacaatatacaggttcctcagaaaattaaaaatagaactaccatatgatctagtaatcccacttctaggtatttatccaaattatcaaaatcgggctcttgaagatatctttgcattcccatgttaactgcagcattatttacaataaccaaaaggtggaaaaaaaatgtaaatatttcccaacagacgcatggcccaaaaaaggaaggaaatcctgtcatatgctacaccatggatgagcattgagaattttatactaagtgaaataagccagtcacaggacaaatacagaatgattccacttacgaggtatctaaagtagtaaaattcttagaagaaaaaaaatagaatgttagttgccaggtgctgagggattagggaaatgaggagttcctgttcaatggatatataatttcagtcatacaagatgaaaaagttctagaggtatgctgtacaataatgtgcatatagttaataatactgtagctccttctagcaaatcttacctctgtgtctttcagtgttccatttttatattttcagtcctctaataactttttaaatttttcctatattaattttccttggtgtgtttttcttttttggacaggatattgacagacacaagacttggtactaggagtgataccaaaaaagaaagataaaatgggaatctgagattgatgtgggcatgaccctagtcttaaacacactgctgaactcccatccaatggagaatggcatgtaatgacatcacaattagttactactcaatgttgattgcagtgaactgccctattgacccaagtgtgtaaggggatgaagtgactgctgtgataattactatgagtacctcaaagactgagaggtgaaatagctatatttaatttaatgtaattaagctaatttaatgtaaactgggaaatttacatgatgaggccaaagtcttgaaattcacagttcaaacagggagcttataatggtggacctaaaagaatctctcctttgttttaaccatacaaccaagctcactgaaaacaaaatttaattgaaatgcttgcagagtgacaacataagttgaatacatagatacgtcaagggaaagggaagaaactgactgggaagggggaaaactttgagacttgaaatagagaattcctggtgaatttggatgattttaaacatgtaaacattccaaaatatcccctagtctcctttactagtgaaagagcccagagctctcctgtctgagaagtctatgcacctcaagcttgagaccttacaatgagctcagctggggaacttatcctgaaaacggatgcctagactcctcaagacatactcctaccaccccttattggctctagatgcaaagaagaatcagatctcaacacgctccagagcaaaaagttccaaatctgaattggaaggaaataacttctactccaaaatatttgcaacattttactaattcatattagcaaaagaaagccaaagaaaccatactaataacagaaatgatgaaacagcaacaaaaataaagtggatatactttatagaatgaaattcaacaggaatttgtatttaacaaaatagcttcaaaatatataaacgaaattgtaagagatataaaaggataaatagaaaacttcaaagtctacttgttggtataaaacgcttcattcagtaactgatagaacaatttaaaaaacaattagtaaggaaatagaaaacttaagaaatgttaatcaaattaacctaatgtacacatgtaaaaacatccaacaattgcagcacagttatgaagttcaaatgtgcatgggacatataccaaaatacataatatccatgggcataatggaagtatcagcaaatcctaaaaataagaattggggccaggcatggtggctcacacctgtaatcctagcactttgagaggttgaggcaggtggatcacctgaggtcaggagttcgagaccagcctgaccaacatggtgaaaccttgtctctattaaaaatacaaaaattagccaggcgtggtggtgggcatctgtaatcccagctactcaggaggctgaggcagaagaattgcttgaatccaggaggcagaggttgcggtgagcctagatcacaacattgcactccagcctgggcaacagagcaaaactctgtctcaaaaaaaaaaaaaaaaaaaaaaaaaaaaaaagaattgcacagtgtatgtcccttaatgactacagaatttaaaaagaaaattatataactacaaagagctatttacagagcaggagcatcgctgtcttataaaagcatcaccattttaaggttcaccttgatcaaaaactacctaaatccaaagtgcatcagcctaatggctaaggccagcatgaccataaaccacaaatgacatctccaaccagaaacattccaaccataagataaacctctccccaaccagagacatgccagccccaagataacctcccctccagctggagagatgtcagccccaagataacctcccctccagccagagacattccaaccctgccataaacttctcccccacacagaaacattccaagcctgtgataaactctctcaccctaaaaccaataaaaactcttagtccataggagcaagcactcctaaccaaaaaaaaaaaaaaaaattgtccagaagcccctctcaggtttattctccaaaataaacttgtctttgactgttgagccacttttcatgtttcttttctctttctttacttcttacatttggtgctgaaacctgggatgggtgttggggatacaggctgtcatgcaacccaggaagcagtggacagcagctgctcatcccgctggatcctgagagtctctggccacctacctcatcttgtctctcacttcactttttgagcaatttgcatgaggaggacaactaacctcaaggggactgtgagggctcaggttggggctactctccagtgagccctcaaaatcctcaggtctcaggaatccacctctgaccacccataacaggtatttcgctttctcctctcctctttcctcatacttccttcactctcttccttgtacagctccagtccaagaggccctttgctgattccaaccgcaacatccaacatcggccactaattcagccagctggtaagatctgccctcacctgctgttcttacagtacctggggaaagtgaggtctgctgtcccagtccttggaggaccagtgggactaagctggaagaaatcttgggtatgtccagtttcttctcagcttgacgtcctcttgagaaagaggattccaggtttctgtcttttgtctggggacaactggaacaaaaacagacaccctcggcttcttcttgccagtctacatgggtgccaaacaatcccacattcctcatcctctccactgggctgtctccttcacaacctcgccaaacttgacatatgcatttagttttttattgcaacatggcctggacccaatacaaattaaataatgacagctgatggcccaaaaatggcacctttaactttcaaattctcagggaccttgacaactttataaccaggaacagtaaatggcaagaggttctctatattcaggctttcttctaccttatatcccaaccctccctgtgtcaagcttgtacccctcatgaaatcctttttcttaatgaaaaccctccctgggtctctccttcctccaaaacttcttccttcaaaactccttcctccgaaatcccttttgaccctgcagatgaatcccctccgtattctcatccccctgcatcatgatgctcctcatctgtctgaactctctgccccggtgtcccgccctgcccccaagccctcagccccaaatcccactcctcctccttctccacctgctacccattcaaaaaccatctctgctattctctgtttctgagaagtggctaggtttgaaggcactgctcgcattcatatgcctttttccatgtctgatttgtcacagatcaaacagcatctgggatctttcccggaaaatccccctcattatctcagggaattcctggcacataacctaatcctttaatttaacttggcatgatatttatataattctaacttccaccctcaccccgatgaaaaagagtgctcagcttaattaaaatgaatatccaagctgagtatattcaaaaggcctttatgtttttctcttcataaatcttgttttcctggaaaaggttttttcccagttaactgaattacttttgtccactttgtcttcccattcttggtgcatgtatgaagaacactaaaatgacttctggtgtcctgggactcattgggaaaacagaaaaggcaccaaaaatcctgtttcaggaaaaatctgttttcctcacagaacccctggaattagaggtggataagtacttctcaaaatcatctttgtcttccagctatacttgtttattaggccctggaaactgttttcctagccctgttttgttttgtttttttctgagatggagtcttgctctgtcaccaggttggagtgcagtggcacgatctcagctcactgcaacctccacctcccgggttcaagtgattctcctgcctcagcctgccaagtagctgggactataggtacgtgtcaccatgcctgtagggagaccccctgaaactattgctataaaataaaagatgaaatgctcctgattattgtaaatacaaaatggcatgcaggattgtgtaaagacaatgccaggttggactgccagaacgagccaacagtgcatgatgtgcttccccccacagagagcctatgaatggacgtgcagtcagagaggtttcacatcaccaattcctgtagggagaccccctgaaactactgctatggaataaaagatgaaatgctcctgattattgtaaatacaaaattgcatgcaggattgtgtaaagacaatgccaggttggtctgccagacgagccaacaacgcgtgatgtgcttccccctgcagagagcctatgaatggacgtgcagtcagggaggtttcacatcaccaagattcctatcccagaaaagcagatgttcatagctctgggaatggaatgcgacccttgtggggagcctataaatggacgcatgaggggcgcctgtccatgtggataagatagggctataaacgccctcatcttgccacggctcttctaggcctctttagggttaaggcatactcccttctgagaatttgtggtctaactggttgtctagcttcacatcctgtttctatggattgtttgtaaccagcttttgctgcaactgttactgctgattaatatcttgctaatcataggttatggaaagactgtgtttctgttttaaggctctgttagaaattactgatgcacacactatattgtaaattcttatctctgtatactgtacttctgcatacagatgttatgttaaagaattacttcatccccatgtgaccatctcacctcataatcaaatgaccctaaatccttcactaacctacccctgccctcactaaacttaataataaatgctagtatattcagtgcattggcagcaccatgggaccagaaggcggtgacccccctggacccagctttcactatcttgtgtgtgtctattatttcacaacctgccgatccgcctgggaacaaagagagagccctgttgcattgtgggatgctggccaggtcccgcaacacacgcccaactaatttttgtatttttagtagagatggggtttcatcatgttggccaggatggtctcagtctcttgacctcgtgatccgcctgccttggcctcccaaagtgctgggattacaggcatgagccactgtgcctggcccctagccctgttcttaaagggcctcacccgaaggccaataatccaattgggtaattagccaaaaaaaaaaattataactattggatcttcttctggttgtctgtgtgtggctatatatgtgttatgtgtgcaatgtctatttttaaaaagctctaattaattggcctaagaaaaataagtgcttaaatcaaatatttttaagggaaaagtaaaagccatggaaactttcagttcacatgactttaacctttaaaacttagtggcacagtaagattagaaatgtcttaagagttgccaccatatatttttatttgcatttatcgatcaagcaattttatacttatctctgccaaatactataaggtatcaacatttgtcatagaggctacaagactataactcagcccaaacagaataatctttgcttgtgtaatttttttaacaaatgaaacattaatattggtttaataaagatagctacatcttgaactatttagtgaaatgccctaacttctaatcttgtggccttaggcagtctagtccacagacatgaaggaagtttgctttggcaaaggactatcatcatctttaatattaaagagaatttatataaaaaataatttttttttctttgagacagagtcttgctctgttgccaagctggagtgcagtggtgtgatcttggctcactgcaacctccatctcccgggttcaagagattctcttgcctcaacctcctgagtagctgggactattggcacatgccaccacgcccagctaattcttgtatttttaatagagacagggtttcaccatgttggccaggatagtctcgatctcttgacctcatgatccacccacctcagcctcccaaagtgctgggattacaggtgtgcgccaccacgcccaggcaaaaaataatcttatatggtaaattcttgtcctaaagtaaattaactggttaaggaaaggaatgtttacaacaagtcagaaattcgaggcatgtgagagattgtctgaaggtcacgaaaaattttataaaaggcaatttatgcaagaaatgtacaatttaaaagtgattaggcctcctcaatgctttataaaatgccactaataagcttagctgtacaatttgcatggtttgcagctaggtaagacctaggacacatttttacctagattaaaaggttaaagaattgttttaagttgaataaaataaaaatgaagggttaagcgagttttgaaaagttaattgtaaaggaaattctgtaaattgagcattaaaagcacaatgggtttttttaaaacactaacctgctcttttacaaaaattatacagggttaaaaaaaggtctataaaaatcttaccttacggtcaaacattaaaatgaggtacatgtgtctaaaaggttttattaaaaattgagtttaacattaatagcacactaatataaaggtaaaacttggcttatttggtataaaagcatacaggaagcactgtcagatataaaatagtgtttggttttctttggactatatttgtataaatatgttattggtatgtgttccaaagttatgggagactcttataattctgatatcttactgtacattatcagtaataattacactatacattatcagtacagtaataattataattgttatgttcaaattattgtgtgccacaaaggtaattgtgtctttaactttggctaccctaaaactttttgtcatccataaacaattcttgtctggtttatataagtggttttataactgctgtgaagctctaacaggtgcccttgaatgaaggattttgataaaaagtaggacaggaattaactgcatgaactgaactaatagggagactagagtgatctttttgatgttttgtttaaaatattgctaatcctttgttttgcttttcaaagtcaaataaactttccttttgagctactgacagcttttaaaaatttagtatactcccatgaacaaaatttggagcatacttgtttctctctacctgattttctccagaatttggaaactatctgtgagtattcttaagttatggcaatatagttacatatataagttcaatacgaatctgttttcttttacaagaggacacaattggaaaaactggttatttttaccaaggctttgaatggaatggtgtgctttcctttaaggaatcaaacttgacttatgaagctaataaacccctttggaaactggcctcatattttgtgtacacagtccctgtacagggtttctgacctgtgataagtaaagaatgtcactttctgacaggccaggaaccccaagttatcttggaacctcaagaggagatgaattcacccaactcataggtatttgatggtacaaatccatggctgggcttggctttaaaatggtcttatcagattccaactatggaacaaagttccgtcaaagccaatttaaaaggcctatgtccaggcatggtggctcacgcctgtaatcccagcactttgggaggccaaggtgggcggatcacctgaggtcaggagttcaagaccagcctggccaacatggtgaaaccctgtctctactagaaatacaaaacttagctgggcgtgatagcagatgcctgtaatcccagctacttgggagactaaggcaggagaatcgcttgaacccgggaggtggaggttgcagtgagccaagatcacaccactgcactccagcctaggggacagagcaagactccatctcaaaaaaaaaaaaagaggcctatgtaacaaataattattcttgctgtattgtatgcaaataattaaaccaagtataataaagcaaaccagtcctactgtgatttcttttaataaaaatgggaaactggagaaagaaaattatgtttcaaaaactattgcacacctgttgctaaattctagtgttgcctaatgttcttcaatttttattattttctactgtttaaattacattccaataccccctacctcaccaaatacttcttgtcattcctacctctctttttaagccaaatattaaaactttttaatggaaattatttactatgctacccttgggggaatgctttaccgactctactatttgcagtaggactatatactgtagcacccttagggtggaatagcagacagaatctcaattactgtagcattttgcttaattattatcctcatagcaggaataacaattactaatagaaaataacacatgggcctttccaaacatgcatctctgccttttattgggtgagaaatgttgtttctatctcaaccagttgggtctagtatgaaacactgctatataatttaaagaaggggctaaaaagctaaaggaataccaaaacaaccaaatagattattggtttgggaacaaaataatagcatgggtcatcccattcttgggccctttcctaataatatgcctaggactaatgttcttaccctgcctactaaacctttttcaaagatttttaactgacaggatcatggccatttcacagacaactactcaaaaacatctagagatggcattactcctacagtcactctgagaccagaaaactctccaaccccttgtccacaggaagtagccagaaagaacacgccatccctcgtcctttttataactatacggtctagattgacagagcaggagcatcaccatcttggacaagcactgccattttaaggttcatcttgatcaaaaactgcctaaatccaaagtgcatcagcctaatggctaaggtcagcatgaccataaaccacaagtgacatctccaaccagaaacattccaaccataagataaacccctctccaaccagagacacgccagccccgagataacctcccctccagctggagagatgtcagccccaagataacctcccctccgaccagagacatttcaaccccgccataaacttctcccccacacagaaacattccaagcctgtgataagctctcttatcctaaaaccaatagaaactcttagtctgtaagagagagcactcctgaccaaaataggccagaagcccctctcaggtttattctccaaaataaacctgtctttgactgttgagccgcttttcatgtttctttcctttttaactcttacaggtagaaaataattacatgcctcaaaattaaagaacatccttctaaatgaccatggtccaaatatattcaaaatgcataatagaaaatttataactagtaaggaaaatactacatattaaacttgtaggatgcagctaaagcagtgcttacatggaaatttctggctttcatggtatatatgagaaaggagaaagaccgaaaatattttatataaaaagtgatttttaaaaataacagagaaaatacctaattaaacctttaacagaataaaataaaaactaagaatgaaagtacaaaataattcattacacagtagggttaacaataatgtaaatttcaaaatagctagaaatattgaattttctcatcataaagaaatgataaatgtctaaggtaacagatatgctaattacaccagtttcattattacacattataaacatatatcaaacatcacactatatcccataaatatgtatagtcattacatgtcaattaaaaataaattttcaacattaatagatgtttaaatttttaaaaaatatttaaaaatcaaagacaaaagctggttcttgaaagtaataataaaatttatgaatatctagcaatattgatcaatattaatagggaaaacaaaaattgtaagtattagttcctatacatattttcaaaacaatgagaatgtactaaggaacaactttatggcaataaatttgaaaatttaagcaacatgagaaaacacctttaaaaatacaatgaaaagatttttgggtggagcaagatggctgaatagaaagctccactgatcatccccactgaagaaacaccaagtttgacaactatttacacaaaggcagcaccttcataggaaccaaaaatcaggtgagcattcacagtgccccgttttgacttcttattgctgaagagggtaggaaagacaatcttgaattgctgacatgacccttcccccatcccacctggcacagagaatctgcgcacttgggagagggatggtgcagagattgtgaggttttgcattgaactcagtgcttccctgtcatggcagaaagcagaactgggctgtgctcacctgacacctgcccaaagagggagcatcaacaatctgctgcctacaagaaatgtacttcacctataaagacacacagagactaaaaataaagggatgggaaaagatatgcaatgccaatggaaaccaaaaaagagcaagagtcactatacatatatcagacaaaatagatttcaagaaaaaaagaagagacaaagaaggtcattacataatgataaaggggtcaattcatcaagaggatatgacaattgtaaatatatatgcacctaacactggagcatccagatatataaagcaaatattattagagctaaagcaagagatagactccaatacagtaatagctggagacctcaacatgccactttcagcattggacagatctcccaggcagaaaataaaaaagaaatatcagacttaacctgcagtatggatcaaatggacccaaaagacatttacagaacatttcatctaatggctacagaatataccttctttgcctcagcatatggatcattttcaaggacaagaccacaaaacaagtctgaaaacattcaaaaaactgaagtaacatcaaatatctcctctgacaacaatgaaatacaactagaaatcaataataaatggaattttggaaactgtacaaacatgtggaaattcgacaataagctcctgaatggccactgtgatcaatgaagaaattaagaagaaaattgaaaaatttcttgaaacaaatggtaatggaaacacaacatacaaaaacctatgagacacagcaaaagccatactaagagagaagtttacagatataagcactgtgaacccccaaaatttgagacaggtctcagttaatttagaaagtttattttgccaagtttgaggatgtgcacccatgacacagtgtcatgaagtcctgatgacatgtgcccaaggtggtcgaggcacagcttggttttatacattttagggagacatgagacatcaatcaatgtatgtaagaagtagattgattccatccagaaaggtggggacaactcaaagcaaagaggggacttccaggtcacagataggtgagagacaaatgtttgcattcttttgagtttctgacaaccctttctaaaggagacaatcagaatatgcatctatctagtgagcagagggatgactttgaatagaatggaaggcatgtttgccctgagcagttctgggtttgaattttccctttagcttagtgattttgggggtccaagatactttcctttcacagcacctacatcaacaaaaaggaaaatcttcaaataaacaacctaacaatgcatcttaaagaactagaaaagcaacagcaaaccaaaccccaaattagtaaaagaaaaaataacaaagatcagagcaaagataaatgaaattgaaatgaagaaaatacaaaagatcaacatttaaagaaattgaaatgaagaaaatacaaaaaacaacaacaacaacaacaaaaagctggttttttgaatagttaagcaaaattgacaaaccttcagcaagactaaggaaaaaagacagaagacccaaatcaataaaaccagagatgaaaaaggagacatcacaactgatgtcacagaaattcaaaggatcattagtggctactatgagcaactatatgccaataaattggaaaatctagaagaaatgtttaaattcctagacacacacaacctacaagattgaactatgaagatatccaaagcctgaacagaccaataaaaaataacgagatttaagccataatgaaaagtctctcagcaaagaaaaatccgggatgtgatggcttcattgctgaattctactcaagctttaaagagctaataccgagtagcagaggagggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccaccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatccacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaaggaaagcccatgagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaataaccggtaccagccgctgcaaaatcatgccaaaatgtaaagaccatcgagactaggaagaaactgcatcaactaatgagcaaaatcaccagctaacatcatcatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcccaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaccaatctcactcaagccactcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagtcgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgatatcaaagccgggcagagacacaaccaaaaaagagaattttagaccaatatccttgatgaacattgatgcaaaaatcctcaataaaatactggcaaaccgaatccagcagcccatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactacgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatacacaccatggaatactatgcagccataaaaaatgatgagttcatatcctttgtagggacatggatgaaattggaaaccatcattctcagtaaactatcgcaagaacaaaaaaccaaaccccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaactagtagcagaattgaaaaaaaaaaaaaagagctaataccaatcctgctcaaatagttccaaaaagtagagaaagggatacttctaaactcattctacaaggccagtattacccagataccaaaaccaaagacacatcaagaaaaagagaaccacaggccaataacgctaatcaatattaatgcaaaaatcctaaaaaaaaaaaaaacaaaaaaaactagcaaaccaaattcaaaagcatattaaaaagatcattcatcatgaccaagcaggatttatcactgggatgtaaggatggttcaacatatgcaaatcaatcagcgtggtacatcatatcaacagaatgaagggcaaaaaccatgtgatcatttcaactgatgctgaaaaggcatttcatgaaattcaacatcccttcatgataaaaaaaaaaaactggtataaaaggaacatacctcaacataaaaaaagccaccatatatgacagacccacagctagcatcatgaatggggaaaaactgaaagcctttccttgaaggtctggaacacgacaaggatgcccactgtcaccactgttattcaacattgtattggaagtcctagctagagcaatcagacaagagaaagaagtaaagggcatccaaactggaaaggaagaagtcaaatgattattgttgactgatgatattaccttatattcggaaaacctaaagactccaccaaaaaactattagaactgataaatttagtaaaattgcagggtacaaaaattggtagcatttctatatgataacagtgaacaatctgaaaatgaaataaaaaagtaatcccatttacaatagccacaaataaaataaaataccttatagaatggctgctatcaggaaaatataagataacaaatgttggtgtggatgtggagaaatggagcccttgtacgctgttggtgggaatgtaaattggcatggccattatggaaaaaagtatggagattccttaaaaaattaaaaatagaactacctactaactagaacaattaacaactccacttataaatatatatccaaaggaactgaaatcaggatctcaaagagataactgcactctcatgttcactgcagcattattcacatagctaagatatggaaacaatctaaatgtctgtcgacagatgaatggataaagaaattgtgatagacacacacacacacagacacacacacacacgggaatattattcagccttaacaaagaagaatatcctgccatttacaacaacacagataaacctggaggacatcatgctaaatgaaataagccagatgcagaaaaacaaatactgcttgatctcttataagtggaatctaaaatagactcacagaagcagagaatagaatagtggttgctaggagctaggggtaggaggaaatgggaagacattggtcaaggagtacaaagttttgttaagagttgagggtgtccaggttcttggcatcttgaaaaaattggacaaaacgtacaaacagagcaaggaaggaacgaagggatttattgaaaatgaaagtacacttcacagtgtgggagagggcccgagcatgggggctcaaaggcgtcgtgacagaatttttaggagtttaaatacccgctagaatattccattggttgcttcgggtatgccctatgtaaatggagaggatgaagtgaagttacgaagtcatttacggtgtacgcccgatggagagaatatttccagttatagctgaagtgtgaatcgcccttatgttcctggccttcggaccctatttacctgcctcagtttcagtaacgaaagtgaataagttctggaaatgcaatgtacaacaaacaatatgactatcgttaacagtattgtattttatacttgaaatttactaagcaggtagatctgatgtgttcgcaccacaaaaaaaagaaaagaaatgaaatgataactgtgtgagatgtagatatattaattagcttgactgtggtgattacttcataaggcaagtgtatatcaaatcatcaagttgtataccttaaatatatacaattttaactgtcaattttttaaaaaaaggtgaaaaatcacactgtttagagaattttctataacatgcacactatttactgcaggaatttggtgaaaatatacgaacaccctcttagtctttcttgggaaactcttgcattaaatcccttttacggacagccagcagctagatttagcaaacctttatcagttctctgtggaaacaacttattgaaaatttagttttaccttctttttttcacgacagacattaaggcgtgaaccagccttggctataattttccatagcctcttacagtgtggccaagattccctacgtttctctcttctgaatttactttaatttccatcacctcagtgcaactttttctgctgtctctactcgtccctctgcaccctcttacttctccctttcaaaccacttagtttctggttcaattccctcttgttttcaccatctactttctccgttaaacctctctcctgccagcttcctctccctagaatcccagccttacctgcaacagttccttttaacggaccaaggacgagaaaccactccccggatgcggtggcggccaacaaacccacgaggcagggctccctcctccgaagagcattttccgactctagtctccaacgcccactttcctagcagtcaccaaccaagtctttccagaaggcagctgcctgaaacatgtgcagccggaaggctgcagcaggacgctctcctgctgttcgggagacgctcctggtccctgccagcggcgcacaaaccaggccctactggcgctctgccccgcccaagtggtgattccccagaattttcccaggcgaagtggggccttcaacaagtctgagggctgtcttaatggcctgcacctgccggcgccatacccacatcattggtttaaggcctaaaaggctcttcctttccaggcacctcctagtgttcacctgcacggagcagtacgctccccacgaggaaaagccctttgtccaagatgactgctactatcacggttatatggagcccccagccccgagtctctgggagttctcagcacccctttggaaaactatggagggatgcacagatacagataaccaagcaaacttatgaaatcgagcccataaggcattttaccacatatgttcgaacaccagataagataggattcaattgtcgccatgaaattggcttaacaaaagaggaaatacagttgacgcttgaataacgtggatttgaactgtacaggcccactcatgtgcgattttttcaataaatacagtcggccctctgcaaacgcagatgcagaaaatacagtattcacagaatgtgaaacccacatatatggaaaaccaacttttcgtatacacaggttctgcagggccaactacaggacttaagtatgcatggatttaggtatacatgggagtatacctcaaaaaacaaaaagaaagtgcgaggtggtgccctgaggatccctgtgtatcagataggacactttgtggtctacagtgtctactcctatcataaaatatgcaacagtcacaataaacgatgttgatatatttttggccagacagcaaggaatgcctctctgagctgccataaaaattaatatacaaggagatcatttcagtccctgtggcatggaaggtttaatatacaaaagatgcccttcgtcaaataatttgtgtgagagtgcactgtgaaaacatataaacaatttccaaggtaaaacaacataatgctataattaaaaaatcagttaatggtcccaggtgttggggaactattactttggaagggatacagttgatattgggcaagtaaaagacggcactttgtgtggtctagaaaagatatatatgagaaggagctatgtcaattattctatatatgactgcaaattggagaaatgtcataagattgccacggtttatatgggtggaccctacctactgtgagtttaccggctatggaagaagctcaaacagtggttcagctctatggggtagtctccttccccaactattaacaattctttgcaccgtaattctactcacactcttttgccttgcctcattatcttacacttttatcagagtactgctttcaacaaagtttttactcaagaaaatgtcattaggatttaaataggaaatagaagtattacaaagtattcacttattcaaagaaaacatttttggaaagagaagatagtgcatgatcactgtccagtgacttccaggtcattaattaagacaagcttgtccatgggctgcatgtgggccagaatggctttgaatgcagcccaacacaaattcataaactttcttaaaacatttttttttttttgcaatttttttagctcatcagctattgttagtgtattttatgtgtggcccaagataatttttcttctagtgtgacccagggaagccaaaagattggacacccttgattaagaagatatgatcaaaggcagattttcttggttccttgtatttaattgaaagacaaacaggcactgaattttttaaattaaacatctgatccttaaaaaggactcatttctctccatttaaggtaggattgcactcagtaggaaatcctggaatgtgttccactatttttatcatattagctctgtggatataccctttaaccagatataaggtaacaagtgtgtggcacaatcacagagacagaatattgacaggtacagcttccctttgtaaaatctgaaggagaaatggtagaagcaatcaaagcaaagaataaggataacaaaatagccataaagggacaaaaattataaagagatataaaaagtcttgtagtcaaatacaa

SEQ ID NO: 15233 - DNA, 51822 bp, Human
  misc_feature (1)...(51822): n = A,T,C or G
gggtgtggtatgtgcacctgtagtcccagctatacgggaggctgaggcaggaggattgcttgagcccaggctgctatgatcgtgccactacactccagcctgggcgaccaagcaagactcatctctaataaaacattttttaaaaagaaacaaatgatcatgtaggaaggtggcttggatggttgtatgatggtggtgttagagagtgtccctgtttggaggaaatacacactagaataattagggctgatggagtagcatgtcagcaacttgttctcagatcgttcagaaaaagactatgtattaattatttatctatgtataatatatataaataaacgatatatatggagagagacagggcaagagagacagcctgcaaatacaaaatattaacaatttgggaatctgggtgaaagggagataaggtttttctcatttctacaagtttaaaattatttttaaataaatttttttttaaatttgggatttacacaggacttgagatgatcaagagaggaattggaatggggttgaaaagctaaggagacgagagataaagaaaagaaagtgataaagcaatttatgacctaccttcttcctcttgttcctttttaaaataaataaattgatgttgggcacagtggttcatgcctgtaatctctgcactttgggaggccaaggcaggaggaacacttgagcccaggagtttgagatcagcccaggcaacattgtggagaccccatctccacagaaaaaataaaaataaaaaatagccaggcgtggtggtgcacaacagtagtcccagctactggggaggctgagatcggaggatcgcttaaacctgggaggtcgaggctgcagggagccacgatcgcaccactgcaatccagcctgggtgggcaagggagactctgtctcaaacaagaaataataataataaaataaaataagtaaatagaaaaatatctgccatagaatcttagctggttctctcacatgccaaatcctactccatgtgttcattattgtgtagtggaaagagcacgagctttgctgtcgaagggacctggatgcagacactgccgcagcctttgcagcttcatgctcttggcacatcgtctaccctctgagcctccgttctcttacatgtaaaatggagataaatacacatatctcacagatcattagaaagattgggagagatccttacagacaacacgtgggtcatctgggagcagaccaggtcgggtaagttattgaaatggagttctcattgagaactcactactgtttggggcttacattgtgcatgagtgagtttttggatactgaaagcttaactttcactcctgagtctgtcacttgacagtttgggtttaaagcaatccaaaaaaatgttgcagttagggatcaggattgttatatccagagaatggtataaaagggacctcagatacatttacgattctgacacccagtgagacacccactgtttaaacaaattcgtaacttgctgagtgttatttatttaccctgtgcttggcggaatgtgcacagcaaaattacctccatctacttctgaaaaaaagtagtcatcagtcacagcctctctatttattacactctgaaatttattacatttcaaataaaatgtctgtctctgacattggctggccttgtggtagggtttcagtattgaccaatattgacctggtcagtttccttgatggtgagcccctcagctcccatctttgcaacccacagagatgtagccactggtggaatcagaatttccatatgggagaggataaggttaaaaggggagagctggggaacttgtcttaaaggagcgtctttatagcaagcatacttttgagttaagtttaataaaaataatgttcctttcagacttcacgttgaattgaaaaatagcaattgtccagattaaaagatgttattaagatcatcatttttcctgggtagctttgcaggggccgatggagactacagaggatgatgactccaccggtgggctcagccactgtcctcagcccagcactgggcatggagtgactctcatgccagcccatccctttcttgtcagctgaaattcagggacttctagactcaaatctcaatcaatgacaaggcaaagtcagacactgtgctttcactgtgctattaggtgtgattccgtctgtcctgagactcttaaaattctaaacttctgccatctacaatcaagagcaggagacaaggcaaacacatgcgagaaataaaggcaagtagaatccaaatgagctatataactaatcacagccatgcagttatgggtggagagggcactctggagtgagggcagggatgggggccgctaggatccatgggggctcatctggccaagggggcggtcagcaggccaagctctcactctgctgctaattgaaaacaaagggaaaggtagatgttatttcagatcctcttgccaagacagatgatagaagtagtcatgaggagccatcttaatatttttttcattgatggccccaccccaaggagcctaaatggccgagccacccccagattcccaggttcggcccttcattctttccagggactgctcatggcctctacttgcctatccctaggaagatctttctgccaagcttggaagcaggaagagcaggcttttggaggttttggcaaatggatttgatagctactctgcatccacttttctagtttgtggttgcaggaccaggtgcctggtgggagtcacgatccctggggagacacctcccaggagccaccctcagtcctcagagggcctttgagtccagggacagacttcctgacagaacaaacatatctgaagctcagaatcttctctcttgtccacagaagccatcctgtagacctgaaacacttaactaactgatcattaatcatgaggaacaggttttgtgggcagcactcccatgcaaacacccaactgccattaacttgcgtggcagatgtcgagaggtgagaacgctgggttctgaatacaaggaatgtgtgtctcccaggttgggggccgatgaggtgaaaagagatttgtgcgatgcaagctatctctccctttcctttcttcctcggatttttctctatcttgagtaaagttcagttttcagagatcaaacctggttgtaaacacagcctttaaaacctttgcactgctttactgcagaatttatggtctgtttacctttgaggtgaggagcaggcaggagaggtaatcctgagcctttggtggacgcctcaaaagaaaaaagggatacggggcacatgaataaaaatacttccttgttccatccgtgatttgtgggtgcagaattcttccccagagaggtcatgccctaaggaaattggcccaaccagccttttgtaaccattaaaacaagtaagtccttgagatcttccccattccagaaacttctggaaacgcacagatttggggatttggaaaatgcacatgagaacaacagaggcaggtgcctcagtggtgatgtgaggtgtcgctagcactaatgccctctgggaattaaaggccaggccccagcacggcataggagcttccttaaggggaaccaagcgcagccaccaagggccggggtgctgtttccagccacactgcatacaccttcagcgacaaccttccaaacaggaacccagtcacaaactgtcctttgggtgaggacttttgaaggtcagaggccaaagagagtgcctggcaggaataaatcatccaagatttttttcaacataaattacaggagatttcaattccccactcacagttgcagaactagctgtcatctcagtcacagaagctgtcacataaatgaatgggtcaaggagaggaattaaaagacctgtgttcctgagagctcatccctcctgcttattcgtacctgctggttatgttaccattagcaaacaccacactgggcttcaaatttcttcccagtagtatgggaacaccaatacttgtcactcaaaggcacagctaggacacaatagtgcacttgaaagggccatgacaagttaatcctataaaatgtaaaatatatgtactactaataatgattttgatgactgcaatagatattttagaaataaactatcagtccctactccgataatgaatgactcttacattatggggaggaaagggaaatgctctccttttcttaactaagttaaggaaaccacctcagacaagcacccaggaggagcgctgtggcttctttctggcctggtcctcacaaacggtgtggcctgaggcttctctcttcaggggaagtgtcacagtcatgactgggagcggatgttgccatgttagtgaaggagaatcctcaggttggggtcaggaaagtcggggtccattccaggctctgtcgcttaaggatctctacaattatggacaaaatattgatccctttggggctccaatatttagacctgagataaaccacagtgttcctaagcctttgctagttctaagttcccatggttccctatcaggtaataggtaaataaattcaaaaacaataaatagttgacttcagaatagttttgtattgtaagccatgtgttaagtaatgaaagagatgaaattgatagatctattgtgaatcaacctcagataagaattaactcagtttttttctttttttaggccgagtgcagaggctcatgcctgtaatcccagcactttggaaggctgaggtaggtggatcacctgaggtcaggagttggagaccagcttggccaacatggtgagacccctgtatcactaaaaaaaaaatggctgggtgtggtggtgcaggcttgtaatcccagctacttgggaggctgaggcaggagaattgtttgaacctgggaggcgaagtttgcagtgaaccaagattgtgccacggcactccagcctggacaagagagtgagactccatctcaaaaaaaaaaaaaaaaaagaattaactcagttttgctgaaaagacttttctttttgttaccccacaattcatgtctacatgaggcttggctgccattcttacaggctacactttcagtgtgccattccaaaagacaagattaaaaatctttaatcattgatttagggaacttgagtaatactgtttggctttctgccaggcatcttcaatatttaagagagaatcagccaagcgcagtggctcacacctgtaatcccagcactttgggaagccaaggagggtggatcacttgaggtcaggagttcaagaccagcctggccaacatggtaaaatcccgtctttacaaaaaacaaaaattagctgggcgtggtggcacactcccgtgatcccagctactcgggaggctgagacaggaaaatcgcttgaaactgggaggggaaggttgcagtgagccgagattgcaccactgcactccagtctgggcgacagagtaagactccatctcaaaaaaaaataaagagagagagagagagtcactatttggatcacacaaaagaaagatgcaaggacatatgtgccctgttggttactgagacagctctcatttcagaaaagacagagattttgtttccagaataaagctgcccaggtgccaagcaggagaaaatagagtaggaaacaatttgaattcatgtatgttctatccgccttaaggcttctttgaatctgctaatataaggtaaaggaaattgaatcaagttatgtaaagtgtggagggaatgatcccttacagtttaggttacatcatataattctaaaacacaacggatgtaatgtgagttaaaatctgtaaacaataaagtcatataataagagattgttcattttgttatttgatctacagcacaccaaacttctggatggttgaaatttctgagcaaatctcagaagagataaatgacttctgaaacattttaagtctatcaagttcaggatgtgtttcaccattgcctgcttcctggtaaggcacatccttcattcatgagtgcattcattcattcatgatctcacgaatgtgcccagtggtgcaatgtgcctgcagtgaggggctactatccctcctgccacctttctctcaataccctggttcagaatttgttgtcatgaactttctccaaggcaagcagcacagcaggtgaattctgcttccagctcacgttctctgatgtgaggtggggggataagtaaaatgagggcaaacaaggtgttgactttgctcaagaacaagagaaatcagtctgttaaggtagtccaagaaagaatgctaactatggaaaactctctcacttccttgccccgaaagacattcctgcatatttcttttggtaaaataagctactcaggatgaattgaggggttttgtctgccttgggcacgtctgtggtctcagcacctagaacagtgcacggcacgacggtgtgcagatgttcattgatgttgacagtggacttaaagcacaaaaatggctctttaataagtaaaatttcaccttggtgttggaacttgatttattaacacaaggccccaagctcacccctattattaattcatcacatatttcagctgccaggaaacctctctagaaatacaacacgtgatgtggtgcctggttaagaccatgggctcagagtgaatttgggattcacccaactagttatgtggcctgaatttctcccagcctcagtttctcactgtaaaatggaagtaatcctagtacccaccacacagaactgttgtaaggaggaaatgagggaaggcgtgtaatcccactgtccctgtgaagccaagatgagaacagtgatttttgcatacggatatgttgtgtacgcacagccctggccagaccaggaaactctgtcacccctgatacactgtgatgaaaccacaaccctcatcgaaaaccatcagcgtgtctgagaggcatcagagccaagctctactgatggaagatgcccctctgctggtcattccccctgggccactgtctgtccctctggaggagagagaccaagaggttttaggtttaggtctggggaggatcgacaatatctctgtctcttaaggcctccctggaaaaagagcttatttggaagggaaaataatagcaacaaaaaaggcaaactacagaggaagagcataactgcagaatattcctaaactccaccacttgggtgtgtgcagagatgagactgtttaaatttttttgttttacctgccccatttccaaaacggggtattgtcctctctgatgtgtgttgacccacatgtaacactaaagagctgttcagatttcccaagaacccactctcacaaaaggaatattgaacaatgtagactttgcatagcatttcaagaggtcccacagggttccacaggaggatgagtttccatggcacttgcccacagcaactttcttttatttatttatttgagatggagtttcgctcttgtcacccaggctggagtgtaatggtgcgatctcggctcaccgcaacctccacctcccaggttcaagtgattcttctgcctcagcctcctgaatagctgggattacaggcatgtgccaccacgcccagctaagtttgtatttttagtagagacggggtttctccatgttggtcagctggtctcaaactcccaacctcaaatgatccatctgcctcagcctcccaaagtgttgggattgcaggcatgagccactgcgcccagccctagcaactttcaaactctttattagacatttctctgaaaccttctcatcaaccacaccacctccacttcaccaggcatttctgtctcagctcctgccccatgaaattcccagctctgctggctcctctctttctcattgggtttttcctcttccaacccccactcttcaaattcttctgtagggctgttcagctcctattacctcatattccaaaactggcatgtttcccaagatggcaccagcaagatgttgtccatataaccatgcccaccattgttagaaggcagttgtggttacagatggcaaaatttccccaatgacatcttaatattttgcttggatcccatagtgagcatagttgtttgtcaatcagcatccattcaccccttttcaattgtacccatgttccccttctagtatctaccctcctcccttatcctacccttatcccagctccagtggtgagacccgatcaatccgaaccaatcagagtactcctatttcctttgccaaaatgcttcggtcagggatggataggtaactaattagggccaatggaaggtaacagatagtttgagaatttctggaaaagggatttccttgcttttctgtatgcactatagaatgcccactctcggccgggcagggtggctgatgcctgtaatcccagcactttgggaggctgagatgggcggatcacttgaggccaggagttcaagaccagcctggccaacatggtgaaaccctgtctctacaaaaaatataaaaattagctaggcatggtggcagacacctgtgatcccagctactcaggaggctgaggcatgagaattgcttgaacccaggaggcggaggttgcagtgagccgagatcacgccactgcattccagcccgggtaacagagcaaaactccatctcaaaaaaaaaaaaaaaaaaatacatgcccactctctcccgctggacctgaagaaggagtcttagtcctgatgtctatagctgctgtcttacgatctaagatgaagcagccttgggattgacagaaggaaatgaataaaggaacctgggtcttcaataatgtttttgaacttctggacccactagattaaaatcagttctacctctgatgtttaattacaatatttgaccagctacttgtttaagtgagtttcagttgagatttttgtttcttgcattcaaaggcattccaactgatattggccccattgtttcctgtgtactgatcttaatatccaactagaccacaaattcttggaaaacaaagacttagatttcttttgtatttcccacagcaacactgcaaatatggcagacgttcaatgagtattcaacattgggctggtttgttattataagatccttgaagtaaggagctaggtcttccttggtttttgtgcattcactctgaagtattggcttgaacccaggcatctatcaataaataattataagttaatgaaaataatagctttggatattctgaaattttaaccacttgggaatcatgattataaattacagctctgagcctcagaatttaaacatacttttccatctccatcctccaaaatcctaagaatcaacttcctagaccaagcgcggtggcttatgcctgtaatcccagcactttgggagactgaggcaggtggatcgcttgagctcatgaattcaagaccagcctgggcaacatggcaaaatcccatctctacaaaacatacaaaactagccaggcatggtggtgcatgcctgtagtcccagctactcagaaggctgagataggaggatcactggagcccaggagatggaggatgcagtcagccaagatggcaccactgcacttcagcccgggtgatagagccagaacttgtctcaaaataagtaaacaaataaataaacaaacaaacttcctcaaaggcagaatctggtcaaacccccaaatctgtagaatcttgatggtttttaatgtcttattgaatttggaaattgtttttaatgaacatattcatgaattttaaagaaatgaccccctcaaggttaattcagctaaaaattattcaaagttcaagagaaataaaaactatcttactcaagcaaccagccggtgagtggcagctcctctcccacggggtgtaaactgcatgggttcaggaactatcctgcaaacaagatattcagaaggatccagagcctttgccaaaatcacagcacacagcagcactgtgtcaactcataccagacttgatggctcagatctttagcaactacactttcacttgcatggaaagcctgctcagaaggcacatgcttcctcctgaggccttcagtgagattccaagtgcactaaaggacctgtcatttgtgctgattttagggaaagtagaatatatttgctaggctttcttacaacacattactatcctcccgtgttaacacagaacagcgtcttggtgatgtatgcaagatttccctatagatcagtgatcaacctacagatttctcttccaccctccaagccctctctttagcctccccctatgcctggaatcccctgcccctcatctagacacttttgactgcaaaagagtcttctgtgctgtcattctgagggctcctggagtctactgcgtccaggtaacaattcctgatttcccaggaaataggaaagttttcaggaaccctatccaaatatgaacttcacagagttccccatcactcagcaccccacagactgcatttaccaatatggaaatacttaaacataggtatttgttaatgtcttcaatatgtttaccgatacctttattgtatcattggtcatatgcttctaaaaggcaatgatctggtcagattcactcaaactgaacaacagagaaaattcatagagcaagtgagggcttcattcttccttctcctttattttgtgtgctgcgtttctggcatccagtgttgtggaataccactggcctgtgtcatctgcttctcttccccactcccctatttcaaaacacacctgtcctgtgccccagtgcctcaaagctctgctctctgctaaattttcaaataagagacatgatgattaacatcttaatagttatcccatcccagttgacattaaagtaggacagatgatgggaatttaggtaacatgacagagagattttggctttgagggcctgcagagttccatcatctgggcatctatttacatttaattgtgaaagccagccttagaaaggaatctgccacgatgcctcacaaaaagcagagctttaagagatgtttttagtaacagggcaaaaacaacaataatctcatatacctacttcttctgctgtttacaaagcactttcacatatattatctaattttgataatgatgatgatacacacacacatacatgaaaataaaatggtggaatccaagtggctctttaagcgtgccactcagcaagttactaaacaggaccgctaagccatttgtattttttaaggcaatttttacaagtatagggaaggttggtaggttcacacttctacttcctctaaatagaaaggggctggaagccattctcttcttattttttgttgcatagctgtatgctaagagcatctccacaccttggaatgtttgtgggagggcaggagaagctatttcttcctgctatgaaacctgatagcaaagccagcaaggtgtcaggaagcagtgccccctcagcagaggagacctttaagacttgtgaccctccaggaacacacaaagggacatatccttcctcctcccctcccctaccaccccatcactccatttaggatgcgataagaaaagtgacttcatggagaggatgaaagctggggacccagaaaaaaggagcttgatttcgccaggcattgccagcacgctaaacctaacccaggagaggcgcttccggccaggaccttgacacaggcacacgaacacaaacaccacaggggtgtgcctgcccagcctccaggtggtagtgcaactcctgccttctccccaaacatgtgtgttcacaaatccccggatcccagttgggagtaggaggcagagagtggaaaggcaggtcaatcagatactcagacattgcctgagatgaaacagcccaggtgtgaggccagaggctaggtggctccgcatgaaagaaaggtagcagcttttgtttgtctagaaaacgcagaaggggagggctgacatactcaggatacctgtttctctagtcttttcatcgaaactaaaagttcaactcctcaaatcattggagaaatgtgagctttcagacatctcatggctataacaaattctagccatggtttaccaaaatctcactctttccagaataccctaggagatataaagcctagtgaggtgaggttttatgagaggggtcctaaaaagaaggtaagagtattgcacccccacattttagtgtttctcaaactttgttcccatggaatacgtggggttccatagttagactagactgggaaatgttacatatgagtctcccctcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaggctaggtggctccgcatgaaagaaaggtagcagcttttgtttgtctagaaaacgcagaaggggagggctgacatactcaggatacctgtttctctagtcttttcatcgaaactaaaagttcaactcctcaaatcattggagaaatgtgagctttcagacatctcatggctataacaaattctagccatggtttaccaaaatctcactctttccagaatacctaggagatataaagcctagtgaggtgtaggttttatgagaggggtcctaaaaagaaggtaagagtattgcacccccacattttagtgtttctcaaactttgttccatggaatacgtggggttccatagttagactagactgggaaatgttacatatgagtctcccctcataaacattcccagtgcctgcaaacgtagtcaatgcctgttggatggatggatggatggatggatggatagatgtatgtatgtaggtatgtatggatagatgtatgtatgtatgtatgtatggatggatgagtggatggatggatggatgggtggatggatggatggatggatgagtagatggatgaatggatggatggatgagtggacggatggatggatggatggatggatggatggatggacgaatggacagatggatggatgggtgggtggatgggtggaagggtggatggatggatggatggatggatggatggatggatggatggatggatggacagatggctaaattaaatctctggcccctaagtggttgcatctagttgtgcccaccagaaaacctccaggttgccaatagtttactttatgagctataacttagaggtcagccagcctaggatctttcagatttttatttattattattattattattattattattattattattattattattttgagacagagtctccctctgtcgcccaggctggagtgcggtgacatgatcttagctcactgcaacctacacctcccagcttcaagtgattctcgtgcctcagcctcctaaatagctaagattacaggtgcctcccaagaagctaggattataggcatgcaccaccatgcctggctaatgtttgtatttttagtagtgacgaagtttcaccatgttggccaggctagtctgaaactcctgacctcaagcgatccatttgcctcggccttccaaagtgttggggttataggtgtgagccactgtgcctggccagagctttcagatattttaaaaacttgtgcctgtttgatgcctgcaagctgaataggttcagaggaattaaataataaaattcagaattagggataagagtcatttgcctgagaagttgtatattagaaacctcttataataaaccttctctgggagaagatgacatcctccagggaccactacaactccagtgaccaccacaatttctggcacacactcagtgcatgtttgttgaaggaacaaatgaatgaatacatgaatttcaaaccatctctctgcaactgaatttgccaacacaggcaccaggcttcaggccggtcacttttccagcaattctcctgcttaccagcttcatggtgatggcaccataaatgacaagagccaccagcagtttgaagaagcaatctcagagagctggggatacagacctcccatttctattaaagtctgtttgtcctccctacttacgactttcagaggctaaccttcgaaacttctgaccttactcatttgaaggaatgcattaaaatcactgacttcaggtttacacttaatccacacgtgccagaagacctgagtcatgaacctccgatcatggtacgaaggacgtctgaatggttctctcggccactgatgcgctcacagctcaaaagaatgacatcaacaaaatgaataagaaccccagcctttgcttcccagggaaaatgaactgatggggctaagagccagtgaaataaaaacagaggagagagatgacacaaataaatgtctgagtcagttgctcacagaacagccaggcaacaattgtgtgactgcgctctcacccctcctcactcattccttgctccctgcactgtgcagagtgcagggggcatccagacctggagccgacccaagccttggggagactcacacagccccacaccagccctgccgccctgcccgggtccactccctgcctaaacacgcattcagcgagactgtctgaatgtaatgccactaaattgtacacctaaaaatggttaaaatggtaaattttatataggtatatattaccacaatttaaaaagtagaaaaaaagttttattaccaattaaagagtaaacccagcatctgtaatacattagaggacaagttagtctttacaataataataatagttaatatttattgagctatcactagggctcctttaaatacattcagttcgtgcaatattgtgtcatttaatagaatgacattaatacataatattaattatatattaatatgtcattaatatattaatatccatgacattaatattaaatgtcatttaaatatttcagtttgtgccataacactgaggaaactgaggcacagagagaggataccactttcccaaagacacaccgtggtaatagggtaatagttagagacatttatgtagagtttttagtttgttttattgttgttgttgttttgggtttctttttaaagacagggtcccactctgtcacgcaggtggaatgcagtggtgcaatcacatttcactgcagccttgaactcctgggctcaagcgatcctcctacctcagcctccacagtagctgggattacaggcactcaccaccacgcctggctaatttttttactttttattgttgtagagacagggtcttgctttgttgcccaagctggtctcaaattatcctcaagtgatcctcctgcctagcccttgatacatagtttaataaaacacttgtgtttacctactggcaatctacaaaaatgatgagtgtctgtctgtcgctctctctctctctctctctctctttctctctctctgcctctctctcctgctagggcaccaaaatgtaccaagaagagcctaaatctactggagactcaaatcggcattaccactgcagtttttgagcatttctggagcagatacagcattccaaaacaacccagaagtgtcacctctcctcagcccacacgccagaacttccatgtaaatgcctcatgtgggcttcccatggtgtctaacggatactttcaactaactgggtctttcttccctaccctcttccagatctatgaaaatacctgaggtttccatttctgtgcctcatttattgactatttcaaagtccagttgtttctctggaattttaacaacacaagaacgatatccacaagacagaaagacaataagggaccaacaggagacaattacagaatactcatgaagactaaaaaaggctgaaatcatcatcatttcccatatcagggagatagttacgacactggacaaatatctaatgctgcctttcaatcctgactcaacaacttactgaatcacttaaactctttggcctcagtgtcttcctgtgtgaaacagaagcagatctttgtctgcttcacaagttgtgagaataaagagaaaatgtttgtttatttgcttgcttgctttttgagacaggatctagctctgttgcccagactgaagtatagtggcttgatgttggctcattgcagcctccacctcctgggctcaagtcaacctcccacctcagcctcctgagtagctgggactacaggtatgtgccaccatgcctggctaacttttgcattttttgtagagatagggtttcaccatattgtccaggctggtcttgaactcctggagctcaagtgatccacccacccctgcctcccaaagtgctaagattacaggcataagcctccatgcccagtgagaaaatgtatgttaaagcacttgtcagctcatgattataggctcatgcctgtaattccagcactttgggaggccaaggcaagaggatcacatgagcccaggagtttgagaccagcctggacaacatagcgagacctcgtctcttaaaaaatttaaaaattagctggacatgatggtgcatatgcctatagtcccagctacttgggaggcttaggtaaggtaggagaatcacttgagcctgggaagtccaggctacagtgagctgtgattgcaccactgcactccagcctgggcaagagagtgagaccctgcctcaaaaaaaaaaaaaaaaaacccacttgttaaactgtagaacaatatgtaaatagttacaggtatacctcataagcaaatctgtataaaaatagtagtaaattaataagcatcaccacatttcaaatgtaaaaacagattctgcattagaaataacccatttatagaaacatcctactcacctaaattgttttaacatttgatgtgaaaggcccttaccagacaggattttggtttctaatctacttaatgtgatttctatttactaatgaagaccttagctaaagttattaagggaggttatcactaatatcttatgataaagtcaaaaaggacaaaatatttaccctttgttgaagccatggagaatgaatggatggtccagcccactggcttgacccaatgttatgttttatacttgaaaaaccggctgggcgcggtggctcacgcctgtaatcccagcactttggaggccgaggctagtggatcacctgaggtccggaattcaagaccagcctgaccaacattgtgaaaccccatctctactaaatacaaaaaattagccgggcatggtggtgcatgcctgtaatcccagctacttgggaggcggaggcaggagaatcacttgaacccaggcggcggaggttgtagtgagctgagatcgtgccattgtactccagcctgggcaacaagagcgaaactctgtctcaaaaaaaaaaaaaagaaaagaaagaaagaaagaaaagaaaaatcctggaccaggtgcagtggctcatgcctgtaatctcagcactttgggagatcaaggtagaggactgcttgagcccagggatttaagaccagcctgggcaacagagtgagaccctgtctctaagaaaatataaaaattaaaaattaaaaaagaaaaatcctctctaacatttaacctcaattcccaaactacaaattataaaacgtaggaattgatgagagttccagttccattacccaaagtcactaaaggcttatcccagaggtatttgcctgtcactgtcttttctatggccctgaacttaacttggcagggttcaaaatgccccacgaagttttgttcaagtggacagccctccgttcaagcacccatccaaatgccaatatctcccaggagcaaaagccctgggcacttttccaaaaacatgggtgaaagttcagaatcaccccctttttgtgaagactttccgtaatgatcttcccagaaagtccccccttgtttctagctctgattttacctccccagaacatctactcacatcttccaattattaacaacttacaacaacaacacacgtttgccaagagtcaactgcattctctgttctctatgacacatgtaaaggcatggcctatgccttatgggcttgtgatgtaagtaggacaagaaataatatttagataagacaccagatcaagaggctgataggattcaaatatgtgttgttcccctccccgcttcctgcatttcaggacagatcttcagaaaggagccaggagtgaaaagctggatcattcagacgagagcctttgggggagacagatgttcaggaggagtccaagggacagctttgggctgaggaaaggcactgagaaggagagtgggaggaaatgaaggcagaagcagaaggagcagaggagaggtatttaaagggcctgagaaatcacaaccagtcgccctctgtgagatggcttgaaagtgctgtgtgtctccctccagagaggacagaggtagaagagtggcccctcttcctgaagtcctgtcttcatttgctactgctgagattttcctaagaaaacaatttcaaagtatctacatgcaaaaatgttcctggtcccatcaataacagaaaatccagaaacaatcaaaatgtccaccaaagggattggttagacttaagtattcccatttcctgcctcctccttcccatatttaatttcttttcagactccacacataagtggcagcatgcagtattcttccttctgtgcctgccttatgttacttaacatattgtcctgtaagttcatccatttcgtctcaaatgacagaatttccatcttctttgtaaaggctgaataatattccattatatgtgtatagagacagatagctatactgcaatttctttatccactcatctgtctatgtacactttggttggttcccgatcttggctattgtgaataatgctgcaatgaatgagggaatgcagatacctttataaggtggtgatttcatttcctttggtcaaaaggtacaaagttgcaattatgtaggataaataagttaaagagatctgatgtacaacatgaggattataattaataatattgtattatatactggtaatttgccaagagagtagattttagctgggcatgagggcacatgcttgtagtgatggctactcaggaggctgaagagggatcctcgagcccaggagttcaaggttacagtgagctatgattgtgccactgcactccagcctgggtgacagagggagaccctatctcaaaaaaaaaaaaaaattaaatcaagagtttgcttagtacattcagggtgtccacatgatcaatattatgcagacatcaaaaatgatcattatgaaggcaatgtataaacataggatataggtgggaggaatggataatattcagtgagtatgttacaatgagcttgccacaatgccaaataaatgtgtctttatttgtggaccaaaactagaaaatatgaaaatatataaatgcttctatcatatgaagatggtagtattatgggttttatgggttttttacattttcttcagaccttttttttcacctcattgctgccagtgtgccttttcaaacttttttagcattatttttatatccactttttccatttaaaatgtctctaaggctgtggtagtttcattagtggagacatccttcctgtgtaaatccaagtatctcagaaggcaagaggatgggagaagttgtcttcctttttgaacacccaccaatagtctagactgctttcacatggaaggggtgctaattagtaatttttcacatttgctaatgaataagtcacctcggggaaaattgatagaggtgtagaacacaggtcacttgtggggcccagaagtgagttattggcttggaatggaagctgtgaaagttgaagacgataaacagctacttggaccatttgcctcaaattctgatcacccatctcgtcagcaaaggccacagctcactgaggttactgtggtttcaccaggtttcctcattatttggaaaagacctgagcttgccattgctaagctaagttgaactatttcacttggcctaatttttctggttattttatttcttaaaacttagcaccagctgagcttggttgctcacgcctataatcctagcaacttgagagactaaggctggcggataacttgaggccaggagttcaagatcagcctgggtgacacagcaagacctcatctctaaaaaaaaaaaaaaacaattagccggctgtggtggtgtgcacctgtaatcccagctgctctggaggctgtagcgagcctggaaagtcaagactgcagacggcagtgagtaatgatcacaccactgcactccagcctaggcaacacacccaaaatctaaaaaataagtaaaatgaaaaacttagcacttatttttattatggataaaaacaagaaggtgcttggcagaaacagcacagcccagaggaaaaaatggccctattggtttctaccaccctgatcctgaatcccctgtgacacacagggttagtgttctctctttatggctaacaagttttgctgacctagtagtatttaggcaggacaagtaaggcctcaggcttaggaagccagatgcctggggatttgtaagggagagccctgggagccttcccacgttgcccacctgcacagagctgtgtgcccttaagcaagtcacttcactcactgaatccttctttctgcattaactggaggatgattgacacccagcctgtgttcctaataccatcacccatccattgaccagacactgtctttagaatcaaatgagatagcagaaaaggtttttttaaagccttttacctatgctacagaatagtattaaataaaccaaacacacacacacacacacacacacacacatttaagagggagtggagggcgtttcaggcatattaactgccccagggactgacaatgaggatataaagtccctataagccaaggtccagggctgtcctgtgttagcagagcccttgaaagagctaccacaggtcccaactaactatttaagaacaaaggggaaaacacaacccagaaaaccagagagaagagaaaaaataaataaataagaaaccaggagtactggtgcttctgagggcaggtggaaagcacagccttagccctggggctttgatgacatcagcactggccagaaaggagctcagcacatctccctgcccctcccacgggttccaaccccgcagttgctcaccgccagcagggccggcacctgagtcacccacttgtcaacgccctgggtttcccttggactccttgcccgccggggctgccagatgatgagatcatagcacttgacaaaaccctgtctttcaaaagcacttttatccaaatgatttttttaaaaaagaatttaacaggcattatcttactagctgtcccatcttcggcaaggcccacagcctgaatacattaaggtgtgttcaggtttgaatacaccttattttttagggcagtcttaggttcatagcaaaattgggcagaaagtacggagctctcacagaccccttgttcccccagcacgcacagccccacccactatccgcatccccacatcctgcaccagagtgctacgttggttacaatccaaagtccatagtccgtgttagggctcacccttggtgttgtacatcctatgacatattcagttttcaaggagagaaacaggcaacaagggttcagaaatgcacaccctctcagtagagcaaggactccaccctccccaaccaggacagccttctctccatccttagtgtgatgctttccttcttcagccataaagcaagggaacacttgataagtattaacgcgtagggaaagttttttctaaagcagaatcatctaaactagtgctcctcaaacttttacttgaatacaaatccctcgagagtcttgctaaatccagatttggcttgaataggtctgggacagagcctgagctgctccaacaagctcccaggggatgcccacgctgcaggtgatcagaccatattttgaggagcaaggctctgttttaaaggagtggccacagggagtgggagctttcaagtgagtggattgggccaaatcatacctctgccaatggctggatctaaaacaatgtgatgatcaaacctacgttgcaggactcaagaggacaatgaatgcaaagttcagttccgagctggcactcaatgacctgagcgtaactactgttactctcctttttgttactattagtattattattattaaggcagagtctcactctgttgcccaggctggagtgcagtggtatgatcttggctcactgcagcctccacctcccaggttccagcaattctccggcctcagcctccccagtggctgggattacaggcatgtgccaccacgcccagctaatttttgtatttttagtagagatggggttttgccatgttggccaggctggtcttgaactcctgacctcaagtgatccacccaccttggcctcccaaagtgctgggattacaggcatgagccaccacacctggcctgttactattattattatcactcttcttcactcttcttcttcttgtttttgtacttgcccaggtgagagtacagtggcacaatcaaggctcactgaagcctcaacctcccaggctcaagtgatcctcccacttcaacctcctgaggagctgggactacaggtgtgtgccaccatgcctggctagtttttttaaattttttgtggagacaggatctccctatattgcccactctagtctcaaactcctgaccttaagtgatcctcccacctcagcctcccaaagtcctgggattacaggtgtgaccaccatgcccagcttcattattcttttggctgattttgatcagttttcctttacccatctttgtctcaaaaagcatattatccacttttggataattttacattaaattttacattaattttacataatcttacaaagaacacctcataaaaccagattagcttgtaaggtctaggctgtgaaattaaaaataaataaataaattagcatatgagttcactgaatcatgtagaccaaaattttaaatacatccaaaatcttttcttttactctgcttttgaggaaaatcaaaagacagggttctccccctgcctctgatctcctccctcaaggccctgatctgtacttcagcctttcctgtctggcctcacatgcattcacttcaataacatcatgttagatctggacagaaccttcagagctcccagcccatcttcctcattttaataagataattgaggcccaggaagattagattatttgcccaaagtgatagttatgttttttggagccaggaagagttatgtttatatcatgttctttaagaaaggtttgcacataataaaagacaaccttcatatacatgggggagtgtgaggggaagaatggtgtacaaccgcacacccctaaatcacgtgcagatagaaagacaaccctctagattagtggtttccaggatgtgggatttcacaagccagaaaaaaagaaagaactcttagttgaagattttaccaacttccggctttgtcaagagagaaattttttttttgtaattacaattcactagaccatcatcccataaaagaaaacctaatagcaaaaagagagagacagtgaatgggcataatcccagaataaaaggcattcttagaattgtagctttatgagaagctgaattgtatctccttatttttcttattttgttacaaaccaagcaatcagaagtgatcccttgttcttaacctactttgcattacatgtgcctttgagaatctgatgaaagcaatgaacttttccccggaaaaatgtgcagacctatatacatacaaaatattatctcacaccaatcagaatggttattattaaaaagtcaaaaaataacagacactggtgaggttgcagagaaaaggaaacacttacacactgttggtgggaggtaaattagttcaaccattgtggaaaacagtatggcaattcctgaaagagcaaaaaacagaactaccattcaacccagtaatcccattactgggtatatacccagaggaatataaaccattctaccataaagacatatgcatgcatatgttcactgcagcactattcacaatagcaaagacatggaatcaacctaaatgcccatcagtgacagattggataaaggaagtgtggtacatatacaccatggaatactatgcagccataaagaagaacaaaattatgtcctttgcagggacatggatggagttggaggccattatccttagcaaaataatgtaggaagagaaaatcaaatactgcatgttctgacttgcaagtggaagctaaatgatgagaacacatgaacataaacaggggaacagcagacaatagggcctctttgagggtggagggtgggaggggggagaggagcagaaaaaataactattgggtactaggcctagtacccaagtgacaaaataatctatgcaatgaacccccgtgacatgagtttacctatagaacaaacctgcactgtacccctgaacctaaaataaaactttaaaaatggaatgtaataaaaattttacaagtaagtccacacattggcaggcccaaggtcaagatcacctgctgttagctgatgacttagtctctgcctgactagtgacttcaccctctggtcatccttaattgttctgaggtcctgtgcaagctagaaaagactcagaatctagctgagcaacagagcaagaccccatctctacataaaaaaaaacaagttaaaaataagaaaaataagctaggcatggtggcatgaacctgtgtctcaactactctgcaggctgaggtgaggacagatcacttgactccaggagtttcaggcttcagtgagctatgattgcgccactgtactccagcctgggcaacaaagcaggaccctgtctctaggcgggaaaaaataacaagactcagaagaaggttccacattcagggcctgaagctctcgggattagtcttctgtaaagtggcatgaatcttcataaacgagaataagaaggagcttcttctcctttgcccagaccttgaccatcagtgatactgccaaatccaaaaagatcccccaaagccccaagcccagaagctcatctgggttcaagaccaaaaagctccacctggtggtgtcagatcatgggaattctgggcaataagcctgggaagagggagggctgctctgaaacctggccaagggagacggttcatcggatctcacacggttcctctccaggccccgccaaagaggcaggaaaaggtagccgagatgaaagttggctcaggtccagcttagcgagcgatgatgtaaaaatggggtggaaggtacctaaaaatcctggtccaaaaaaaggctggtgacatccagaaaatgaagagttggcaggtacacacaaaccatgatatatgtgcatgaaacttcatcacagcttgcttctgagtaacaagcaaagatgtaagatgcttcttgactttcagctgccggcagacactcaggacagctcagcaaggcttctcagcagcatctgtcttaagacaatctcagccaggagaggtggctcacccctgtaatcccagcattttgggaggccgaggcaggcagatcgcttgagctcaggagtttgagaccaacctgggcaacatggcaaaaccccatctccacaaaaaaataccaaaaaaaaaaaaaaattagccggggtggtggtgcatgcctgtagtcccaaccacttggggggctgaagtgggaagatcactggagcccaggaagtcgaggccgcagggagccaagatcacacccctgctccccagcctgggtgacaaagtgagaccgtttcaggaaaaaaaaaaaaaaaaaaaaaaaaaaggcaataaagacaatctccatctacgcctacctgcaccatccagctacccaccccagctgtggttcccaaggtcatcatgcagaacacaggaaatcgttctacaatatccctctggaagagggatattggcctctctggaagagaggccagagaaagaagaaggaagatcttccttgccttcagtgcctgtatattaaaaggaagaaaatcaaatttgcaacctacctatcccttcctcactcccaccccataaaatactgtagagtagtttatagtataccttactgtatatcttagctgtgttgcaaatggattcagttgctctttccttaagtctgtaccgatgcctggctctaatatctatagcatttaggaagaatggggtaggctaaacagatgttattaacaggaacaggtctccctgggtgcattaacaaccctttttttgcagacaaaagctgaggaaaatccttaatggtttcagggctgggaaaaggcaaatgatagggtgttagggaagtagggaatccttcaagtcattaaaaccaattcttttctcaagaatgccaaaaaaggtgctaatttgccatatttaaatgtagatgaatggtaaattcagacatttggcagtggattagatagccataggtacctgaaaatggccccttcagccccacaggggttttaagatcctggtagtgctctatttcttaaactgggtggtgaggacctgaggatttgtgttctttttgagacagggtctcactctattgcccaggctggagtgcagtggcacaatcatggcacacagcagccttgaactcctgggctcaagcgattctcccacctcagcctcccaagtagcaggtactacaggtgtatgccgccatgcccagctaatttttgtgttttttgtagagacaaatttttgccatgttggtcaggctgcattattattccttaaactgtacatatgtaagataaatcttctgcttttttgtatgtctcattaacataaaaatatttaattttaaaagtctccattcccattgccaactctactccaagttagtaggacgagacttctggatcggatttgaaagtgtcactcttttggccagacacggtggctcacgcctgtaatcccagcacttttggaggcagaggtgggtggatcacgatgtcaagagatagagaccatcctggccaacatggtgaaaccccgtctctactaaaaatacaaaaattagccaggcgtagtggcgcccacctgtaatcccagctactctggaggctgaggcaggagaatcgcttgaacctgggaggcagaggttgcagtgagccgagatcatgccactgcactccagccttgggacagagcgagatcccgtctcaaaacaaaaaaaaaaaaagtgcctcttcttgtctctgtccctttaggtctcttcctctgtgtttctttcctttgtttggcttcctgtttcctgaccctgctggaatgtgagcagcaaacctccaagaacacaatctgtgaacagctctcgcctgccacagaacttaggcccgcctcagcctccgtgtgttcaggagtgaggctggccagagactcccttccctccgtggcccaaatggagggatagacaagatgaacagaacaaagccatccctccctgggacccaccaccagaggtctgggtcgcagacacgaagctgtttgactccgtttcaagagcccaaggacagtcaacaaatgacaatctcttccagccctgcccagcactaaaaggggtgacagggagcaggttctccagaaatagcctgctcgagttctctgtagtgcttgctcttttttttttttttttttttttttttttttgagacagagcctcgctctgttgcccaggctggagtgcagtggcacgatctcggctcagtgcaacctctgcctcccgggttcaagcgatttccggctaatttttgtatttttagtagagacagggtttcaccatgttggccaggctggtcttgaactcctgacctgaagtgatccacccgcctcggcctcccaaagtactaggattacaggcgtgagccacaacgcgcagcccgctctttttcattctctcttctctcaacacaaatgtcagcaatcagttctaaaagctgcttgggcttgacaggtaaggaagcatccagtgcagggaaaaggccccgagtaaggcaaaaaacaaactcaccttccactctggaaaagaagagcaggaacccgagacccccagcccttggttaaaatcagccctgctggaaacagctttgttgagtccatgagaaggtggagctgagacaagtggctgcgtgagcccagctgctgtggaggaatccgctcagaggagatggggctgagatcatgcatgccaccaagtgccagctgcaggtatttggggagtatcaattaaaatagcatgtagaggccaggcacggtggcttatgtctgtaatctcagcattttgggaggctaaggtgggagggtcccttgagtccaggagtttgagaccagcctgggctacatagcaagatcccgtctctacaaaaaaattaaaaattagctgggcatcatggtgcacatctgtagtcccagctacttgggaggctgagatgggaggatggtttgcggcaggcaggtcaaggctgcagtgagccttaatcacatcactgcactccagcctggatgacagaacaagacactgtttaacaaagtaataataataaaacaaagaggggcacacgtactcaggacctcctgaggctatgtcataggcaaaaaagtaaatagataaaaagaaaaaagaatgtagatggtagtaaagtaacctccagccagccataattgaaggaaagaataagttagagaacccatcttctttgaaatgcaaagcagtttaaaggaactggttaatggtgattaacagccattgagggtttgaatgaaacccagagaaatgacagagtgagtactttctgctccagcacaaatgatgttgtaaaaaggatggtcagaccctcccttgggcttaccgctgctggagggcagatgtgggtcagtctcacctcctgagcaacatagccacctcctctgctgtcttctcctctttatttattcattcattcaaatcagagatggggtctctctctgatgcccagactagccttgaactcctgggctcaaacagtcctcctgccttagcctccttgggattatagacgtgagccaccacactcggcttgcattttttttgtttgttttgttgtggtggtggtggtggtttttttgtttgttgttgttgtttgtttgttttgttttgagacagagtctcgctctgttgccaaggttggagtgcaatggcgcgatctcggctcacggcaacctccgcctcctgggttcaagcaattctcctgcctcagcttcccgagtagctgggattacaggagcctgccaccacgcctggctagctttttgtatttttagtagagacagggtttcaccatgctggccaggctggtctcgaactttcaacctcaggcaatccgccagcctctgcctcccaaagtgttgggattacaggcaagagccaccacgaccggtctgctttttttttaattaaaaaatatttaattgacaaataaagattgactaattcaagatgtaccacatgatgatttgatgtacgtatacgtggtatgatcatggccacaatcaaatcagtgcctccgccagcacccacgctgccgcacgctgtcttccgcagctggaagagcttttctcagctaccaatagaggcctattttggttacttatttagaagttaccattatttctatcattagtggtattctaagtcttttgaaatcaagtagcatttcaattaattttttttcaagatccaagatttgagtccttggagagacagtgacagggattaaaactccagattaactcactcaaagatgttgacttcaaccctagtaaattcatctccactctgactcctcccaaagttgttctcaaccgaagcttctatttttaataactttcattggtaagatacttgaggggaaaaaaaaacacaatatttcctgtaatgattcatcacttcttcctgaaagggaagcactgttgattcctagagtacaggactgtctgttttaaaagcaaagcacttcacagcctaaccccgttctgttggatgggacacactcagatggtaatcacatccatctgatgtgattaaaaaaaaaaaaagcaataagtttcttgacatcgctggaagagagcctcttgcctcaaacttcctagtggcattacagtgctccaggactccacacacagtccaagggaagagaacaaaaaatacctcatttttatttcaagtttactctattaagccgtatgcttggcagttcacatacatgtcatttaacaactctgggagatatcccattactccaattctacagataaataaactgagtctcagagaaattaagaattatgaccacggttgcacagctgacaagtagaaaattcaggatttaagtccaggtctgtattattgcaaagccttggttctttccaatatactctggagtcctctaaactacaagatagttaatggagagggtgggtctacctatcatcacccaggagcttctgtagtgcaaatgtctttttaatgatatataaatttttaaaatatgttttaatccaaaaaaacatgtattgagcgctcactagatgaatgacatcgcagtgattaaaagaaaaaaaagcatctagtcagtaaacacatgatgtcaatttcttttcttttcttttttttttttttttttttttttgagatggagtctcactctgtctcccaggctggagtgcagtggcgcaatctcagctcactgcaacctccgcctcctgggttcatgtgattctcctgccttgtcctcccccgtagctggaactacaggcatgtgctaccacgcccagctaatttttgtattttagtagagatggggtttcaccatgttggccaggctggtctcgaactcctgacctccggtgatccacctgcctcagcttcccaaagtgctgggattacaggtgtgaaccaccacgctcagcattgttaattttttaaagttaatgttgtttgaaaccatagagccatttccaaaaaagtgaagcaatcacaagctgtaaattcctaacaagtctctgcaaagctagtggtaaaacaaaaggagctgagaagctgtttaaaagcaagaagggaacttcaggtacatcaagtccaaatgtccctatttatagacagtaaactgaggcccagaagagcccatgacttgcccagggtcatacagttcaaccatgacagagctgagcccagagccaagccggtgggagtggtcagctccaggacttcagcagaggcaccttctacataacttccccaagaaccctcagagaggcctccagcaataacatagaattccgatcctgagggagttctaacagagatccctatggcccccggcaagcttcatcatcacaatgtcctcttcagttaagctctctaactttggactgaggcccagttgctaaggatcagtggccaagcgtgtggagagcgatagttaattttatgtgtcagcctagctaggctctggtgcctagttgcttgatcaaacaccacagcttggtgcagtggctcaagcctgtaatcccagcactttgggaggctgaggtgggagaatggcttgaagaattagataccagtctgggcaacctaacaagactgagtctcaaaacaaaacaaattaggccggatgtggtggctcatgcctgtaatcccagcactttgggacactgaggtgggcagatcacttcaggccaggagtccgagaccagtctgatcaacatggtgaaaccctgtctctactaaaaattaaaaaaaaaattagccaggcatgctagtgcacacctgtagtcccagctacttgggaggctgaggcaggggaatcacttgaatctgggaggcagaggttgcagtgagccgagatcccaccactgcactccagcctgggtgacagagcaagactctgtctcaacaacaacaaaaaaaaaattagctgagcatggcagcacaggcctgtacttaagagctacttaagaggctgaagcagaagatccctgagcccaggaattgaagctacattgaattacgatggtaccactgtactccggcctgggcaacagagcaagacctccactttaaacaaaaaaaaaatcaaacaccagtctggatgtcactgtgaaggtattttttagatgggactaacactgaaatcagtggacttgaagcagattgtcctccatcatgtatgtgggcctcacccaatcagtagaaggtcctaaaagagtaaagattgaagtttcccccagaagaaattcttttccctgcctggccaacatggtgaaaccgcatgcaaaaatcacccaggcatggtggcaggtacctgtaatcccagctactcgggaggctgaggcaggaggatcacttgaacccaggaggtggaggttacagtgagccgagatcaagccactgcactccaacctgggtgacagagtgagactcagtctcaaaaaaaaagggaattattttcaagactgcatcataaaaaccctgcctgcatttccagactcctgccctgtggaattcagactcaagaccaacatcagttctcacctgagtcaccagcttactggcctgctctacagatttcagacttgccagccctcacaatcacatgagccaatttcttaaaacaaatctctctctgtctctctgtctctctctctctgtctgtctgtctctgtctctgtctctctctctctctctctctctctctctctctatatatgtatatatatatatatatatatatattcaaggatatatataaaatcaaaaatccaatatatggattatatatgtatatatcctattggttctgtttccctggagaaccctaacacatggagcatgaatgaatggtgtgactctaggctgaaaatgggaagtggaaagcagataaattagtgagtgcccatcttgtgaaaggcactatgctagcatcatgttccagggtacaaactctgcccctaccctcaaaaagcagaagttgaataaggcttcaaggctgaagactggcatacgaggcagattatgtcaccctcctttttgagataagagcactgcagccttgagagattccagaacttgttcaagcctcagagctgctgtgtggagccaagattcaaacccccatttgcatgactctgaaggcacagtgtttccatttcaccacagccctgatttatctatgatgtctccggagtcaaaagggggagaaggcttcaggtaagatggagagggccacaatgtcaaatgcttctaaaaggtcaaggaaagaaggttggatggtgctggggacaggggagaaaagctccatctgctgccccaattcaagatataaacaactgaaggcttcccatggtcagttccaaaataaaggtatctctgacccatttagaaagaaaaggaggcaccttctgaaatttctcctggaaggactcaactggaaatcatgcctagtgatatcaaagagtcagaaattttttttggagactcaagtgatcggtaaaatgtaaatggaagaatagggtaaacaaagctacaaagaaggaagtcctggtaaaagtacaaagaataataagtatataagaaacaatgggccgggtgcagtggctcacacctgtaatcccaacattttgggaggcccaggcgggtgaatcacctgaggtcaggagttcgagaccagcctggccaatgtgatgaaccccccatctctactaaaaatacaaaaattagccaggcgtggtagcacacgcctatagtcccagctactcggaggctgaggcaagagaatcacttgaacccgggaggcggaggttgcagtgagccaagatagcgccagcctgggtgacacagtgagactccatggcaaaaaagagaaaaaaaagaatataagaaagaatgaacagaatgttgaattatagaaatgttaaatattattaaatctatgccaatgtattccacacaggccaatttgtatttggtatgccattataaattataagtaacatgcaaccggtgttcccaggatgattttccatggataagaagccctgtgttcttagtatatgggtcctctgaattaactatagtgggttcacaaagtttattcaaatggagtcatcactctttcctgccagcccagctactggtcattgcccagctgattagagccagaggtcttccctctgccagattcaacaagagggagcatgaagaatgcagtctcttatttacaagctgtgaagcctgcaaaaactttgccgagtgtatctgtccatttggtgataactgatctccagtggctcagaaagggcggttgtttgggttagcaagtataggtgtctgtcctgattttctgctctcgcaatgcttccatttacttcagcaaatgtggcctggtgattcactggagaccaatggtcatgtgggctactccctggaaggaactcagaggtggtgtttggagacacatgcaatctttgaaaacccatactggcccaagtctcagtatcttgttaattcctaaaccgattaatgaagcattactcagagtaaaaagaagttatagcctctgccaaagtccaagcttttgctcacaatgtttggttcttgcatttccttcagggacctctcagcctagcccacagcaccaaggtcatggatccccgagcctggaaacctgagctctatactgacgaaccacaacccaacctttctgagactcagtttcctcagctggacctcagtcaagtctcttccatctctaaagttatatgaattgatgatttaagtgaataaatgcagtgtgaggtacctagatttccttaatcagacaacaccatgaaaagtgtttccaccaacacctgaaccaccagcagtacaaatagaaactgcatattctctcagaaaacacaagagaatcaaccgaaaaaaaatatgagaattttaaatggttctgggaaagaggcttactatactcttaatgaacatgacaatccattagaataaactaacatcaaaaagtattgaacacctaagaataaacttaaccagaaacatgcacaagatctacaggaagaaaaggttaaaattcttatgagggacacagaaaaaaaaattttaacaaacaaaaaagacatacttcatcttggacaggaagacttaataaaattaagatattaattctccctaagataatctaaaattttaatactattccaataaaaataccaacaggatttttttgaaaaggaacaagctaattctaaagtttatgtggaaaaacaagtaagcaagaatagtgatcaaattcttatttaaaaaataagatcaatgaaaaggagctggccttctaaacagtaaaatacatgcaaagtatagtcatgcaccacacaatgacattttggtcaaaaatggactgcatatatatgaaggtggtcccataaaatgataatactgtatttttactgtacattatctaagtttggatatgtttagatacataaatacttaccattgtgttacagttgcatacagtattcagtagagtcacatgctgtacaagtttgtagcctaagagccataggctatatcattatagcctaggtatgtggtaggctaaaccatctaaatttatgtaaccacactctgtgatgttcacacaatgatgaaattgcctgatgtacttctcagaaagtattcttgtcgctaagtgaggcatgcttatataataatcaaaaaaaagtatgagattgacacatatataaacatatcattggtacaaaatagatagaaatagacccaaatgtatatgtaaatttatattaaatatatatccacataagaatttataaaagagtacatatacatatgagaatttatataattttgactttctattttcaatcagtgggagggaaatggatttttcaggaaatgatgctgtgacaataaggttgccatttggacaaatgttgaatatatattctacatgttacaacaaccaacaacaaaagttccagatttaaaaaacaatgcaaacctcaaaaataaaaccataaaaatactagaagaaaacacgggattttaaaaaaatcatcttaatggtggggaaggccttcctaatattatacaaaactccaaagtcataaaagaaaagaccaataaattgaattactttatgaaagaaaagatcatcatgactttttaaaaagtataaacaaagtaaaacaaaaagccagaatatatgtatatatatttcaagtatatttcagacaaagggctgctttccttaacatgcgaagaacttctcaaatcaatgagactgataacccaatagaaaaaataagtaaagaaaatggacagagatgggcaaaaagttcacataaaaggaattacacatggctcctaatcataggaaaatatgttcgacttcactcacaataagagaaatgcaaaacaaaactcagagaatcaagactgacaagatcagaatgtttgacaccagacttgtgtgacaaagaaaaaacactcttgtccattgctggtgggagtacaaattggggaaacctctgtgagagcaatttggcaatatctatcaaaatgaaaagtagatacccttgagtcagtaatgctgcttccagaaattcattttacaggtatatttgcacctgcgtgaaatgacacagataagggatattaattgcagcattactcaaaaaaaccaaaggctggaaacaaatgtacttaaatatggcactgattaaataatgacctacccagatatgctaagtgaaaaaagcaaaatgcaaagcaatgtgtatagtgcgctatcctatatgtcaaaaaactggaatatattgtgtgtccctagtcaatgcatacaatccatgcaagaaataagaagttatggttaggcgcggtggctcacgcctgtaatcccagcacttcgggaggcctagccgacagatcacttgcggtcaggagttcaagaccagcctgaccaacatggagaagccccatctttactaaaaatacaaaaattagctgggtgcagcggtgcatgcttgtagtcccagctactggggaggctgaagcaggagaatcacttgaacctggcaggtggaggttgcagtgagccaaaatcacgccactgcactccagtctgggcgactgagggagactctagcgaaaaaaaaaaaggggggaaggaaggaagggaaagaaaggaaagaaatgaaagaagaagaaggaggaggaggaggagaaggagaaaaagaaaagaaaagaaagaaggaaaggaaaggaagaaagagaaaaagaaggaagtaacatctgggagaggaactgactgactgaggtagaggggtgaaaagaacaattttttttagtgcattctaacttacaactttgtgattttgtactagccaagaaattttaattaatgcaaaggccaaaattgcagcttccaagacaagacctgcagaatccagttctctgggggagttatggactctgcgattttcacaagccctgtgtgtgattctcgtgcacatgggagttggagaacccctgacacagagcatccttggcaatgcacacttatcaaaataataatagcaacaatgatgtaagcagtaatgaacacttacttaaaaagataaagcccaagacaccactgccaagatcttgtgcaagttttcctgaaaaaaattctttggcacagctaagcacagagattttacaccacaaggtattccttgttccctctcatgttcagttttaaccactgttcatcatttcaccagcttttttacactttacaaaatgctttaccctaatcttttgagctagataagagcataataagctgcacttgaagttacaagaaaaggggaagggactcactccaaaaatagaatgatacctctaaactttccagctaacagctaggcactctcttctatgttctaaagaaagaactaactgcgagaaatatgcatgtttactcaatttcttcaacctaggcatacctgtgttgcaaatgatacttgtgtatttctgagatgcgagcggagaaagaaaaagcatagtctctgctctcagacagcgatggcttccttctgtgttcttctatttcttcaccttttttattttattttattttattttattttttgagacagagtcttactctgttgcccaggctggagtccagtggcacgatctcggctcactgcaacctctgcctcccaggttcaagtgattctcctgccccagcctcccaaatagctgggattacaggcatgcaccataacgcccggctaacttttgtatttttagtagagacggggtttcaccatgttggccaggctggtcttgaactcctgacctcaggtgatccacccgcctaagcctcccaaaatgctgggattacagatgtgggccgccgtgcccatcctatttttttgcctttaaatcaagatgaaaagacaacatgatgtagtgattaggagcatgtgctctggagccacactgcaggggttcaaatcctagctctgccacagtgcaaacttgggcaagtgacttaacttctctgtgcctccgtagacacatccctaagatgggaatagtaccaccccatttacttggtatgaggattagataaatgggtatatgtgaggcattttgcatagaaaatggcacatagtgctatataaatatgtgttgttcctatctccgaccagtcttggagcattaaagaaatagaattcacaaaagtaagggtaaaaaccctggaagagagtgatgagacagagaggaaaactgtgtagtagctaaagagaagacacagaaggcaaacaacaatgaaatgttgattgcttccaagaaatagaaaaccaactataagatactgaagcaatgggccaagcaaagcaaagctgttttttccttgttctgcggactgctccaatgccagacttttccattttccggtctggattcgtatcgctgtctcagtttcatatgggggacacagaccaaacaggttcagtgttagggagcagtggcagcccttactaagcccctgggttcatgaatatgactgcaactctcaccctctatggcttaaggttatgggaggacttggcctccagagaccagatctgaggtggggaggagacaggaagagaggagattgtaaatctaccagcctccttactcacagagggtccctgcgagcccctcaaactcagccacagacctgccatcaccttgcatacagtctgcccatgggactgtgggatgtaaacacagatagaagggaacttctagaccccaactgccagatctcgccattttttggctactgagatccagagagagcaaacaacttgccccaaagctataggatatgtagatgattattttgacagacagaccactgataactgaaatataagcacctctcctcattaaacattctttaatcactatattttagtcatttttaaaaggttctttctttaaaaaaaaaaaaaaaaaagccaccaagcaaaataagtatctcttgagccaaaatagtgacatcaactgtgtaatggtcacttccctgtaacagctaccaggcggcaagagcagtgaagcacccgtcgtcacgctggttccctagtgcagacttggaatatgctggagaatattcagaggagcatgggtgcttgctctgacatgagtctcagaggtgcagacacgcacctgcaacgtcctaactttccttagaagcaatttggaactatcaaccacaatatatttatccaaagtccctataaactaagactttctggcatcctttatcttgaagttgaaccaactgaaaacaccctttgactcctcttctgcctgtcctactgatgtctatcaccttctcctgcctgatcccagccccaccagaaggtcataagcgaagtggccttctcagaatgcagctgctgaaggttcagccacacagaatccatccaggagcctcaagcagccagacctgtaggtaccacattttttcccacagaccctattctgaaagatttggtctagcaagtttattaatatgtttcccatttaaaataatcaaagcatatctgactgccaattagagctcccaagcaacagaagataactagtattgccacactgacttgctagtatttcaacccagaaacaaaatgcattttagccaggtgcagtggctcacgcctataatactagcactttgggaggctgagggggaaggatcacttgagcccagaaagttgaggctgcaagtgagctatgattgtgccactgctctccagcctgggtgacacagccagactttgtctcaaagaaagaaagaaaaaaagaaagaaagaaagaagaaagaaagagagggggggaggggaggagaggggaagggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagagagggagagaaagggagggagggagggagggagagagagagagagagagagagagagagggagggagggagagagagagagagagagagagagagagagagaagcatcttaataagccagcactgcctgattctgaaaatatttgcttctgcctgccacctttctccccactacactgctccaacctgaactcaccctggaatctggcacagcattgaagactcgctgggttgccctcccagcaaagcagccaatttatctgtgatctgaaattacatcaaatttccaaggactgtgaaaaacatttcccatgagcaagaagttaatttatttgcactgggaaatgaatggttccctttgctttcctgaccctcccataagcaccaggaaacaacattaagtgaccctgaaaagagaccccagacagagccttcacttatttaagatggcctcaaatcagccatgtgtgacagaagacataaattctccagtccacgatatacggtctggggattctttaagctgaggtgcagcatctatttgaatgcattcccttttgagaaatgattgggtcatgttcagttgcacatgtcatactttgggagaggagtgctgaaattgtgtatttggagcaaatttaacaaacttctttatgcaatcataggtaagaaagtaatcatttaaaaacagatagtggagttcattgtgttaggacaggctacaagaagccccctctgtcttctgcccactgtaatttgtttcataaaaactagaattctttttagaattggaaggagcaatatttgagattatcccagaaaaagggtcatttggaagccccaaaaagaaaaattcattttccaatcaaaccatattaactttaacaactcccaacccaccaaaaagcactcaaagtaatgagaaccataaaaggagggaggaaaacagacatcagttcgtggggataataattttcttctgttgtcagaacagccttgttctattataaaacaatcagctctcatgcatcctccctccatttctgcaaccccctggattagagggagtctttcatttcactcttcttggccttgttgaagaagcacaggtgacccacaggacatcactcttacagaccataaacttctgatattccaggtagtcagacattattcaaaggatctatgttgcaaatcatgccactctctttcaaagtcaagttagtacttaatatgtgccaggtattgtgctaagcacttggcatggactatctcacttaatcctgtgatttatatactatttgcctttattttatattagaaagatgagagctggataacttgcccaaggtcacagagcttatccacggccaagcagggaattgaagcctagtgatctgcctgcatacccaacactcttaaccattgttctggcccaccttatgatatcagggtgcacgtgggccttactgaattacccagaaacacacacacacacacacactggctatggacactgtccctctatagagtagcattcaccaggactaaggaagacattccttctcttgaaagattcagactgaaccccatagaatgactgtaataagtgcatgaaaagaagtaaaaaaatactgtacactcagggagccacagttaaaggccatcattctgtattgtgaaacacctcctgatttcctgaaatctactcaacaatgaagaaaatacaaagaggccactggaatcatttctacctatcttctgttgggggtaacgtctgcaacctcaggtgagctttgagacttcaaggcacgttgcaaaaggaaaaaactgaaaggaaatcgccctgttcgtgggccagaatatatttcattcacaaagaaaaaaaatctgaactttctggaatatttttaagcattgttcccaaacaaaatgcttatcatctcaaatataataatactgagtccttcccacttataaaaactgtccccaatgcacatggagagtagtaactaaccccatgtgtcaacttcaaataagccaaggtataaaaggtacaaaacggctccaaaaggactatgctttgaaaggaaggccttaaagcattttgcaaacttcacgtgcacttgttttatatgaatatctatagtcacatacagcataaaaagaaagctttgaaaagggaaggaactcactgtacagaagacaaaacaataccctttttatttttaaaactctggtgaaataggtttccataggacatcccattcaaaaaaaaaaattaatgtaaaccaacctgcctgtgggttagtcacactatacagacttcatcagagtgtttacagatacctagagtatttacaaatgctatccgttaggtagtaaagtgttgttgcaatttttccagcacatattccacagtaaaataaagggggtatattggtgttcttgtataaaaattcttaacaaatagagaaaggcaattttcctgagagaagatttgttcttgaaatatttttctttaacaattggaaatataaaatgggatgtagttgtaaaagaagcataagaatgtctaagttaacatttttcttttaaattattttaagtaccattaagttaaaatgtttacattcattataaaaaatgctgttaaatcttatgcaaatgatttaacactgattgctgcaacgcaaattgcactttttaaaaaaattattgtatacatggaagaaaaatatcttgtttgctaccctgtttacaaattccgactgacttcagatcagccacacaatatgaactttgagaaacgtcagtcacagtgtatgttaaagttacaatgcagtcttgcaaactgagtaatatttttgataagagacctcatgaaccgactcagcctccagagatgtgtaccaaatggcctcaagtgatcttctccatgaacgcacatgaaatctggatgtggaaaaggtatgaagaaattctggaacaaccaaaattgatcagaagaagcacatgattttggacaaaatgcaaaatcttttttaaaaaatctctctcaatattccatagcaggcaaggcccaggtcctagtcctggcttctggaagtggagcagggtccgccccggaggcgggctggctggagtggcccaagcgcccagttgcactggcccttcccttccatcttctctcactctttcagcaagcctcttgggaaaaacatctctttcaaaataaaggcacgagaatcacgttctgtcagcgcagtcgccactgtctggactgctgcacaaaagcagacacgagtggagtgaggcccgcggcggagccctccctgcctcctggcggcgtgggctcaggccagggccagggcgcaccaggaatccggtcgcacggaggacgtgacttcggccggcgaggcgagactgacgcctatgtagagcccatcttgacccgaatacttgagctcgctgttctcgggattggtgctctctcccgcaccagtcatcaccggggcacccgcctggcagaagagggggacacagaggagagacgagaaggtgagaagcggttacaatcctggtagtgaaatacatgggagctaatgaacgggtctgtgcagccagggccagagctgctcctgggcagacccagggcaggagaaatgaagccggcgttactatcccctgcccccagcaagtgggggcctttccctgcattgcacacagtgccactgacctgaccctggccacttaagccttcgaaactttagaactcagggcaggagccactggcaagatgcaaagctggacaaaaggaaggggaactgaagaaatcctatttgtaaaaagtgccaagctctaagatctctgactgtgaaacaaacctcactgtgtgggtgaataggcattaatgatgcacacacaacctgatcatttccaaagagaaaatgcagagcgcacgcatgcgtgcgcgcgcacacacacacacacacacacacactctaacaaggcttatccagtgatggcaaagtctttttagactttttagaaaagctgcacagttcaacattccctgatcagtgaaatttttgaacattgacttcatggaaaataaacctatgcatatacaggctttaaaatctacctcatttaccttaattctttacaagaacagtccatgtctgaagcagaccacgttataaagaaaatgctaacatcctctatctgccatgatcatggcaatgatttctttctttttttttttttttttttttttgaaacagagtctcactgtctcccaggctggagtacagtggcacgatctcagctcagtgcaacctccatctcctgagttcaagtgattctcctgcctcagcctcccgagtagctgggattacaggcatgcaccaccacacctggctaatttttgtatttttagtagagacggggtttcaccatgttggccaggctggtctcgaactcctgacctcaggtgatctgcttgcctgggcctcccagagtgctgggattacaggcgtgagccactgtgcctggccacaatgatttcttgaagcacaagttcacctttgccctgttccacccattcctcccattcacatgaaaaaggccaaataggaaacatcatataatttagtaaaatcaaaccaaaataactaaaatctgtttagacaacagtttgaataaagttgcttttgagaagctttttgaaaaatttcgccataatcatgtactttttaaaatcacctttttccttctaaaagttcaggagctcttattccttccaagctttcagggctccattctataaattaccagatacttgttatttgacagaggtaggacattgtgtacttttcacagaatttcttttttacatacataatcccattaaatccttaaaacagcatttctctggcaccagacacaggcggaacagaaaggaagtgtgccgagcctccacggcctgcaagtgaatgaggtccaactctactcgttttccaacaagatctggtttgctctcaaccctcaccataagggcatgaggctgggaggcaggacttcaggcgagcaagccctctgagtctaagcacccaaacttccttcctcccaaccagacagaccaaacccgacccctccacaggtaaccactccttccctttcccagcagaaatgaggttttatgaaaatccagcaacaacactggccccacacccaaacttttgtttatataacacaaatgtaaagacttaaactgagggttttaggtgcattaaaaagcaaatttcacaaaaatcagtgagatgtctaaagcttcagatggattcttgtggcaattctgaaaaagctaaaataatcctgtccaacaaactgaatgccataaacttggttatacttataaacatagtgattaactttagcccttaattccagagactccaccagaagcaaatccagtgtggatccagatttaaccctcaaagaaataagcaaaaggatgatattcaattacaaaagaattatttatttagaaaggaactattagagtgagcttccttataatgatacatctcacgtccaactttgcattgattttcttattcgaaaacaggcacatcagcatatgcctctgactaaatctgacttcaccgcaacaagtgttattttctgaaatggagagggttcctgaactggcccaggaaatagcccatctcaaatggcagggaagtgccaagacagcagagggatctgtcaccaccaccacagccagcaacaagaagcataagcaggctgggcacggtggctcgtgcctttaatcccaacactttgggaagccgaggagggaggattacttaagcccaggaatttgagaccagcctgggcaacattgggagaccccgtctctacaaaaaatacaaaagttagctgggcatgtagtcccagctatttggggagccgagatggaaggattgcttgagtctaggtgatgaaggctgcagtgagctacgattgcatcactgcactccagcctaagggacagagcaagaccctgtctctaaaaagtaaaaattaaaaaaaaaaaaagaaagaaagagaagaaaaaaagaaacattggcaaagcaacaactgacagccagacactagatcaggagcctgaaagatagtcaactgccccaggagctcccaggctttgtggggagccaggatccatacacattagaaagtcgactgttggctgcttatcatgaacaacaaatgagtggctgagacaggaaggtagaccaagagtcagaaaaggaatagcagagggcaaggactcctgggcaaggaaccaaaggcagcccacacaggagtatgagaaggaggggaagcagcttggactctcaagtcctgtcctgattcagtcccctgctgagtgcagtcccccctgagcctcctctgtgcctgggtcctcacatttcccacctcagggatggttgcgacaattaaatgagctaacgtttgtaaaagcgaaggcaaggtgccttgccatgttaaacattccgtaaagggaagctattgttattggcgagagaaggatgttcaaaatgggaggcagggcggatgaagagaggtggtcacctggcctgttcagaagaaaagccagctgaaaaacagaaggatgaagcaaaagagtgaacagaccatgtgggagaggtaaaccagaagcctgacatacagctttgtgtgcctcagtttccacacctataaagtgggataaaaagaggcacctatgccataagattattgcaagaattaaattggctaggccaggcgcggtggcccacgcctgcaatcccagcactttagagaggccgaggcaggtggatcaccttaggtcaggagtttgagaccagcctgaccaacatggtgaaacctcatctctactgacacaaaaaaattagccgagcaaggtggagcatgcttgtaatcccagctactcagaaggctgaggcaggttgcagtgagccgagattgcaccattgcactccagtctgggcaacaaaagtgaaactccatctcaaaaaaaaaaaaaaaaagaattggctaatatatgtaaagcccttgtaacagtgtctgagaacagtaaagattatgtcagtataagctactcttgttatctaattattattgttaaggttaagaggcttggatctaatttattctcctcattctatccttcagcccaagcaagttaccccatcaccaggcaggggcagaagcagtcggaacacagttggagctcaaagagaaccacctccagaatgaccctattcaaactgtcactgacagttcttcgcaaaaataaatcaaagtgttctgtagccattcaaaagtctcatgactctttctcttttttattttattttttatttttgagacagggtcttgctctgtcatccaggctggagtgcactgggtgtgatcttggctcactgcaacctccacctcctgggctgaagagatcctcccatctcagcctctcgaataactgggaccacaagcatgtgccaccatgcccagctaatttttgtattttttgtaaagatggggtttcaccatgttgcctaggctgttctcaaactcctgagctcaagggatccacctgcctcagcctcccaaagtgctgggatcacaggcacgagctaccacacctggtgactcactgactctttttcaacaacccacattaaagaaacgttaacaccctgaatgttattcttacacctgaataacaatcccaaaagcaattggcgaaaataacctgtctttttttcagacaaaatgttaagctatttggcaggccaagagtcctgctatcaaagggcagacagacctcaaattccatgagtgatgcactcctagaaataaatctgctcatttgcaattaaaagcaatagctgagcctgtcagaaaaaaaatggggcaagtatttgtgcccaatgcttggtagccttattttatgtgtacatataataatatttaaacatgaaatactgcaaagaaaggctgatgttacttacatggtaacaccagtcccctcactcatggctggcggagctaaattctggtacacccaccttacagaaggcagttagctgcaatgtcaagagccatccagaagtttagaccctacttcgccctataatttcacttctggaaatgtattataaggaaataattcaaaagaagggaaaggctccgcaaaggaagccaaccgttgcaaggttacttctaatagtagaaactatagaaacaatctaatgtctaataatatgggaacggtttagaaaagcagggcacatccgctcaatgaactattatgcaattattaaaaataataagatcatggagcaaaatggaaaaaatcctgtaataccatgttaagtgaaaaacagcaagatatgaattacacgtcataactgcaatttatccatgcacatgtgtaagtattacaaaggtcccctgggaggaggggagaaacaggggactagctgagagggccaagtctattagccatctatacctttctttgaatatttttctttgaatacttaaattgaattgcatagtaaatctatttaggttgttgccaaagtaattgcagtttttggcattgaaagtaatgacaaaacccacaattacttttgcaccaacctaataactttggggatgaatagaagacatgagtaccagaaacacaaggcacttgagggacaagccaaccttcatgggatcagaaagtggcttgaaaaaataggagggaaccagagtcgaggcactaacaggagggcgggtcagaagggcccccatccgcccctgaaatcatctccctgccacctggcacaggccagggcctggccagccacgcacatgtgaatctcacagttctatacaagttaaaacaatcaacacgtcagctccatgcatcagcgtaacttcagctctcaaaaccgatattctctcactctgtcgcccaggctggagtgcagtggtggtatctcggctcactacaacctccgcctcccgagttcaagtgagtctcctgcctcagtctccagagtagctgggattacaggcgcccaccactacactcggctaatttttgtatttttagtagagttagggtttcaccatattggccaggctgatctcgaactcctgacctcaagtgatccgcctgcctcgacctcccaaagtactgggattacaggcatgagccaccgtgcctggcctctaaaccaatattctaaaagtagaaggcgttc

SEQ ID NO: 15234 - DNA, 49416 bp, Human
ttcaagacatttcaccaacccttccttctcctctgccaatttctctttttgctccacttggaactctctgcatattgcccaggtatacttagtttctcgaaactccttacaggacattttactttgggactgtcttctttcattcctttttaaagacatgctgtatcgctttcaaaaaattctcaatttttaccaattcaaaaaaaatttcctaattcatttccagttgagtcccgtatttaaaacagtattatctaggtgctaatatatgtcttattattcttatttttatatgtcttaacattctttttaaaaatattttcagcctctctaaaggatcaaaaaattaacctttaaaatcccttgaagagcattttaagagagaaaatatttgaggtttagtaacacttacacattgtaccacctaccagctcctattctactagggaaataaaatttagatgcagctaaaatttagttagggcccaaactcacatcctatctaaaaggtttctgttttcctgtcattgttttctacccttcgcattttgcattcagtagggttgcatttttcttaatagttcttggtgatgcaaatgcaaaagaaatgaaatagggctctctcatactacaatttcaaggaaaaggagactacgaggcccattcagcgaggtgcaagaggcctagatgcagcacaccctgcaaccgccgcatgctccaatttcatcttagggttttcgtacagctcctcttttttggatgatgcaaaccgcgcaaaagcagcattcaaacctccccaccctggaaacgatacaagaacatgaatctttactgccactttctccctaacacgcagccaagggagagaggcccggatacccgcccccaaaaccgcgtccacaacaatcatttcctccctccccgccttttacatacagtacacatacaaatacacacacgcagagaagccagcaggggcgggccgggcccgaccactccgcaaaccgcagggggaacttgcggcaggccgagctattttcgcccagtcctttcttcttcgcttgcgtcttcctctccatctgcatgcacctgttacatgaaagcgaacttggggacgtagggtttccagaaaatccgcttcggagccacacagcttcgccgggtgctgcaacatcccccctctctcggtaaacagttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggtgagcgggcgacggggactcgccccgcccccccctcggtggcgtcgctcctggctgtagcggggaagtggacgcggcccgcccgggagccgagggggccgaggctgcagccgctgggcagcaggttgcgggggaggccttgcgtgggcggaagggggccgctcgcttctcggaatccctgcctttttctctcccatgcaccccctcccttttggggcttaagctcggtggaaaaagcccggagaaagatggggcgggcagacgggcgatttctggccgggcagcatccctgcttcaggtggtggcgtctcttcggtggcggggtggaggacctgctccagcgcggaggcagcgcactggcgggggaggagcgggaggcggccgtcccctcgctctcccacccccacccgccggttcccctccccctccccttgcggcccctcccttcggggttcttcgctttaaccgccctcggtgctctccctagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtaagtgatttgtagccctcgcgcttagcagtgctaccctcctctccagaggcctgctgcccaccgtgtctctttattttttcttctgtcctttctctccctcgctttagtctcatttgtaacctgacctttcattttagttttttgcccaataatctcccgtgtaattatgaaaatccagacgtttctacatacctgtgtatttccctatggtttattggcagacttggacagattttcttcctaggaaatatttaaatgcgttgctagttaatattccattgtaggtgaaataatgaagagtgaatttttgtttaaaaattagtgaaacattgacatttccatagttttggatcaagtacaaaatatcaatggaatttgtgcagattacacacaaacacttggatgtcagagaagtgcgtatgtgattaaattggatttacagggttttaaaaaaaataccttgtacttgatgaggccttctggatttgcttgtttaatacagattcaggactggatattcttgaaagtattacagtagtttagtaccgaggaagggccagaaaattcatttctccttttttatttgagatgtttatgaccttgaagaagttgttttacctttttgtttccaataggcaaaaaggaggtgtggaccagattcctcagttcacatctagtggtacagagaaatgattaaggacccaggatgttttgtgacattgaggaattgagactgtttaaagatctacgctccatttttagaaaaagggttctttttgtttatggtggtacccaggctctcaaacagagatagataggacctaagatatgttgcaatcaattagattaggtaaactcaagatcctttaaaaatatacttacatggggttctgaagttttatttttccaagccatttattttcgactaatttactgtcctttgaaaatgtatttcttaaaaataattaaattctgtagttttagttatgtcagcaggggaatggtggaaaacacccattagataacggagtcctgtctaggagctgagagtgccatccaagtgtaaaacgatcactgttccttgactttcttccatctagctgctctacgtaaactcctgttcacaagtttccttccaaagcttttttccttgcctataaagtctgccttttcggtgcagtcttacttgaacaatccttagtcataatccttgtctgtatattttacattctaatctattcctttcgtgataatcttttgttttaattcttaactctgtgtatgctttgacctccaaatatattgtgagaccgagggcaacaaccttaaatggaatttgtttataccctccatagtccgtagtatatatgatgcacctataaaacacaattcacgttcaaatggagcctagggaaactgatcaggtttaaggcccctctgatatactttttcatggtcttcgaggtatccttgtttattttgaggtgtttgaaaatatgaggttgtctaatagatctatattccgatttgcatgccacagtgaagttaaaagccaaaggaaatgtttaaaaaatctcccaaatcaccctccccacgctcatatgttaagtgactaagagtgctactgaaaataaaatagggtagcctttggaagaccagagtgttttccttatttaacaagttctacatttaacaagttcatttggattggaagggaagtgtttgtcttttcccttttccccatcattttttctgagaaacacctccatttagtgttggtgtattctgtgtccaacagttacattcctttttctgtcttcttcattcttaaaaatttgaaatctttgctgtagagtttagagtccatatttaaagtctgagccgtaaaggtgacacctcttgttgcaatttttgctttaacatttctgtctacatgtcccaaacttcattaatttttaagtcttaaacattcatgtacataatcgtttaccagtaataattatttaaaaaatcaacttaaattttgcccggcatttgctaaaggctataggtgctaggtatttgcataaactctttaagctgtttgctagcagaaagaggcatatgaactgggttaacagaaatgatctcttaagggattaaggatttttgcaattatcgggacattcccacaaagttgagataacaggtgtgatcttcatcatataagtggggaaataggtccctagagatattgggtggtaatgattctgttggtgtgtgaaagcctttagacttccctcacaaatcagttcagtcatcctgatggtcttcttctgcaacaccataatgcttacagaggatagtaggtcctctgatggtcaacccccttcttaacaaagtcagctgattttcaaattgaagtgtttttgaaattatgaaaattatgacatttaaaatagatatgttgttaaattctttttttttgttttttttaaagacaggatctcactctgtcacccaggcttgagtgcagtggcatgatctcggctcactgcaacctctgttgcccaggttcaagtgattcgcctctggagtggctgagattacaggcacctgacaccgtgccctgctaatttttgtatttttagtagagaccgggtttcaccatattggtcaggctggtcttgaactcctgacctcatgatccatccaccttgccctcccagagtgctgggattacaggtgtgagccaccgcgcctggccgacatgttgttaaattctagctagatagtactgctttagtcctgaggtctgcttttcctttattgatgagggaaagtaacaagtattatggatatattagacgtgacagcacctgatgatttcttccttacataatttaaaaggttgaaagagcagtgaaaaaggaacaggtagcctcatgtgattcaggcacatcagtgaaggatcttttcatagtaagtttttcagactttgggaggtactgatttaaacttttgtcaatgtctgcttttacattagtctgttatttgtatagatttcctgcagaactaacatttagggttgtcaaataggttcagactccttacctgaaatgatatgattaacaattcagaattctgggattttaggaaggcagggagagtacatatgccatatattttgctgctggtgcggtctggaatagcacataataatatgtctgcaaagaaacaacagtggaaacaggtggataaaagaaatgactgataccctcaatgtcagtccaggttttgccaccaaatgagttttgacagaaattttggttttcagagcttcttgggtttcagatttggggataggagattatgggcctgcagaactggcccattttataacagaacccttttggatgttgtgctcttgtttattcagataaatgttgaggtgtgtatgatttaaaatattttaatttttctcacttttcttttaggtagacgaagttcctgatggagctgtaaagccacccacaaacaaactacccattttcttttttggaactcatgagacgtaagtcctgttagctttaaaggcaaatcagagctaatttaacagggttattaggcagtagacattaattcaagggggaaatcgtaacgtaataggaaactttaaaatctttgaactttggaaagagtctttaagtctctatttttaaggtagcgtttacagatgctataggtttattttttactggaattgatatttccttaaccaaaaaggaaagtagaaattctctgagcaataagaatgattgatggatgaaaatacataaggaaagttttaataagtgatctgatattcctatacagtaaaataagtgctttttataaggactagttggtacctaatttttggttttatgatatcagatatgcaaactgtgtatattgtggagaaggtgagaagaggaagtctagctagttccctccatgtgtttatatggtccctgaagctctgctgcctctggtgggtatgtgggcagagaactgatgtgaagcaaatttttcaaaaattgcagctgaatgttgacgtatgttactgccaagtgcatgggatcactcaggaggctaccgttaatttcccgaagaatgttcctatgtacctataatttaatggccttagaaatactatataatctggttgattttggacttgaagtttggtgtctgtcataattttggtagtcttgtttacctgggatgaggagaaacaaaactattgctattctgattagaattatgtattcctaagagtggctgcaatggcaatatttggtttaaagttgcttagctactgtataaactttcacacaatgtctttaatagctctattgagatggaatttacatacaaagaagttcacctgcttaaagtgattttcaatagattttagtatatttagtagattttagtatattgactatcataaccttttgatgatcactttcccctctccaaccgtaaacaaccactagtctactgtctgtatagacttaccagttctggacattttatttgaatggtgtcatacaatatttcataataagtttttaaaaaaatacaactttggatccagaattggtttggccttcatcataattagagttaggttcaagtgtattctatatataacaatataatttttaagaagtgataagtttctgattccatgggatactttaaagaaactcttcagtaaatttaatagaggacaaaagtatcttttaatggaaaatggtgcagtgtatattagagtagggcttttcaaagtgtgttgtcaggtctagcaccattagcatctcttgcgaactttaattaaaatgtaagttcttggctgggtgtggtggctgacacctgtaatcccaacactttgggaggccaaggcgggagggtcacttgagttcaggagttggagaccagcctgcaacatggtgaaactgtgtctctacaaaaaatacaaaaattagccgtttgtggtggcacacacatgtggtcccagctactccagaggctgaggtggaaccgtcacctgagccggggaggcaaaggttgcagtgagccaagatctcaccactgcagacctcatctcaaaaaaaaaaaaaaaaaaaaagttcttaggccttattctagacctactgaataaagctgtgagtgtggagccaaagacctgttttaacaagccttccagatgattctgatttacgttgaagtttggaaatactgtagtaatgtgagtggacattccttagcatttttcagttttataagcttaaaagtctttaattctgatttttgtctgaaatggaacaggttttttcttttttttttttttgagaccgagtctagctctgttgcccaggctggagtgcagtggcatgatctccgctcactgcatgctccgcctcctgggttcacgccattctcctgcctcagcctcccgagtagctgggactacaggtgcctgccaccacgccaggctaattttttgtatttttagtagagatggggtttcaccgtgttagccaggatggtctcgatctcctgacctcgtgatctgcccacctcggcctcctaaagtgctggaatggaaccgattttatacttctatatatcctgatagtcttacagaatacacagtccattcttacgttactattttaaatttagaagaggaatgattatcccttctcctgcatttaaaaggattttcatatataaatatatgtacactttaaaccaaaacaaactaaactaaataactaaactgttgtttggttaataggtaattagatagttaatgaagacagtgaattactaatattcaagaatttaggatatattcaaggaattcaaatgaatttaactttaaagttaagctgacaatactgaattttcatttcaaaatgcacttggtttttgccttagtgttcttatgattataccatttatctttggaaaagcagtgctgccccatatgtatgttggtctggtggtgacttcttttgtacttaagattaatttttgggctgggcgcggtggcttacgcgtgtaatcccagcactttgggaggctgaagcgggcggatgacgaggtcaggagttcaagaccactttggccaatatagtgaaaccccatctctactgaaaatacaaaaattagcctggcatggtagtgtgcacctgtagtctcagctacttgggaggctgaggcaggagaattgcttgaacccaggaggcagagggtgtggtgagccgagattgtgccattgcactccagcctgggcaacagagtgagactctgtctctaaaaaacaaacaaaaaaatactaatttttggaaactaggtctctgatgatcttttttcccctcaaaatttgggagggtagttatttgaagtttttttttttttggagacagagtctcattccatggcccaggatggaacacagcggcgatcatagttgactgcatccttgaactcctgggcctaagtgatcctcccatctcaacttcccaagtagctgataactgcagtagcttgctaatttttgtattttttattattattattattttttagagatggggtcttgctacatggcccaggctggtctccaacgcctggtttcaagtgatcctcctgccttagcctcccaaagtgctgagattacaggctactttatttttttatttttttattttttgtgatggagtctcctctgttgcccaggctggagtgcagtggcaccatctcggctcattgcaacctccacctctgagatacaagtgattcctctgcctcagcctcccaactagtcaggattacaggcacccgccaccacacccatctaatttttgtgtttttagtagagatggggtttcaccatgttggccaggctggtctcaaactcctgacctcaagtgatccacctgccttggcctcccaaagtgctgggattacaggtatgagcctctgtgcctggcctgtttgaactttttagtttggattttgcataaatagtttagtagtctgctaaactagaagaaaggtatatttggaaattgtactaattcgtaactggtttatagattaaggttttttaattgttaatttagagcagaattcttttgtaactgcattcttttcctggcctacagacgtctgattttacttaggacattcatagtaaatgttcagcaatcaagttttgaatattagacagtgagccctaactgtgaccatgtactagatattttaaacctaacatattcagacagatttttagtaagtgggaatgacatagactcaattcttactgaagccaagtcttggtattatccttgattacatgttatagtctttccccttcctttctacatctagtcagtcagcaaatcttgttctttgcctttcaaatgtattcggatctgtccgctcttggtcatctttgtataattcaagtccatgcgtaattacttctgtaaataatgtcctaagttgggcacactgggacatgtctgtagtcccagctactcaggaggctgaggcaggaggatcccttgatcccaggagttcaaatctggcttgtaacatagtaagaccctgtcttggggggtaaaaaaattaaaaatagtgcgcttactctatgttggtttcagtttccactcttcatatacagttggcctgctgtatctgtgggttctgtatccatggagtcatcctgtcacagattgaaaatatttgggggaaaaagatggttatgtctgtagtgaatatgtatagattttttttctttgtcattattaccttaatgcaatgtaacaactatatagcatttacattgtattaggtattataagtgatctagagatgatttaaagcagcaatggaagacagttttttccacgggggtttggggggatggttttgggatgaaaactgttccacctcagatcagcagccattacttagattcttataaggagcactcagactagatcccttgcatgtgcagtgcacagtagggtttgtgcttctgtgaggatctaatgctgccactgatctgacaggaggcagagctcaggtggtaatgcctccctcctgctgtgtagcgtggttcctaacaggccacggacgggtactggtccttggccagggggctggagaccccagatttaaagtatatgggagggtgtgcgttttatatatatatatatatatatatatatgctgttttatataagggacttaaacatctgtgaattttggtatctgcaggggtcgaggaaggataatccacagtcttacggatacggaggtacaactgtctagtcaaagagatctttatatctcagtcagatcatgtcatttcactgaaaaccttcagtgactccctattttaacattagcagtgaatcaaaaccaaaaactacctacaaatgatatttataaaaacctatacgaactagcccatgcttacctctccagcctcattacatttttcaccgcttttttctattgtaaaaataagcctcatcttatctcaggtcttttgttttccctttgcggggaaggttatgccttcggatatttgaagtcatttagatcttagctcacatcctcctcctcgtgtttattttccccactgcaacagtgactgaatttttttttttccccttttctctttttttcacccacactcgaagagctggatcagcagggaccttgtctatcttgtcatcattaacttaagtgcctggcacttagtagctgttaaataaatatttggtgattgaaagctttgtgcactagataaagtcatttgttgattatgcatttgctgtccattagccaacgtttatgtagagcaactagatcagaagtttgtttttgaatactgactgccatttacctgctatataaccttgggcaggttacttatatttgtgttttttttctttgtcatttgtaaagtggggataatattatcttgcctcagaatcttgggatgcaaataagacatgacatgaataatgcttagaacaatgcttggctattatttatttaaaatgttcagctttggcaaacttttatttcattttgggaacaagagttgtggggatttacccatttttccaagacttctagtagtatttattaaattgaaatgaagctcagtttgagttttggtgactaattacctttgctaattcagggactattcctacctagttctgtatcttagaagtctaggaaatttaaataaagatattttgctgttttttcctccttactgctcttaattgtcttaatgcaaagaagttgggtgctcagttttaggaactttaaatatacatcacaggctgttttaaaacccgtctaatttatagttttaggagtgaaggtcagtgcagaggtactgatagtggtgacaagaagaaaataaagtaatgaatcttaggataggatttttttcttctacactagttcttctgtacaagtttcatagctgcacgtattggtgtgggacttgtatggtttctcttaaattttacaccaaataatgagatgaactgtttattcatctcttttttttttggagacagagtcttgctctgtctcccaggctggagtgcagtggcagtggcgcaatctccgctcaaagcaaggtctgcctcctgggttcatgtcattctcctgcctcagcctcccaagtagctgggactacaggcgctcgccaccacacccagctgattttttgtgtttttagtagagaccgggtttcaccgtgatagccaggatggtcttgatctcctgacgtcatgatcctcctgcctcggcctccacagtgctgggattacaggcgtgagccaccacgcccagccctattgatctctttttaccagcaggttcatgagaaatagtgcgtgcatattcagttgtctgttgaataatttttctgttatagactaatacatgctattataaaatataaaatatttataataaactttcatattttgtgatttagtaatgtagaaatgaagcagcaagttagaatcaatatgttgttaaaaatggaatttttctgtttagcaatattacttggcaacacttaaatgagttttgagcttcatatatttggctctgatttcctgttttgtgtatgtgacttcggttttttttttttttttgagacagagtctcttgctctgtggtccaggctagagtgcagtggcgtgatcttggctcactgcaacctctgcctcccgggttcaagcgattctcctgcctcagcctcctgagtagctgggattacagggacgcgcccccaagcccagctaatttttgtactttcagtagaaatggggtttcaccatgttggccaggcgggtcttgaactcctgggctcaaatgttcctcccacctcagcctcctaaagtgttgggattacagacatgagccaccgtgcctggcctgtgacttgtttcttttaagagttctagttgtgtaacaactgaatttttgtgtgtgttcttgtgggtattcatattattcacaaaaagtgaattaagagagagaactgcttgtctttgtttatataccattaggaaaattggaatgcacatgtacacacttagggcttcaacgtgtgtgccatgtaagaaacacattgtagcatttgagctgcctcagtattataaaactagtattgaattcagttaatgatttcctgttttcttagaatgttttacatcagtcttgactcttacaagctttgacattggtatttgaggtctgagttcgtacatatagagaaatagcatgaatattttattaggagatgtttcaaagactgtattacaatggttaaaggaaagtccaaaacctctttaaggaacactgcaagttgagactctgctgttttaataggtaggtgaccttgcctgagtcagtctttttgaatttcaattttctaatctttaaaatgaggtttttggtgatccctcagtttcctttcagctctggaatttggtgggtaagttaccttgaatgtgtatcttttcttgttaaaattttaaaaaacaatatagaaggaaacaaatcctttttactcctattttttagaaataacccctaaacctggtaatattttgacgtgtttttttcaaacttgtctgtgcattttttaaaggagcttctgtcgtatatagttatgccctgcttttgtgtgcatgttaagcatttggtatgttattttaaagtggaatgccttgaagaatgaatcagtcagacctactgttaacattttgatgtatttcagactgacttacaattttttggtatttgatattatgtataattatatcctgcatttacttagcatattaaggatttttttatatgtaattttaaagtggaatgccttgaagaatgaatcagaaccacagctgcacaaggttgtacccttgggaagtagtatagtgatgtccgtcgaaaaactaatctggtccctgttcaccaaacctgtcggactgcgtgcccaaggaagatttttttttttttccatctgctgtcatttttgagtctcattaagagttcatcagtcttgagcatatcttactctttgtttttttgttttgttttgtgttttgaaacggagcctcactctgtcacccaggctggaatgcagtggcacgatcttgtctcactgcaatctccgcctcccgaattcaggcgattctcctgcttcaggcttcctagtggctgggattataggtgcacgccaccacggctggctaatttttgtatttttagtagagatggggttttgccgtcttggccaggctggtctcgaactcctgacctcaggtgacacgcccgccttggcctcccaaagtgctggggctggggttacaaatgtgagccaccattcccggcttgacccacttattcttagaatttattgtgaagataggtgcagagattgagcaatatgtttattatagcagtgtgattttataatataaaatttgacatggaaaatggcccaacaataggtttagctattcagtgaaatagtgtgtaggtgttaagtaattgttgacataaaaagatactcattttaatttaaagaggtctacttttgagtaagtttgtatcatatacattgaaattgcatagttatatatgtatatatacaaataagtgggctgaaaacagtagatttagttggtgagattgtggattagtttactttgataggatatgttattgtcaaaaaattttaacagctttattaaaatataattcatttctccaaaaagaaaccatgtattcattagcatttactttccatttctacccaatcttctttcccaccttggtctaggtggtagctaacctactttcttcctattctgggcacttcatataaatggaatcagccgggcgcggtggctcacgcctgtaatcccagcactttgggaggccgaggtgggcggatcacgaggtcaggagttcgagaccagcctggacaacatggtgaaaccccatctctactaaaaatataaaaagtagccaggcgtggttgcacatgcctgtaattccagctacttgggaggctaaggcaggagaattgtttgaacttgggaagcagaggatgttgcagtgagccaagatagcaccattgcactccagcctgagtgacagagcaagactctgtctcaaaaaaaaaaaaaaaaggaatcatagaacgtgtggtcttcagtggctggcttttctcacttaggatgatgtttttcaagattcatccatgctctagcctggatgtgatagtacattactactctactttttattgtcacatattccattatattgatttaccatatttattcatcacttgatagacatttgagttatttttacttttggcttttatgaataatgctgtgaacatttgtgtccaagtttttttgtgaacataagttttcatttctctaggagaaaattcctgggtcagatgtaatttcacgtttaacgttttgagaaaactctcagacttgccaaatcagctgcaccgtttaacattcccaccagcaattgtaggagggttccaatttctccacatccttgccaacacttgttattatttgttattttttggccgtctgagtgggagtgacggtagtatattgtgatttttgatttacatttcctggataacttaatgatgttgaattatgtgaactaaaaaaaagtgtgcgaatttaaaaatcttctgtacttaacatgaatttacatttgtaaaagtcttttcagttggaagaacatagttatttaatttttggtatattaagatacgtgaatttatgtatgacatcagttgaaccattatggttaataatgaaaggtacaacttgtaaatctgaatctgggagtaggagcaaggggtgaatttttttaaaaacctacttagcaaagttaagaataaaaaacaattgtagtgaaaaggtacacgtaaaatgaggtggtgtgaataaaactaaatgtaaacattacattttatgaatgaatatagttctgttaagactttctgttttaataaaccactttgctatgtcttattttgtgagacaaagctcaaacaaaacaagagcaagcaatgatacaatgtcacaaagaaagcaggaatggcaatactgctgtctgttaaaagtggaatttaaactcaaagcttgaagagagaagggtatatataggcagtccttagctttacatagttcctgtaggcacaaatttcaattgccatgacttagctaagtaacagtccactaacaacatggttaaaatttcacctaccctgccatattaactaattgtataaactacaacatttgctgctagtctttcaacctacaaattaagatgtaaatgacaggtgcatataatgtcacttttaaagcttcttggtgattggtcaccatgcattggtttctcaaaatcatgcacagtcggatgtatagttggcctctgtctcctaatgatgtccccatgtgacagtttaccaaaataaacaaggaaattggtcaacaaagatgatagtgcagcaaaaatcctaatgctagatgggaaatttgaatttaacataaatggaataatagaataaatagcttaccttgtgaatatagatggtttgcagttggagagacactaattgtccagccagagaaacttagtgaaggcaagcttatcaacataaatgaaaaaggtagttgtaatggaaaatatgaagatatcctattaatagaagtgataccaacaaaaaacattgaggatatttcacatcattgaaagcatgaaggataaaatattggaatgtgatctaaacttaggagtatgacagtttgccaaggcatagaagatagacgcattccatatcataataaatatcactagaagaaggcaagcactgttcaaactattcttgatagattttttttaatacaaagaaatgatacactttaatatcagtgttcctaatgttttaagttacagcatactaagttggtattggttttactatttcatttccttatgcatttacataaccgtcagtaatagactacttaatattctgacaaattttaaaggtcacagaacaatcgtaacttttcccattgattattaagattgccttgcatggtcctttttaagaactgctttttttgaggttaagaaaaatgattcatgtaaaaaaatttatcttttatacagtaactttgtggtagatcagtcttctgtggcttttagacttagagccatatctttaaaaaaaaataaatatttgaggttttaaaacattttcctgtaattatttttgaggtcttttcctactcctgaagttcctggtcaccccaattttgagccctttggggattttaaattgtaaatgagggtgcttaagattcaacttctttagttgtctttttagcttccaaattttatttttgccttgtttggttttaagagtttatacttttaaaataatctctttactgttgtttttctggtttttcaggagggagaatttgtgttgaattgggtttgttctgaccagaaatacgttttcatggaggtttaactcaagtcatttacttggaatttgaaacctgttacataagaggaatgttatactgttagagctaaatgtgttaatttttctaatttgagattatggacaggaattaatgatgtctagtaaaatcttcagtttttgatggaatgagatgatttcagtttaactccaaagtaaatttggtaaattattggtttgccttaatcctagcataataatattactttgaaaatgggatgtgcagttaaaatacatggatacaatgaatgttacagaatttaaataataaagctgacttttatataccctgattttttatatatgtgtgtgtgtgtatttttttttttttttttttttttttttgagatgcagttttgctcttgttgcccaggctggagtgcaatggtgtgatcttggctcaccacaacctccgcctcccgggttcaagcgattctattgcctcagcctcccaagtagctgggattacaggtgtgtgccaccacgcctggctaattttgtatttttagtagagacggcattttgccacattggccaggctggtttcaaacgcctgacctcaggtgatctgccctgctaggcctcccaagtgctgggattataggcatgagccaccacgcccagccatatttaaatagaactcttaagtcttttaattgaaattttattttagagcctttttaaaattctaactagaatattaactgtactcattagttccctaattcttaaagaattttagcagatcaggaatttatgatatgtatctaatgatagtaataattttaaaatttagtacattttagaggaaataagtatcagttccattttcctgttgctttggggagtatatgtatatcagctgtcatagtaaaattatcaacatacttacgtctagctttatagaactgacagacttatatgactcactgatgtggggaggagatgtacagggtccatcctggataatgtatctaaatatatatgtacagatggtccctgacctactgatatggtttggctctgtgtccccacccaaattacacctcgaattgtaataatccccacacatcaagggcaggaccaggtagaggtaattgaatgattggggcaatttcccaaatgctgttatggtgatagtgagtctcatgagatctgatggtttcataagtgtctggcatttcccctgcttgcgctcattccctctcctgggtccctgtgaagaggtaccttctgccgtgattgtaagtttcctgaggcctccccagccatgcggaactttgagtcaattaaacctcttttctttataaactatccagtcttgggtatttcctcatagcagtgtgagaactgactaatatggtaaattggtaccagaaagtggggtgatgctgtaaagatacctgaaaacgtggaagcgactttggaactgggtaacaggcagaggttggaacagtttggagggctcacaagaagacaggaaaatgtgggaaagttgagaacttctagagacttgttgaatggctttgacccaaatgctgataatgatatggccaatgaactccaggctgaggtggtctcagatggagatgaggagcgtgttgggaactggagtaaagatcactcttgctctgctctagcagggagactggtggctttttgcccctgccctagagatctgtggaactctgaacttgagagagatgatttagggtatctggcagaagaaatttctaagcagcaaggcatttaggaagtgacagagcataaaaggaaaatttgcagcccgatgatgcagtagaaaagaaaaacccattttctagggagaaattcaagcaggctgccaaacactaatcaccaagacaatggggaaaacacctccaaggcataccagtgaccttcctggcagcccctctcatcataggacgagaggcctaggagggaaaaatggtttcctggcctgggtcccgggccttcctgctgcgtgcagcgttgggacttggtgccctgtgtcccagctgctccagtcttggctaaaagggaccaaggtatagctgaggctgttgtttcagagggtgcaagccccaagccttggcagcttccacatggtgttgggtctgcggatgtgcagaagacaagaattgaggtttgggaaactctgcctagatttcagaagacatgtggaaatgcctggatgtccaggtagaagtctgctgcagggacgaagacttcgtggagaacctgtgctaggactgtgtggaagggaaatgtggggttgcatccccgacaccgagtccgcactggggcactggctgtgagaagaaggccaccatcctccagaccccagaatggtagatccaccgacagcttgcaccatgcacctggaaaagctgcagacattcaacaccagcctgaggcgggttgtgtaccatgcaaaaccataggggcagagctttttaaggctgtgggagctcacctcttgcatttgcatgatctgaatttgagacatgcagtcaaaggagatcattttggaacttgactgcccctattagatttcagacttggcatggggcctgtagcccctttgttttagtcagtttctcccatttgggatgggtgtatttagccaatgcctgtccccccattgtatctaggaagtaacttaacttgcttttgattttacaggctcctaggtggaagagacttgccttgcctcagatgagactttggacttggacttttgagttaatgctggaatgagttaagactttgggggatggggactgttggaagggcatggttgtgttttgaaatgtgaggacatgagatttgagagagggggcagggacagaatgatatggtttggctctgtgtcccctcacaaatctcaccttgaattctaataatccccaggtgttaagggcggaaccaggtggaggtaattgaatgatggaggtggtttcccccatgttgttcttgtgatagtgagtttcatgagacctgatggtttcataagcgtctggcattttccctgcttgcatgcattctctcctgtggccctgtgaagaggtgccttctgccatgattgtaagtttcttggggcctccccagccgtgtggaactgtgagtcaattaaacttcttttctttataaattacccagtctctggtatttcttcatagcagcgtgagaatggactaacacacctatagtggttcaacttagattttttgactttagagtgggtttttcatggttacttaaatggatttctgacttcagatattttagatttacagtggacttattgggacataacctcctagtaaattaagaactatctgtgtatatatgtacacacatatgcaaacagttgaggctcgttatttgtggattccatatttgcgaatgtacctactcaccaaaattatttgtaagcccagatcagtagtacttgttgtacaggtcattcacaaacatgcactgagtagtggaaagacttgagtctcctgatacaacacattcttagctgaggttgtacaagggaatgcttgccttcttttttcagcactcatactgtaagcaagtatcttttttgcagtctgtttattgccatgcatttttttgcttttgttggtcattttgctatttaaactagctcccaagcataatgctaaagtgttctttcatgttgctaagtgcgagaaggttataatgtgctttacagagaaagcgcatgttacatacgctgttggctatgagttcagtgttaatgagttagcagtctgtattaaataaggtgtctttaaacagaaacacacataaaatgaatttatgtattgattggttcatgaaaaccttgtgattacaggaacctaaccctgtatttcccctaggagcaatggttgtgtatttgctaattcagttttcacagtgactttatagaacattactaccacagatagcaaaaattgatagtacatatatgaatgaatgggttataatatgtctgattccctcattcagtaaaataaaattcttaacatactcactgattattttaaaaacacgatagttttgtgagttgtataatatacgaagttattttgaagtgaaactatatttggggtgcagttaaatgtgttgattaatgctaatgtgtcaaagtttgtagtttaaaaaaacccaaatttattgaattaacctttttttttttttttttttttttgagacagagtctcactctgtcacccaggctggagtgcagtggcgtgatcacagctcactgcaacctccgcctcccgggttcaagcgattctcctgcctcatcctctcaagtagctgggactacaggtgcacgccaccacgcccggctaatttttgtatttttagtagagatggggtttcaccatgttggccaggctggtctcaaactcctgacctcaagtgatccacccgcctcagcttcccaaagtggtgagattacaggcgtaaggcaccacgcatggcgatgtaaccatttttaagtgtatagttcagcagtgttaagtacattcacattgtgcaacgtctgtggttttacttaataggattatggatttaaatagtagcttgttactgaatttaataaaagtatttggaattattaattgccctttaacttatttaagatttgtaatgcagtttaggttctgtatttttgataattgtgtaatagggtgtcttatctaataaattatgtatttgagcttgctttgcactcacatcttccccacttcttttttagtgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggtaagtcatattacataaaatttgatattacttatttaatcctggggaataatcactatcctagctgtaggaaagtaaatactaaaagccttgggaatttcatactagtttgttgtgttcttatttgtgaggttgaaccttgggcattttatatcaaaatgaattgacaaaatcattattttatgtagttaaacagatctcaagaaactgggaactattcagttatttaactcctgatagagggtttaatacgtcattgaatataaagctgtatgtactgttctaaatttaggttttgcgacttacatggtgtatgcctaagttttcttattctctttaattaattaattaaatttcttttttttttttttttttttgaggtgtagtttcgctcttgttgcccaggctggagtgcaatggtgcaatcttggctcactgcaacttatgcctcccgggttcaagtgattgtcctgcctcagcctcccaagtagctgggttacaggtgcccgccaccacgcctggctaactttttgtatttttactagagacagggttttgtcatgttggccagactgatctcaaactcctgacttcaggtgatccacccacctcagcctcccaaaatgctgggattacagatgagagccattgcgcgcagcctttaatttctaaatccatagaattgtattggaatatgaacctcatgagttaaattggtatgtgacaaatgtacttacagcactatgcaaattatatttattggtgtcagcagccaccttataccttcttttctgtggtttttcccatgggtccagagcttttattaatttatatgtgatagtaaattttcatggagtggtttgcctttatccaatttgtattgtttttatcctacagaaaacactggttctcttacttctcctttgtgttggtattgatgtgatttagaaaaaatttattttttttgagaggagtctcgctctgtcgcccaggctggggtgcattggctctatcttggctcactgtaagctccgcctcctgggttcacaccattctcctgcctcagccttccgagtagctgggactacaggtgcccgccaccacgcccagctaattttttgtatttttagtagagacggggtttcaccgtgttagccaggatggtctcgatctcctgaccttgtgatccgcccgcctcggccccccagagtgttgggattacaggcctgagccactgtgtccagcctaattttttgtatttttagtagagacggggtttcaccttgttagccaggatggtctcaatcttctgaccttgtgatctgcccacctcggcttcccaaagtgctgggattataggcttagaaaaattttttatattgtcgattgcactcttgaattgttgcatatattcccaaatgaatgttccagaactcttacgatttaaaataaacagatggctttataataggatcagagggctatgagaggtctttatgaagataattgggacagtttctctttcatcaataaacgtcctctgtttaagacctgaggtccaaaaactaggaagagcacgagtaaatctaaagaagcgaggtagcaacaaagtggaaattctgcagctttttactcttttttttgttgttgttgttgagatggagtctcactctgtcaccccggctggagtgcagtggcgtgatctcggctcactgaagcctctgccccccaggtcaagcaattctcctgcctcagcctcctgagtagctgggattacgtgtgcgctttgccaccgtgcctgggtaatttttgtatttttagtagagatggggtttcaccatcttggccaggccagtcttgaactcctgacctcgtgatccacccacctcagcctcccaaagtgctgggattacaggcataagtcactgtgcccggcctagctttttactcttaaaccgataaattttatttcttcacatgtgccatgctttaccttggagaactttttagatactgttctatctggaacatataaatctttcattgctgctccaaggccacattaaatgattagtgactttattacttcccagtacttacttgttaatggattcatcgaaccatatcataattgtttctgtacttgtctgtacctgctacagaatattatgttgcctctgtgaacaaaggtttatgtcctgtgtgcccagcatgtacacgtgtgagaagaatagctaatcactaaatatttgttgaatggctacatggtttcttatcattattgccttgactgtgtgatgggaagacatctgtctaaagagacagaattgattgttatctgaaacttaacgtcttgtaatttcttttttgttgttgtttttttggagacagcatcttgctctgtcgcccaggttggagtgcagtggtgcaattttgatcttgtctcgctgcaacctctgcctcctgggttttaagttatactcgtgcctcagcctcccgagtagctgggattacaggcgcgtgccaccatgcctggctaatttttgtatttttggtagagatggggtttcaccatattagccaggctggtcttgaacgcccgacttcaagtgatctgcctgcctcagcctcccaaagtgctgggattacaggtgtgagccacagtgcccaactacgttttgtaatttctcttggatcatttgtcctgtgattgcacctttatggtcttttttatcctccaaattgccaagccttgtcaccatataatcttggagttttttttaatttttattatttgagactgcgttgcccaggctggggtacagtggtgcaatcatggttcactacagcctcgacctcctgggctcaggctgaggagggaggatgccttgagcccaggaattgaggcttcagtgaaccataattgcgccactgcctccagcctgggtgatagagtgagaccctgtctctaaaaaaaaaataaaaataaagaattgtatatattattgggataaaaacttattttatgaaattaatagagttgattgctcacaggcagcaactaaacaatcaaatgcatcatctgatgttgaagttgaagaaaaggaaactagtgtttcaaaggaagataccgaccatgaagaaaaagccagcaatgaggtatgttctatttctcctaacattttaaacccattttgtttcaaggaagaaataatgaaatgagttggccatgattaattagtaagtaatttttaaagtacttgaaaagtgaattagaaaatatttaaggcttatttccttgtgtaaatattaaatacagtattgtcaaacaacttatgcatctttaagatgcatacctgttattatttgaagttatttttatatgtaaaacatgaagtccaactgtagggtgcggtagtgttaaggattttttttaaagagaagtgttgtaggatggatgtactggaaacagcattagactaaattttttaaaacctaggttgatgtccaactgtatatgatctgtgtgtaaagatgactcatttagcccttccaggcctaatgaaatggttgttagatgatcttcaatgtcccagccaccctttaaaattcacaattcaaatttatccacccttataattcagaattctagtgtagaaaaagtagttttataaatttaaatagacagacttcctggtgtaccagcaaccatgacttacatttgatctgacagtggaaatgcatttttctcactttataatgttgagacacaatgtttttaatttcagaactctacagagcaaaacagatttccccaatgctttcagttaaacgtgcttgtaacttttagtttaacaaggtttctttcattcctggaataatttattcagtattcagttttcttttttcttttttaggatgtgactaaagcagttgacataactactccaaaagctgccagaagggggagaaagagaaaggtaatttcactgacttaccaaccatggggatctgaaaagaatttttattttaattgggttgagggagagtagatacaatgaaaccttaaatttcagcttttattctaaaccctttaattttttatgggttatgttttacttggcaaaactatctgtgtttctttcttagtgatatagcacccttaaagtaacttgagtggtaaaggaaataaaatacaccagttttcattcattttaatgactgtgcctcagttttctctaaattgggtagaaatatatactccaaggttgtggaggattaaatgatttaacatatgtgaaatgtttatgctaaatcctgatacctaaacactagtaagtgttatataagtgttgtccattatgttgttgttgttgttacttcacgttgtgagaaatgagtgtgagtgacagtgcaaggttaggtacatagtaggcttttaattaatatgaaattttccttccatatacgaagttttgttcacacccttttctgacctatttatgtctcaaattattatcatataccaaagatgcaaagaaaaccaaaagttcagtatctcatgaggaggtaaactatgaaaataaataattacagtggcttatttgttgtgcagtatgggttggaagtggtgtgataacaagattttaaaatacaggcagaattttgtcaggcggatgaaggagcagggaaggacacatgaagccatttcacatagaggaaattcctactcaagcatcttgagtattgtatttcattattaacacaccataaagtctgagggaaatgggtaccaaaaaaacctgatgttgtcctaaagaccttggaacttacagaagtgatgggaaatgattgaattattttaaattttagatacctccttttaaaaaatttttttaagagatggggtctcatgctgtcacataggctagagtagtgcagtggcacaatcatgcctcactgcaacctgaaacttgtgggctcaagggattttcccatcttaccctccctaatagctgggactgtagaagtgtgccaccatacccggctaattttttttttttttttttttttgagacggatctcgctctgtcatccaggttggtgtgaagtggtgcgatcttggctcactgcaacctccacctcccgaattcaaacaattctcttgcctcggcctcccaagtagctgggattacaggcatgcaccaccatgcccagctaatttttgtatttttttgttttgtttttgtttttgttttgagacggattctcacactgttgccccagctgaagtgcagtggcgccatctcggctcactgcaaccttcacctcccaggttcacgtgattctcctgcctcagccccccgattagctgggattacgggtgcacaccaccatgcacacctaatttttttgtatttttaggagagatgaggttttaccatgttggccaggctggtcttgaactcctggcctcaagtgatccacccacctcggcctcccaaagtgctggtgtgagccaccacgcccagctaatttttgtatttttagtagagatggggtctcaccatgttggccaggcttatctcgaactcctgacctcaggtgatctgcccatctcagcctcctgaagctctgggattacaggtgtgagccaccgggcctggcctatatatatatatttttttttttgatagacatggggttttgctatgttgcctaggctgatctctaactcccagcctcggtgatcctcccaaagcactaggattgcagatgtgagcctctgtacacaacttgatgcctcttttttctttttttttttaaatataaatttgtttttttttttttttggatacagagtttcattctgtcacccagactggagtgcagtggcatgatcttagctcactgcaacctccacctcccgggttcaagcgattctcctgcctcactcagcctcctgagtagctgggattacagacgtgcaccaccacgcctggctaatttttgtatttttagtagagatggggtttcaccatggtggccaggctggtctcaaactcctggcctcaagtgatctgctcacctctgcctcccaaagtgctgggattacaggcatccgccaccatacccagctaattttttgtatatttagtaaagacagggtttcactatgttggtcagccaggtcttgaactcctcaccttgtgatccgccttccttagcctcccaaagaatgcgtcatttttttaaagcagtgtgaacgatggggattggattggggcagtgagaccagttcactgtaaaattcattcagaattttagtactaactttactggacttggcatggatttgagtagtcagtaaagaagacaaggtctttgtttccattgaacttacatttttttttagacaaaaaataaatatttaaaataagagggtttaaatggggagttaatgagttggcaacagactaggctacaaaaggcctttctaaggagttggcatgagactggaaggacaaggatcttatagattttttaagtggtgtagacgagagatgggatttaagagcactttaagaggttaagttgatggttgatgagaagtggatggtaaagggggcgggggagggaactagaatctaaggtggctctaaggtctttacttgaataagctagttattgggagtgcagaggatgttggtttggaatcataggcatgagtaaggggaaggtgaagcacctgtgggaactggagtgaagagacatatatattgttctggcaccaaagagggagaagatgtaagttacagatgcagtctctggcatgaagatagggtaatagatgaggtcaaaggagaacggtttattgagaggatgcagaaaccagaatcctgaaggaatataatggagagggggaaaggttgctctgtgaaattatggctgagaatgaactgtcaagagaaaatctaagagggtatcaagctaaacaagggaagggggaatgtccagaatgaagaagtggtcagtaatgtcctgatttagagagggtaccagtaagatacttgccacataggctgctctaggatactttcaggtgaactccatttagttgaatggtaaggacagaaactagattaaggggttagagaataaatgttaatggtaaagttacactgtgctttttaaatctttgaaggcaaggagaatgtggcaacataatagggattttcatagctaagggaaagtgttaaaatgacaaaagacagtaaatgccttaacactttttctctgcaaaattaggaaagatcaaagatgtggagtcagtataaattattttatgtaaatacatgttggatgagagaatggaggggacatttgaaggaactgacttaacaaggaggagatggatgtttcagtctcttaacactgaaggggagggatggaggaggctctgaaaatttcttgggacactaggaaattaagggaattcctttctacagcccttactcccttctgccccatccacatcaaagcaagactttggatgtggtacaagtcgggaagaatagattgagtaaattatgcagctgttggtgggaggaggaggcctgatcagatagggtaaagtgactttgagatctcaactgagattgcataaaatgaatgcatgtttgtacattttttttttcccagcaggcttcagcagctgggaataatagaacagagaaggtagaattgtatagtaacctctcttgaggatttgtgggacagatacagcaaaacaaggatgtggaggacttatgaatacatttgaatagtaatcccatgaggtttttgtgtgtgtgtgaagtggtgtgtttttagttaagatcaaggaagctggtagagctagaaaggggtaaaaaatgaagagaaaatgagggttagatgtctcagagcaagtaaaatatggaagaaataaatctgtagtcagtagtttaagatattagcatttaagatgtttaaatatttaagcatatcctaagagtggaaaagttttaaatatatatgtttcgtataacttcattggtcctttctttagataaaatatttattattctttgattttattttcatgaggaatggttctgacttgcatgattttgccataatagtcatgaacacacgtgcatggtagggctgatctcttagtattagtgttaatatagttttaattattattgatgaacttgttacacttattggtacctccttaaaaaccatctcttttacctataattctttgttttttttgagacggagtcttgctctgttgcccaggctggagtgtggtagcaggatgtcagctcactgcaatctctgcctcctgggttcaagtgattctcctgccttagcctcttgagtggctgggattacaggtgcctgacttatttttgtatttttaatagagatggggtttcaccatgttggccaggctggtctcgaactcctgacctcgtgatctgctagccccagcctcccaaagcgctgagtgggaattacaggcatgggccactgcacccaaccctacctataattcttattcagtgttttgatttatttccaaaagcagaaagtgtaagtggagagagtcttctttgcaccaaagaattgaccagttataactgaattttagacaaattatgccctcttaactcctcagtaggaaaagagctctcagtcttgagttcttaagctttgttacctggggagctttataaaaacacagaatcctggttccctgactcagagctattgaatcaggattggggcagggcaactttgtaagttcttaaaattctagaaataaaacctgagctaataatgttcagggaggaattttcagtgttctctgagaacaactcaagggttaccttagatgagttttaataatacttttaatatgcttcattatgtttcagttatttaaagaaatgtttaaaaaactaataaagaaatggatacattcgtagaagtggaattgccatataaaggttttttgttttgttttgtttttttgagacagtcttgctctgtcgcccaggctggaatgcagtggcatgaatttcagttcactgcaacctctgccccctgagttccagcaattctcctgcctcagtttcctatgtagctgggattataggtgtgcgccacaagcctggctaatcttttgtttttagtagagaaagggtttcatcgtgttggccaggctggtcatgaacttctaacctcaagtgatccactcaccttggcctcccaaaatgctgggattacaggcgtgagccactgtgtccagccctatatagagatttgcacattctatattgccaatactcattcataattatgtgctttcataaagtatcagtttattgataccagcttattgatcattggtagtcaatgtatgaatgattctccacatgcttatcaacactgggcattatgtttacaaatcattgatgaaaaggcaatttttaatttttttaatcaatgagattggattatgcatgtttttgaatgccttcttgtttttatctttagtgatacagttaatgctgaattctaaatagttgggggagttggggaaggagcccatctcctcctttggtctttctctttcctccttttgcagttatgatcagtaccaactgctgcctcatgtttacattttgtttctaatttgtgttcttaacctttgttccattctaatgcttaaatcaataatactgattctcatttggggccattctctccaggagaatcatactagcagttatcaaagggcattagagtttgcaaatggtcagtggattccttactctctgttgtagtaaatcctttcttacgggaaataagaataactcctaaaggagaactgttaggtaacagtctcagtttagaaataaaatgtgtctgtatgaacgaagaattagaaataacattgtgttagttgcagtgtaatcacatactttgttctccatatcgcatcaagaatattagctttatttttacaaatgacttcatttctaagaaatttttagttttttttaagagttgttcactagagttataaactaagtttgaagatgttactcttgagttgattgttgaaaaaacaaaagatcatatagaggttatatctatacttgaactcaacgttaccatagactggcatatttttgccatcgaattaaactttgagtgcctactatttgctaaataagttaattaaatttttgtaattcaggcagaaaaacaagtagaaactgaggaggcaggagtagtgacaacagcaacagcatctgttaatctaaaagtgagtcctaaaagaggacgacctgcaggtaggattactgatgtttaaatatctgtttggcttgtgattaatattccagtccatttaaagtgttgctgcctcaaatattttggaatgaagcaaataggcaattgattatgtgtaacatacagatttcaaaggagataaacatgatttgtgctctgtttcaaagtatttaaatttgaaataaactttgctttatctctgttatgttttccctaaatagtggtaagagaggctgtggggaggttaaaattatcatgaataatgggtttattttacctttcacttaagagtcgtaagatttcaaaatggagttataatcagagaatgagaaatagcatttgattaaagtcattaatattttaaatttgtgcgttctttattgatagggattttgatttttacagtttgcagctctcttcagcattgcctatttaaaagtattttcttaatttggcaaattggaaatattttggaaaaatcttcgtaaaacaaaaccaaaattgagtgaattttttttctactttttaataggattcttactgaaaatggggggtaagatgagtaatacccagaaaagaaaaaagatttttatttatatattttggagtttaatattgcagtggataaaattaatagtgctagggaaactcagtgaattttgatatgaacttccaaagatatgtaactgcataagtaatataatatgtatatgaatattaaatataagtgctgtttcctattctaaaagttgaattttgtgacattactgttaaaacgatagtgaaaaatgttttaagccctctcagtcataataaggacaaattgaggattactctgtttacctctttataaattttttgttgttgctcattttaaccatggtgggggaggtattattttttcaatttagcaataattgtatctgtaataagctactaatattcttaaatagtatgtatcatttctaatatttatatctgagatttgtatcttaaatagaaactagtagttactgattttttttccatgtgtatattagctacagaagtcaagattccaaaaccaagaggcagacccaaaatggtaaaacagccctgtccttcagagagtgacatgtgagtttatttttaatgtataattatgcaataaatgagacatttgactttaaacaagcacatatctctgcgattttatcagttttctcttacaggatgtttgttattattttgatctttcttaaaattacaggaaaaactgggaaaattttgtaaagtaaaaattggtaaggaatggctatttatcatttcattaattaagactcttgggtatatcaatttatatagatacttagataatacaacataaaatatataatagagaaattgggcaagatggtatgtttcaggaattttagaatatatttgaagtaatgtcacaaatttttttttttttttttttttttttaaagatggggtttcactctgtcgcccaggctggagtgcagtgctgcaatcgcacactgtaacctcaaactcctgggctcaaggagcctcttcccactttagcctcccaagtagctgggaccacaggtgtgtgccaccacacctggctaactttttttgatgagactggtctcatcgttcccaggctggtctcaaactcctgggctcaaacgattctcccacctcatccttccatagtgctggaattataggggtgagccacgtgcctagcctacaaatcttttttttatctcctctagaataggtgctttatttaaaaatagggctaaaataatttttgtatgtaaatttaatttttaaagcatttcagaataactattcagttatccaggaaattgtgcgtgttttttggttttttgcatttttcccttgctgccttttctacttggatcctttttactttggcttttttggggaatctttgccagaaggaatagagagtatatttagacaaagggggagaaaaactttttgtggctattgtgtttgaagatttgaaaggcttaagtggggtatgtctattaagcatagatttacattgttttgaatgaactgattatagaaaattctaattgtagaacactattagagaattggtatgtttcaaccaaaatatgtttaaagagtttcactgccagtctgtatttactttcaaaaatagtggcacataacaatatatcatatacttgaaaattactaagagagtagactttaagggttctcaccacaaaataaaaatatgtatgtgaggtggtatggtaaatagcttgatttagccattccacagtgtatacgtacatcaaaacattgtgttgcacaccataaacacatagaatttttacctgtcaatttttaaaaatagtggcagaaaaatacaacatactttaactattatagtgaaattaagaaattggatacttaacaggtgagttggcagtcattattccctaggaaatctgaaattctgctgggaaaatactgtgagatccctctgttttggatataattagtgttccctaattaggtcccagttttcccccggagtatgcttcccactccgtttgtcttcttggcttttggctgattcctctggaacttctctactttttcagtatcatcctttgttgcatctgaaaaggtcattggaaaatactgccctcctcatcagctgagcagctttctcagcctactttcggaccatagtgatctgagggcccagtgtacctttttaggaacttatcctcatctcacttactttcttttgatggagtctggtgtcacttttggtaatgtaatacttttgtatgtgtgtttaattctggtcagcttcctatgcaattattgttaagacttttctcagacatgctcgtctttttatatttaataacagatactttgagtttataggtttttgtgagaaaccatccctcaggaatcatttgtccatctgaaggattaatgaagtccaattttaattcttaaggattgcagctataccctttattgggtctttgacccaggctatcacccaatttgaaagtcctacatcctcacttgaaaataggctaatcttttttgaacacatctttcttgaacactatcaaattcaccttgatagtcatttcacgctaccagtattctattttgaaacttcttcacccaaagccacaagttgattgaatatattttcttatttctgctgcggtccaacagttttacccattgtataataacgtattagggtttccagtctcccagccctaaagcaagtgactacatgttttaggtttttggtcctggtgtcagtttctctattagtgagctttttcctgaggcaatggacaaccctaaaatagcagtagcctttacaacgtttatttcttattcatgctgtgcgtaggctgagtgtgagctgtaactactcttggctgtgtatctgggcacacactcagtggagtgcagaactaaactgtataagctctttttaaacttctgctcttcaccgttagaacaccatgtatctcttagcgtctacttctttgtcacgggtactgatgtgacacaacagtagaatagagcccagaagagctaaaaaccaactcataatcctcagaaatgtttgttaaagcccactgaagctcttagggttgtgtttgcattagtctttgcttatattaacatatattaaaagattaagaaatttacaaatacaactttgctaatatcccttacctgctaaaaagggaagttgtcacaagtctgtatttcatggaagaaccactgggaaaagactcattggtagcaagcagtgatagtcatgtttatgtaaattgttttggcacaaagattatttcacaccttgaaataatcttttttatgaccttaggataaatttttaaaataaatccctaaagtcactttttaaagaccagctgcatggtatcccactgtatgttttataattcttaagatctatcctatgtatggatagacgattttaaaaacattgtcatctattcttttgtacataatgcaaatatattggttaggatacattgttagaagcagatttgctgggtcaaatggtatttgtatttttaatagctatttccttccatacaggtgtaacattttgggagaagtagttggccagtattgtttaagagacacagaaatgtctttttaaatgggactctagtcccatttttaggaaactgattatcaaaatatttacatcagtggaaatcctgaagaaagcaaatagtttcacttgcatgcttttactttcatttattaaaagtaaaggatggttttaatcccagagaggctaaagttaaaaggataaaaaccataggaccattagaaaataagcatacccaatgataattatataataaaaagtttctaaaggggcaaaagtaaatttcttctcttccaacttaatagttcttaagtggtcagggaatcacttgtctggaaagaggttaatggatttggaattgagatgttgggcttgttatttgaccttttgcatcatcattttctcatttgtcaaatggaaggggttgaactgaatgataggaagtctcttcaagctctcaaattcattgatttaattgaataatttgcgaaaatctcaatgaaattctttggacagttaaaaggttacagtttttaaacggcttattccagcttcaaatgaagtatttatttgtaaaagaattgctttagaagaatatatatcaaccataaaagtaattacgtggttagtatttgcattatttgattctcctagagcctatttctgtagtaccaacttgcataaatatgcagcagtaattaggattattgagcagtttaggtagtttctcttgttttagtggtgtctgtgaaattcagtggtgatgggaatacttaggtgctagtcagcacagcactgtctgaaaacatgcttaattggctatatatttatcatatgcttaagttgggacctttttaccctgcaaagaatatttgagttctaaaacgaccgtatttgatttcacttccgcaattccatttgtcccagtgtgtctactttttaaacataatttattcttacaaatatgtagaatttaagttccataagagccagggatctgcccatcttctatcttctaatttataccaaaaggatgttctgtgacagaattccttttatgattggatagtgaagacactctttttactttgttttagatttgcctttaaattaaaaattatagcttactgatatctaaaatactattatagttgaatgacaagtatacattgttatgttctctaaaatagcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaaggtataaagtttacatatataaaatggctgttctattcttagtttatatatatattttttgttttttctttgttttttttttgttttttttttgttttttttttgtttgagatggagtctcgctgtgttgcttaggctggagtgcagtggcacaatcttggttcactgcaacctctgcctcctggattcaagtaattctccagccttagcctcctgagtagctggaagtacaggcatgtgccaccactaccggctaatttttgtatttttagtggagacaaggttttgcaatcttggtcaggctggtcttgaactcctgatctcaggtgaacctcccaccttggcctcccaaagtgccgggattacaggcaccacacctggccatttatgtatttcttaatctgcccagtttaagagcttttaatattttggaggaagtctataaatatcagtggcagttaaaatgaatttgtttacctttttgaatagacttgaattagctgtgttacaaagcatattgaaaacgtccctttattatctgttctctaaattcatctattttacaattatgatctggaaattaagtaaacagtacctttccaataaccccatctgtctagaaaaggtagatgaaataggctgtggccagtgaagacaaatgttaaaagaggtggatttatatagagatttttgttatttacccccaagaagttcttaacacccttcaggcctattgtacattttatcagtggtatgtaaatttatttggacgccatagttgttgggaacctcattaaagctgtgtatccttttgtgtagaaaaataaaattttgtgtatagccttagagatttacagattcaggtcatgcaaatcttttgtttactttcatctgatttttggctcatttcttaatcttttagaaaccaaacattttaaattggataggtcatgtagtgtgcttgtcagtactcaagtcaaatcactctgtagagaggcaaacagactgacatactatattttatccaaaggacatcactcctatagcagggcataaaacaagatgattatttcacggtcattaatcaaagttaaacttgcagagataggtgtaattcaaagactatttttaggttgctaatttgagtattcatcccttttttaaaaactagctgctgcttttcccccaagattataattccataagcactagtcactgactttatagttaaataaaaccatcctaattctcaaaacagaagagaaaaggtgggaggaactttcagactgctcacagaaggaatatgctgaaaggccaacatgagaaagaagcagcagatcgaaaacgcaagcaagaggaacaaatggaaactgagcagtaagtatttttttttttctaaattttgggttctttttaaaggctagcatggaatttttaaataatagactttcattttccagactttatgaagccttttgaagaagtgacttttcccatgtgttagaaaaatcttcaatatatgatgatgatcttatttcaggcttcattctcttctgagaggatgaaattgactgaggcagtcactctgtgaattacttttgaatttaaacgaagtgcagataggatttaattgatactggctttgcaagaagtgtactcatcctcaaccatttgtttgtataatataatacatatagatagaggggcgataatatactggtagacaaagaatgcaggaaatgcccttattcatcacaccaccaagcaggcctcaccctaaagaccagcaaaagtaacaaaagcacatttggaaacccaggaagccagtaaaagtaaatctaaaggctgacagggtgtacattattatgtatgtgcaatataaatcaaattcaaagctgttttctcttaaattttgatacttatagagacaggacttgccatggggaatttctttccccttactatataattttattactagaaggaaaagtaatagcaatgataataatgaacagacttcgtgtctttattacatttgctttcctagttacctttagactgtcacttctgagttctttctctgacatgcttttcttttctcgtgaagcgtcttacattctgactaaattttgtttttttgttgttgttttagtgaggtgatttttaaaacatgctctaggtcaataagacaaagttaatgatgagcagtaaaacaattcttgaataattttgtactttttttctttatataatatatccgtaagccaaagtctttcttgacaagtacagcgttttactctgctttcttagtttggaggatatacaagtagttttagctccttgagggagtaatttaaataacttatctaaagctcaaaaatattattccctctaatgttagactttaagcacttctgtaaatatttaagttattctttgtcacctatcattttctattctatcttttcactgaaaagctgttggactgtttgttgcttttgactttattgtgatctcaaaattaagatataaaattagttgttactagtatatgtagcccaacccttctttagtatcttaaagttatctttatgtatttcagtttcttttgaatgtcctccaatgtaactttctcaaattctaatatttgtgttttctttccttctcctgttattacaaaactttgtacttggacagttttgctctgtaaagcatttcagatgcagcttgtgtgaaatgcattatgcaaaataaagtttattgtattgtattcccagccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaacctgatttttagatattttttgttcttgtctatttgaattggttcataatatggcctgaactctaagccaaggtactagaaattaagatttcaattttaagtggttatttttgtgattgacaataaaatggtaccttttgtgaaatgttagtgaatgttactggacgtcattcaagtttgatgaattggccaaaattttaaaaacagtgttatcttaagtctatttaactttaaagctaacttcagaactcattaatctgcttgttacatgcacaatgattaaattggtctattttaagatgcagctttaaaaaagaatggatgtagaagccattaaacatttataggtgtcatcttcccattgtggcctgtttgtccagtgaccctgaaattgctcttctagcaacacactatttgtgatgtcactgaaaagccagatatgatttaatctagcatgttaattagagttttgcttatatttatgctacggaactgcaccattctaagagctacagtcagttcctttgcagtctaggctattgacttattttaaggaaaacatttttagcttttacatagggattgtgggcatttagtcacaaaattccaatgtgttgaaatatttttgttaacatttgataggcagaataaagatgaaggaaagaagccagaagttaagaaagtggagaagaagcgaggttagttatttcactttctaagatacataaaattatacatggaaaagaagttatatagacataacttttcatgtattggttttggaataattttatactcatatcctacaaatagaatttttcaaatccctaatgggctttatataaattgcattgtattttaagcataatcaagtgaacttgcttgagttgtttatgtttaatgctcattaattatttgatggtgtcaaattttagtacacttgctgaaagctggatgctttcccatttcagacaaatcccttggttaaacataaggaaaagcaggtgtttggggactggagagcagaggagttatcatatgcagactatttattttaggaaaaacgcagccaagtggtggttttgtgcttttacactgcatgttgcttttctcaaccactaaaaatggcaataagtacttattcttagttaagctattgtgcatatctttgagcttcttagtaaagattactaagaacattttttttttaagtccactaattcattatacttagcctgtatatagaaatactggttttggaaaaactgttcactgtttttcacatattttaatttgtagaaacatcaatggattctcgacttcaaaggatacatgctgagattaaaaattcactcaaaattgataatcttgtaagtgtttaacttcatttaatacttcagtactgcatttatagcttcatcttttattttctcacatgatcttatgagtatgtaaatttaagggataattactggtcattttgcactacctctttttttttggaaacgatctttagaaacagattgtttaagtgttaagataattaacagctatgaaattactgttttgtcatgaaggatgtgaacagatgcattgaggccttggatgaacttgcttcacttcaggtcacaatgcaacaagctcagaaacacacagagatgattactacactgaaaaaagtaagtgatttcaagtcatgtggattctttgaattttgtcattacttcatttaaaaattgtttaaaaaatcaattaggaaaacaattatgatgaatgtatattgttttctcagatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacaggtatgtggtaaaaagccaacaatttcacaccagtttttaaaccatttgccaggactgcttttaaaaatggctttcatacatagtttcactgtgtatacgccacagaaaaagtatacaaaggcaaaatggtgaaaatctgatgggcctgttgaaggactagagcagtgtgcattgagaacaaaaaatcatgtcagtttatattcgacttctgcagaaaccattgctcatgaggcagatgactctggataaacaatttttaaaaacccatccatcacaatgcctcctaatccctagagtacccacttcctggttgctcagctgcttctgttttcttctcacctaaaaagtaaaatagcgtacagtagccttttaaattaaaacacagcctcataggtggagactacacctgccattacttgatacaggtattctgatgatgctgctgagttaccctgaacagacttcacagtattaatgccatgtccttttttttttttttttttaaaagatggagtttcgctcttgttgtccaggctggagtgcagtggcgtgatctcggctcaccacaaccctccaccttctgggttcaagcgattctcctgcctcaacctccagagtagctgggattacaggcatacgccaccacacctagctaattttgtatttttagtaggcacggggtttctccatgttggtcaggctggtcttgaactcccgacctatggtaatccacctgccgtggcttcccaaagtgctgggattacaggcatgagccaccgcgcctggtgataaagtcttacaaagcacttagatgtgtagcatatatgtaaggcactgaaccttagcttctacttttttcactaactttagcagtagttaaatcctgctagtacttattactaacagtagttattttcttttcatttgtattaggaaaaatttataacttatacaaatagaaataacttctcatgtccttgtcatccagctttggcagttcagtttatgatcattgtgcttttgtagcccataagctttctctatgcccctcttgaaagttgttttacgaaaaatccctgacataccatttcactcataaacatttcagaatgtatgaaagactcttaaaacagaatcatagtaccattatcagctcctccagtcttgttattaaacatcttagtggcagctgcttaaggtaaaagctggcatttcaaaagcagtcggttggttttttgtttttgttgctttattggggaatgacatgggtccccttagagaattattaatacgacttacaggaaaaccccctttattaggcacaaaaatatcaattaggaaatactcctttagcactttgttctaaaatagtaaattttaaaatttgattcacattgcttttccgtggtagaataaatgaatatgctaagaattacaacaccctgtagtattcctggtaatagtaacaaccagaataatcagattaataatccacttcctgtactcatagatagttaacctgctttttatggtgccttagctacccaaagcctctggtggtcatctgctcccctttttgacaaagcatcaaaacccaattctaacattcaagagagggctgtattacaatgtaatttcaaataaaagacattaagtagtagaaacacgatggccatgttgtattttgattctggatctttagtggacaccttcaattattgttttgtaagctttaacaaagtttttccattggattccttcgcaagggtcaaagactctaaatggaggatctgatgctcaagatggtaatcagccacaacataacggggagagcaatgaagacagcaaagacaaccatgaagccagcacgaagaaaaagtgaggaataggttttaatgggtcttgtgtgttttttattattcaggtttttaatcacagttctgttccaaggttatcttactataataagcagttatcttttgatcacccaattcctgaattcagtaagcaagttacaattcaaaaaggaagaagagtaaaaaccttttattgacagtgactttgccactgaattcaagggaatggaactagctgggaacccagttaaaaagaaaatatttgctcctggactacttttactgagatactgttagtaatgacttgcattcacactttcttgaattgtgaaaggataattgtaaaaagttagatggagaatcacagttttgttgttgttgttttttctttgagacagagtttcactcttgttgctcaggctggagtgcaatggcacgatcgtgctcactgcaacctccacttcctgggttcaagcgattctcctgcctcagcctcccaagtagctgggattacaggcacctgccaccacgcccatctaattttttgtatttttagtagagatgaggtttcaccatgttggccagcccggcctcgaactcctgacctcaggtgatccacccaccttggcttcccagtgttgggattacagctgtgagccaacatgcccggccatcacaggctattttttaatacccaccctaaaataggctatggagccatagttgaagtcttgctttgttccactgtgtatctgaaggagttagatagaagcatcccttctaattctgaaattgagggaaatcttgttgtctatgtgtgtatcaacctctctttttattaagattttgaaatatgttggtatcacagatataaaacattctcatgttctttaaagagaattcacttttatgctagaaatgatggaaagggcttggtccatgacactttgctgagttattttgcttcatctgcatattactttgggaagaagatacaacatggtaaaataacagttttgaagaagaaaaaaataataatgactgttctaataacaagtcaagtttttcttttgtttggttggtttcagtcttttcatgggtttaaaaatataatgcagacttaatgtctttttttccttcatcaggagaaaatcctaattccagttgtacctttcccccttttcttcaggccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaactctgctagtaaattactttcttgctatttacaagagtaagtgatggaattctgggtttgctgccaaggaaataatttcttagttaactggtcacagaggttgtgctgttttgggaaacggggtaactaaacagtaagctcaagatgataaaaaataaaggtaatatttatcttttgttcaccctccctttcttcccatgacccaccagatctatagttttacaaagaagccacagaatattccaattctagagatagagcatcattctcataatttatgtcagcttgtacaggctgaccttgctctaactagttgatgtatgttcgcttcaagcataattgctgtttctttaatcataactctcaagaaatggtgtcataggctgatttacagataacttctcagaactcttgataattattcataagacttaagaactttcaggatcattgaaattgttcattggctcaatttgtgtgtgtggtcaaaactccacagcttgacaaggcaccaaaaggtaattttgagatagataacccccaccccatcccaccccaccccacccctccaaaaagtacgtgtaatatgtatgttttaacacctcttttgggctggtatgtgtgtgtatgtacgtatgtgttttgattactggataaaagagtcatacatcagccgggcgcagtggcacgtgcctgtaatcccagctcctcgggaggctgaggcaggagaattgcttgaacccgggaggcagaggttgcagtgagctgagattgccccactgcactccagcctgggagacagagcaagactccatctcaaaaaaaaaaaaaaaaaaaaaaaagagtcataccatgaccaagcagaactgaccattgaaggttttcttagctgcttggagaaattgcagatacatctatctgaatctgagaactgactgggatttggtatgtgaacaactggagagaaccatacactttataattaatattatatccagtgatttcaaataatatgatagattttgctgatacagtactgctgtctgtgttcctactcatacacttacctggttacagatgttaggtcaagatgaggtctgcatctaatcctgtataagagcagagatttttcatagggtgctgtgagggctttgctaactctattttgtccgattggccagaaaaaggatgctctaatggaaatagcaaacctgtatcattaaactctttagaaacaaagaaactggtttaataggcagaaatgtgtttatgtttg

SEQ ID NO: 15235 - DNA, 20890 bp, Human
tccatccatgttggtgcaaatgactggatctcattgttttactgcattttgcatatgtaccatattttcttaatccattcatctattgatgaacacttaggttgcttccaaattttagctttgtaaacagtgctgcaataaacataggagtgcagatatctcttcaatatattgatttcctttcttttgggtatatatctagcagtgggattgctggatcatatatgtggctcaatttttagttttttgaggaaactccaaactttgctccatagtggttgtactaatttacattactaccaacgctgtatgagggtttccttttctccacatccttgtcaacatttcttattgcctgaattttggacataagccattttaattggggtaagagggtatctcacaatagttttgatttgtacttctctaatgatcaataatgttgagtatcttttcataagtctgtttgccatttgtatgtcttcttttgataaatgtctgctcaaatattttgcccatttttttattggattattaatttttttctatagaattttttgagcttctcatatattctggatattaatcccttgtcaaatgggtagtttacaaatatcttatcccattctgtgggttgtctcttcacttcattgattgtactctttgctgtgcagaagatttttaactagatgtgatcccatttgttcatttttgctttggctacctgtgcttgtgtggtattgctcaagaaatctttgtcaagaccaatgtcctcaagattttcctcaatgtttcttcattgtagtttcatagtttgaggtctcagatttaaatatttaatcaaatcattttttatttgattgttgtatatggaacgagatagggacctagtttcattcttttgcatatgggtatgtagtttgccagcaccatttattaaaaagactgtcttttccccagtgtatgttcttggtatcttggtgaaaaatgtctttactgtaggtgtgtgattttgtttttgggttctcctgttccattgctctatgtgtctgtttttaggccagtaccatgctgtttttgctactatcactccgtagtataatttgaagtaaagtaatatgattcctccagttttgttatttttgcttaggataactttgcctcttcaaggtttggtgttccatataaattttaggattttctttctgtttctgtgaagaatgtctttggtattttgataggaattgcattgaatctgtagattgctttaggtaatacggactttttaacaatcttgattctcccaatccatgaacatataatatttttccattatttggtgtcttcttcaatttctttcatcaatgttttgtagttatcattatagagacctttcattcattggttaattcctaggtatttaattttatgtgtggctattgtaaatgggattacttttttatttctttttcacatttttcactgttggtatatggaaactttgctgattttggtatgctgattttgtatcctgcaactttactgaatttgtttgtcagctctaatagttttttagaggagtctttaggttttattcaaatataagatcttatcatcagcaaacaaggataatttgacttcttcatttccaatttggatgctctttataccttctcttgcctggttgctctagcaaggtaatatgttgaataacagttgaataacagaataaaaaaaaatctctgcaaagtaaacaaatctcactagtttatctgacttgtattccaaattagtgcttctggccttttcttaaaactttaagcatcacaaggaaatcagttggaagggaatcatgtgctgatcaagtccttaaagggcagaaatattcactgaagtgaaaaggattagtaaagggtggaaaaaaagaccagccccccgcctagtttgggtgagcagatttgggattaattatcaggcagcaatccacatgcacttaacagttctgacgtgagaggacaagaaacacaagcaaatataaaacattcaattctaagagaagttcatcagagacatccttcaggattgtgaggtactggaaagaagtcctatggggagtgggtggacacgtgccaaaactccattagtgtaagggactttaaatcacagaaattaacttgctggaaatctgttcccaattcttccttcagctccaaggttaaattaaatgtaattaatgatggtgacctgctaattcatgcttttgataactgatatctagtatgtatatatatataaacaaaatgacgaggacagggaatttaattatttgggtatcacacatgcaggtgttatatatgccaaattttaaaggtaaattactacttttattatttgtgtgaaatgtcattttacatatgggttccattttgaaagtggtttgggaagggggcataccattttaagtaccaagaaaaacttgcataatctcattttactttctctttttcagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcataggtaagtggagatatgaatgagttcataagtcctgcatgagactcaaggctcttaataaaatcttaaatcatttgagctggaggaatacctggaaatcatatagctcaaccctctcttttcatagttgaggaaactgaggcttagaaaggttaagaaacttgtttaatgtaaagggttggagttgaagctcagaacttctgatcaatattttattctgaaacatttattgagcaaccactatatcctaggaactgtgttaggtattatgactagtcaattcagtaactccttcaggtaaacatgttaattgtcatagatgaggttcagaaagttcaaatccacacaggtgatatttagtaaacctggaattcatgctgagatctacctagcccttatattttagttctgcaactacccctgctgacccttaaagaagtttcccaccatgatgatcaaattcagcatttgagatgaagagtttggcctgcagactaaatagcattaaataacaaagcactaaacagtaacagccaacaatatttgattgtgttctatgtgcgagatagtagactaagggtttaaatgaacatgtattgagtccttactatgagttaggccttgggctaattgctttttatgtgtgtggtctttgaactttcaattctgtaaagcaagtattatttttatccacattttaatgattaaaaaaaaactaagacttggaaaaatgtgcccaaagtcatagaataattctctggtcttaactactatgttatatcacctaattttcaaagatttataatgttaaaaagacagaaaattccaacaaaaatgccaacagtgggcagaaatcaacatgacaaggtcacagaaacataaaatccataggtaagattaaagaaaggtaatataaatcatgcagtaaattggagagagaaaagggaagaaagagagagaaagcaggcttgaagaaagggttttagttaaggatatttttaaaagtgtaaaataatttaaaacacatttgaacagatggataaatgggtcgtggtgtgttacaagatgattatgctctttctctacccatccccgcaaggcagatgttttcatgcttgaattttgtatccctaaagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggtatgtaagaagcatttcagtttgcagactctttacagacaagatgccttgtttgtaagtgattttaattcactagttttcagaatcatcagaacatttgatgaaaaagcaattttatgttactaacctgtctttggcatttcgttttctccttattttggttacttgttaattaatctttatcttggtgaagtgaaaataaagcaaaatcaataatgagcaaaatgagacatttgcaggaatgaattaaaagtttaaaaatattttgcagtttcattgaaaacatgactttcataaagcttgaaacagaagaatctcatttgcatgtcttccttctctactaaatataagcagattcctcctcctggtcaagtgatgtgggttagagacttctcaatctttccagtcctaaatgtatatctcatcattccagcgatgattccctccaacatggtatagggtttaaatcatgaaaaataattcctttcaatttagactctcatattttcattgaactatatttttccacgttccctaccctttgagtcttacagaagaaacctattaaaatatcacatcactatataagaggacagatattttaatttgcttggctatagtaatcactttactatgtatacttatatcaaagcaccatgttttacacctaaaatatgtaaaatttgaaaaaaagttgaaaaatatcaaaataattatatcagtcaggcaatatttttagtgaaaagacattggctttttatttggcacaaagtgaacctcaactcaagcagttatttcatgcttattttctaagcagataagcttcaaacatattaaagtatctagttacgtagattctttactcttatttcttttaccaactgctctgttccttgagaaaaatatggaaattttaaaataaaagtttaagttgttagatctcaactaggaaatccacaaagtaaacctgttttctatgtgaaataacagcaatgaatctcccccttcaagttaagatataaaaattaagctaaaaatatctgaagaagggaaaggcgtttagattcatttattaatttgcagaatgctgtgccagcattattccgagaaaaaataaatggttagaagagagagaattaatgcactaacatacaggataaaatattcttttgaaagtacactatccatttgcagtttgagagtgattaaatgaattcatctgatactctgaacgtcatattttatagctctgattgcaagtaagacatttagtagattatagataaatctgtcatttgtaattgactgcagatcttcatgccttcaagtcattttctcatgggcacaccaaaatgaaagggcaggtggaaagtatctaaaagcttcaattttgcctgtgtaaacttcaacctctatgacttacattttaaagacccaacagcacaagggatgcaacaaattagaatttaaatgtaattcgtggttgaaatgccacatgaatatgctctggctcccaaatgtcagttgctgaaccacaaaccgattcttaatgatcccttggaagctgtcactaatttttgtgaaccacaatgatggcttctaaaggaggactacaaacccctggagaccaataactggggataacttggaaagcttttggctctctaaaacacccaaggataagaaaatgcttcctaggaagggatttaaagtgaaaaagtagaaatatactgagtgcttgagagataagataaaacaattgcaatccctacatttaaatcccataccataaatagaacttctcaaggcaccaaagaaatgagaaataacaaggaaatgtatgttttaaagaaccgaatgaaataagcatgtgatcttgaggccagcatttttaaaaatgtgagatcagctttgaatggaaactaggtctctgatctaaaaaacaatgggcagaaagatttactctgcttctgtttagcatttttatcagtataaatttaggcagaagcctgagtcttaaaagtttagattctaaggcagggttccctaaataaaacaccttccgtgctcagtgtgaaagagtccattggcctgttgccaaaccagaatctaaatgcctagtcattcaaattaaatttaaaaacagaagcaaaacaaaaattagcactccacaaaacatattttaaggctggatctggctccagactaagagttaatgatgcttgaattaaagataggaaaatggaagaaggtggaaatgccaagaagtggatgttgttattgataacttttttgtataaccaatataaatgtaattatctgcctaaaaaagaaaaagaagaccctttatccctttaaatcattttcagaaatgtctgcataatgagttgagtttcattccctctaatgcctaaatgacaccttgtaataaattaccagctttgttaaataaggttttaactcctctgggcccctcagacaccgttgatatactaaccagtaccttattgtctgaagagagctaatagaaatagactgtcagagagtagaccaaacagaaatgaataattgtaaacagaagcagagagtattaatgtggtttctgtgatctaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagtaagttccaaatgatagcttggagtcagaatttctttttagataaagagattaaatatgttgcctgaaaggcccttcattctactagagaattcagactaaaatctacttttattatagagtaacagtgtaccaggcattcattaaacacctagaatgttcaaggtactctagaagttgctccaggggaaacagaaagtgcctacacatttttacactgcctttcttgagtagtttggtcaatatcttgctaactttcttattttggaaatgtctagttgtataaactaatcctcttagttttcttagcactacttagaagtcatgtgtcttgtgttggaatttcacagaaaatgtttcctaagaaaatgtgaaaaataggcaaaaagttggaaatgccctgggaagaaaaaaaagaaaagaagcaaaccaaatgtatgcttgcagttataaagttagaaaacaaaagctgatatgggggatagttttcagaaaaggagtatattgtactgatgtctgccccctagctgctttccagctcttccaaagtgaacacagtaagagtacgcctaatcagttgtcccagcatcctttctccagtgatctgaatgccaccactgtcacaggtcaagtttctgccacatgtagatctcttcctgagctttctgttctcctccttggatcatattattatttgtgcctgtggtagtaacacaaggtttaattattagacaccccctacctcatcttatttttcttcttcaggcatgtatggctcttttgattgttcttccatataaaaataagagttatgtgaatttgttttcttattataatcaccacatacttattctacatgtattattttatgcatcaagtattaaattattttatgaacttaaataagaaatactctaaataaatcagcaggaattagatacatattttcaccattagattatttagcaatgtataggaataagagaagtgataatatatgaaaatttcctctgtagaagtttaaaacttagaataaatttgtatttgtttggtatgctgaatgcatgatcccaccttgtggcagagaactgaaattgaggatcaggatgtctgcagatgccaaaacgtttatactctttgtgaccaggccattgtattttggcctgagagttttctagacatttcccaatcaccctgatgattggataccaaaataaaacacagtttaaatgagtgaatgcaatcatagcacaggagggggaagaaagaggaagagattttcttttcatcataatttttcttgtcaattaatataacaagtctcctaactcagacacatagtctcatgacaaattgaagaatatttattttaggttaaaatatttttaagattatcccttgtctcactgcaagagataaatggcagacattttatttataaggcaaaggaaagggaaaaactatcattttattgaacatatattatgtatctgatatagtatgaaatgcattgatatagtatcctatttagtcttcataacaattctctcttctattactgttcttctttaatgatcttgtccatttctgtagttccattcgtcatcttttactggagacccacacgtttccacctttagataaaaccttctttctttaaatattccatacccatgtcttcacatgcttgttgcatagtatttctccaatattcaaaattaatgcgccaaacttggtggattgaaaatagttaatattttattgcagctaacgttcttccagccaccaaaataccatctttgaatcaacatagaaaaacactgttctttattcacagtacttctcaaatatattttcttcttcagacatgggcaactttccatttatttttatgtggaaattccacaggactttggtccataggatgttaggtgcaatggcagagtttgtccatatgcaaacaaatttaagaatcactggaataaaaaacaaactggtttattttttatataaactagtttctttactgtcagcattttctacaatggaactctgtgagggcaaattagaatgtaatgttttgaaactcaagtaattaatatttgtttcttgggatttattgatagcttcctgagcagtaatccccaaaacatcagcttgaattgatagtctagctagtgatggtgaaagttttgggtgataatgtacactcaataaatagtttccaatcccacctgaggcatatgttttagttacatattatttaaatttcattatgctaacttaacaggttctgattattacgttaattataaagcatagaacatgggaggctttctgaatgaaggaaaaggaatatgagttgaagttgtaaaattatctctcaccagcttagtggattgttttgcttgtccctttacggtacatatattcctttctggagaccactgggacagaatgatgcaaaattttcctaaccaatcacctctcctcccacccatctaaggttttgacttctctccacttcctaataaatcacacataactttcttatcttgatacttgatttttttttcacaatatagctctggtctagcttcttttctttcctacagtccactactatcctggcacatactccaggcaaactatttcccaaacaggccctccccctttttttgtttattttacagctaacatgatcttttccatataatgacaggcaccaaacaactcttcagcacctattcaatgccaggtactgtgccaagtctgtgggatacaaagtttttttttgttacagatagggggtgttatagacagaagaaagtgtatcatctcttgccatttcctctgcctaaaatgtttgtcttgtaaaatttatttcacctaagaaaatttttcttaatcctatggggctttgtgtaaatctctcttctttataaagcctttctggagatctgactgggcaggatctctctctctctttccctgctccctcccaccatctctcttctttaaggctcctatcatattatctatccctagtatcacagttctttgtttgttactgcccttcacaaagtttcattatttctcacattaattgctgaaaaagttgaaaaatgtgtgttggttgacatatgtatcactttccaaagaaatgtaagggttttttttttccttatttctctgaaggtttaaatagacagcatttgcatacaaaatatcacatatatgtgacatatagattttagtgtagaactagatttatgagattattttggcaaaattcaattttccatggaattttcattttaatacattcttgtggaagaagcatatattgatttaacaaatatcaacacctgtatctgttagtgtgattcttttttttccttcagatacttttatgtatctcatatctacttgattcaaagaaatgggacatggtaacttagattttctcattttaatgctaccaagtatgcatttttaaattttcttttctaccaaggaaaacctatatttcatattcatgctatgtataaagttttaaagagcgacaataagaactccaaacattgtgtaaatgtttccacatcccatttttttctgcaggcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggcaagtaaatgaaatcagtatttttaaaagatctagttatcagagaaaactgaattattcaaaagcaagtttctttgagaaggctttgaatagtatattaatcctgtgtgtttatgtgaatgagattttctattatgatacacctgcttgaaaaaggaactttcttaaaaagaagagtcaaccatgaagctcttttcattataggtgaagcccttggaaatcatgctctaatttcttaaacacccaaaaactttttaaattcaaatttctggtagctagctggccaatatgtaactatatcaaggtctctagcattggcaaacaatattcaagactttgacagtgtattaaattagtttagttttttttttaaatagagtaataaaaaaaattccaaacaattagttgacactgagtaaagccttgcttgcgcatatgttttatttaggtccgtattaacctgtaacttttttcaaaggtctgtacaaattcaaattagcatctactgatgcttaacttggttttccttatttcacacaaagtattttaaagctgaggaaagtgaggtataaacaggtaaaattactatcacaagatattcagctagttactaacagagcgtaggttcaaattcaagttttcaaaatccagtgtctttgtataataaattttgatacctccaaatgatgcttgatatatatatatatttaaagtcttcaaaagaatataattacttttatcttataaacttgttattgttaaatttttaccttcaatatagcattgtccatgtctaatgcatcccatctccccaaaaaatgcaaatacatttctctgccctatgatcagagatacttggtatacaaatctaataattatttttaattctctcaccttttagtctcaaaattatatgccattttaacctatttttgatcattttaataactacctgaatgcactgatttgaatatgattcaataaaaaaaatcactatattttggctaatctgtaaactaaggccatcagcactgatgttttaaaagatgtacagattgtgtcttcttaatgcccaatcagaagacaattatacttatttcctgacaaaatgtataaaaagacgagtgtcaagccacgttccatatatatcacagacaatctttaaatgtttttgagtcaaataacaatggaatagatgcttgaaaaaatgcataggtggctaaataagtggctacaactatacaattcatcttagatgaagagagaactggttaacatattttaaattctgatttcattttataatgcacaacaattccctgatctcaaccctctggtccttcaacccaattagacagcctacattatagaccctccatttttatttatgacctgtcttataccaatccttgttttctcccttatatatggaatatatatatatatgtgtgtgtgtgtgtgtgtgtgtgtgtgtgtgtgtatatatgtgtgtgtatatgtatatatggaattgagatatttatcaaaagctgtataaatgttttgacagtaggttttcccgatgtttaaaactagcacaaagatggaaagaaagccctgaggaattgtagcttccccacaaaaaatagttttccaaaaataaacgtgctaacagtcattcaaaaataaggtaggaggctgaagtaacatctggcaacttaagttccaagacaaccagagcattcttctcccaattgtgtcagcagtttttagcagaaactggagattttcactatctttattcccatgtagaacaatgtctgccttgtcaaatagagtgtctatatattttgactggtatcctttgcaggtcattatttttaacctggaggctacatttagaatgtcatgccactagcataaaaccagcctagctctgggtatagcaaacaaatgtcatcaaccataggtacagagaagcagtgctgttatattaaggcaaaaattggcctgacgagccttgaaaaaattgtttcccaatataatcattgctattacctggaaaagtgaaatatttgcaatagttttactattctcctccttaccatgtgtctaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctggtaagacattttcatatgctttttgcatgctcagctgggcggattgtttagatggcatagttatcagttcaagctgagcactcagcgcataaaaacactttcaaaataaggatagcatagctgtaatatcaagtcacttccagacattcaattctactttgaaaatgcaggcaagaagtctctccaaatagttattataggatgatatttttaaccatttgctgggactaaccaaatcatctctcctaatttttgctacgaaaaaatggctactatgtttcacaaattgttcttaccctcatcttccaacataaattctcattacttttaaatataaatgaggaaaaccttatagagctcttctttgatatcccaaaagactaaaaattgtatacccataatccacagttcttatttttattacttaatggcccctcacaaatagaaattgtgttccacttgaaaagttaatgttggcttttatatcacactataggaaatctcttttaagttcatttcaatgcattctttaaaatactatttaaaaggcctctttctctgccttcctatgcagctgagaggctagcattatttttcaaacaataaaagtgcttccactggttaaaacatcgcaaattttcataggttgaaagcattctaaattttggcttttgtgcctttagctcataacgcacataaacctgatattgtagcttaactacctattgatttatgtatccattaggcatgctttcatttctatgtgtgtatgtgtgcaataacgtcctctaatccaacctaattaggaccattaattgatgaaattgatgaaaatagtttgttccatcaaaaattatttaagaaacaacttacacataagcctgtaatcgcagcactttgggaagccgagatgtggggatcacttgagcccaagagtttgagaccagcctggtcaacatggtgaaaccccgtctctactaaaaatacaaaaattagccaggcatggtcatgggcacctgtaatcccacctactggggaggctgaggcaggagaatcacttgaccctaggaggtagaggttgcagttagccaagatcacaccactgcactctagcctggctgacagagacagagttagttttcaatcagttatgaattcagttattgcagtttcatctcattttcatgtgtatttatatacataatgacaaccataaatctataatttacactgtcagcttttttaaaagtgaaacaataaatgagtgacttttgaaatacaatatgagggcaaatattttagccatacacctttaacaaatctttccaaaatgttcaatttacatactataaaaacaacatccttctctttgttttacagtcatgatgaccactttatgtttgtttaactagattacttttattacagtaatgagtaaactcaaattaataggtttaggaattaacaaaaccagcttttgttaaacatgcacttctgggaactacatggcaatgttcaagttgtatttatccagttattcacaatgccgtgggtgttagtaaactttttagaggaaatggagactattcagtaacctggcaagtctcttaagtggagttttctttcacctatgaaagaaaggaaagatattccttcaccttgtgtatcttggctgaaaatataattatttcacattgatagcaagttgttaaaggttctccagattttaacttaaaggtcattgatgaaccagaaaaataccttttgaacatttttttctgacattttctttgtttgcaatatgtgtagcataaggtttctcagtaacttgaattgtagtgggaagagaaataccgtaaataaaaaataggaaactaccctgcagcacatttctgataaaatgtggccataaaattataggataggtcaatgtaaacacttgcaaactgcatgaaagctaagctgaaacaattagcctccttcttaaatattccttgtacctgcaaatacgttttagaaatcagtgtcataaaacaactgtgaagaagagaaagaaaaattagaaagattaaaaaaatttataaaactgtctgtaaagcaagagtcttgtttaaaataagtctaggagtggagggatggaattctttttcaaaatgattgaaaggtttttacaaatatagaaagctctttacaaattgcagaataatagaattattaggcttggaaaggaacaaaaattacactttacagataaagaaaagtggagtcattcaaatattaatgtccattacaggttcctttcattagacatgaaatagtacaattgagagcatccaaactctagttactaccatgttaatttctatttactaacatttctgatctatatacacattcaattcaattccttctcttttatttcaactgagaattatatgaattaagttttaaatatagcagcccagaagttcagtgtattttcagaagaagcagtttatacgtttccaagagtgatcactactttactttttgagctgtgagagaaatgaagtaatcacacgtacacttaagtcttttcatatatattattttcaaatctactatttcctggtcagtattcaaggtaccagaaatacgatgctatacaaaattcaccaacaaattttcttcctgaaacttttcttcctgttgataaaattgacaataaccatatgtaaatacatatacagcatgttagatggtggaagtctctatagacaaataaaatcaggaaataggataggcagtactgtgtagatatatggaagaagaatgtcctaagacaaaggaacagggagccaactgtggctggagtagagtggggtctggggagagagtggtgagagatagtaaggtcaaagggataacaggaggcagagctgtatgccacagcaaattacaggtttatgttttctttggctttgaaaaatacatttaatgaattttattcaaattgctttatgtaatttttaaaaattattcaagatcaccataggtgatgaaatactaaaactcccctgcttttaaactctcttttttattaagtggtatattggtactgtattcaaagcattttctgttttatgtaatttctcatcctgctgtagtgaaacttcatatctttattcagtgtaaaataagaataaaattttttcaggttctccttgaatattggatgcctttagaactcaataatgataggaatattaattttattatgtttattaatacgttgtctttggaataatttagatatatccacatttccattggaaaatgcccctattggacataatagacaatacaacatggtgccattctggcccccagtcaccaacacagaaatgtttgttactgctccagacaacctgggatacacttatgaaattcaatggccaagtgagtgttgaaagtgtatttttactgtgataatttccaaaagcaaatgtgttatctttcaagtagagtaatcacggtattctgaagctatgttttccatttggacttggaaactttcatttgtacttttatttgaggataagggaaggaatttgatatttgttgagagtccacactaagctgatattgatcttattgtacagcaccctatctcatttaatcctcacaatgctttggggtgagtatgaaaatcttcatttcacaaataaggaagctgaggcttaaataggttaactgttacagattcacatttctaatgagggaagagaatgagtttgagcttaggcccatggaatatgccccaatttttctactataccatattgcctgcatttatctatcttaaaggaaaagggagtgagatactcttaggtatttttctgagattttgaagttcaaaagttttttgtttaaatcttttccccaacaaaggcagtagggcatagtggaaaagtacaagacttatattctaaaatatccgggctccaaagccaactttattgcttaccaaccaagtgacctgggtaagtgactcagactcattgagtcatcattctctcactttcacaaaatgaaatggaaataacaatgactatcccaatagggtccactcattaaaagaaatcaggaagtggcttcaaggccatgtggccaatgtaaattaaatatgaggatttctgttaaaatagacatttctaaatttcatgtgtccactttttggtgataactattttaatatttgtctttttatttttaatcttcctttccaaataggtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaactcatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattctcttatcatttatcagccttttatgtattttccaagtaaaatattaacatattacttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaaaaaacatgatccagtgacttgctgtctataagagactcactttagatttaaaaatacatataggctggaagtaaagagatggaaaaggatattatgaaaatggtaaaaagaaaaaaaaaagaaagcaggggaggctatcctatcagacaaaatagacaaagtcaaaaacttcctctagaggtgaagttcattatataataataaaagggtcaatttaacaagatataacaattgtaaatatatacatattcaatatcagagcacttaaatatacaaagcaaatgttgatagatctgaaaggagaaattgatatcaatacaatactagtagtagaatctaatattccactttcaataatgtataaaacatccaggtaggagatctataaagaaagagagtacttgaacaacactgtacaccagttggactttagggacatatacattacataccactcaacagcagcagaatattcttatacttcagcaacatgttcttctcaaacacaggtggaacatactccaggataaattacatcagacctcaaaacaagtccccccaacattaaaaagataaaagtcatttcaaagatcttttaagatcacaattgagtaaaattagaaatcaatagtgcaagaaagtgggaaattcacaatgacgaaaaaacaatacactcttaaataaccattgggtcaattaggaaatcataaaggaatttaaattatatctcaaggcaagtgaaaacaaaaacacaacatatcaaaacttacaagatccagcaaaagtactaaaaaggaattttgtagcaataaatgcctacgttgaaatctaagga

SEQ ID NO: 15236 - DNA, 147840 bp, Human
cctgacctcgtgatccgcccacctcggcctcccaaagtgctgggattacaggcatgagccaccgcgcccggcctatttatgtgttttaattgccagaagttaattgtttttgaggggggttggctaatagtaggctgttttgtgaaggagtatcatattctccttgtaaataagagtaaataaatcaccaatttatttgttaatatttccctatattaggcctcatgaaataatgcaatgctcggcattggaatgcctatctatatggaatatactgactggacattaatcctgaataaatatatcatagttacaagttatgctatgagctggaaattggcatactttatctcatttttcaaaatatacccaatgagtaagtgtgttttaaaagaaactgaggttgagatgataggtcccttgctcaaggccacacttctgtttaagtttcaattccaggtcagagccagtgtcctcttttcttgacacaaaggcactttttaaaacaagtgccagtagttaaacaatttaacatttgaaatggagttgatgtttcaaatagtatattctacattgggataaggcaagtcaatacgtactgttctctcttatcacacagagctaattgcagacattgatgctctgtagatctgctcatctacatcacatacttccctttttgccaaatgaattttgtcttaaagaggtaacaggaggcgacttgttctttctaagagaaattccattttgcttccagatgaaaaatgagaacgtgtggtggtagatttcttttctctattgaaggaatgactgactgactgtcttcctcatgattcagggttttctgtgaggcaaaagagagatggaactatggggatagctgtgcagatttgttcggcagcaaaggctcaagatgggttagtgacgtggatgttagcaatgcagatctgtatccagtatttcaaagaatctagttaagtattgttagagaaagatgagatgtgtggattgaaggagttgagaagatttctttgaatgggaaagaggagaacattatagtcaggagagtattttgagaacttttgaaaaatttaacactgtatactcccttttgttcagtttttcatccgtgatttaaagtattatcttccagtggttcaggtactgcttgagtgtcacattcatttctttttttcttttcttttcctttttttttttttttttttttttgagatggagtcttgttctgtggcccaggctggagtgcggtggcatgatctcggctcaccgcaaccaccgcttcctgggttcaagtgattcccctccctccgcatcctgagtagctgggattacaggtgtgcacaaccacacccagctaatttttgtatttgtagcagagacggggtttcaccatgttggccaggctggtctcgaactcctgacctcaagtgacgcactcaccttggcttcccgaagtgctgggattaaagatgtgagccaccatgcccagcccacagttcatttctaataggtatgcatgtattgtctcctcagttaggagtgtgagcctttgagggcaggatcacattttctactttttatgattttgccacagaatttcttatgtggagttaagtaagctccttattctgtgcttaaagatctgtaagtgaatacaagattatagtggtctgtactgagaactctttatggaaatatgtttgaaacttctgccaccttatttaaaatagaatttatgtcttttaccttatgcaagtattatgggtaaatatatacatagaagataattttgaataagtcctaaaatgtttactttattgtctgtaaagcgaactatcttaagttgtatcaacaagattttaatggtcaaaggaattagagttgtatcaagtgttcttcagagtatatagctttagaatataaagttctgataaaacataaccattctatttcttttttgcacagagttccattttaattgctgttaatcatttcagagaagaacactgaactttgaaaaaaatgttggaagccattggtaagacttattcttttctgcctacttttataagaattgtaactcctcccattgggatttttgacatatgttgtgtttaacatagcaggattctgtctatggtatctagatttaaaaagtttttacctactagcattgtattaaggtaatatgtttctgtatttggacaatttcatctaaagtgttgtaaaaatacgttacttataagcaaaaattaaaaacatatgagatattcttccaattatgggttttaataaagcttaatgtaagcccaattctgatttatgagcctaattctggttaatatctatttctggaaagcatctggaagtttagcagtatttttaatactgaaagaagatattacttttacttctggcaggtgaagttctactgagctcttgctattaattgataaagagaaaaatgttgcttagtcttatgctttaaggcagtttaatttctacattagataatttaggttgaaatatctagatttcccagactcatgtgttaataaactgtttttcccactgctctttagttttaaagaaactagtttgtagaaccattttacaggtagatatatcaggtatggtacaatacatgcaattatctgacattctagttccttaccctattccaggtaactctttgggtatgactaaatggaaagtgtttggatttcactctggcaccttaatcattatggcagataccttgatgtcggtgggttttgagggatagagtgacagtcagtgacagtaacgggagaaggacttgtttttgtggtcgtgggatcactatgatgacttttgttcctggtactgtgctggtaatgaaaatgtacgtatgtacatttccttcacttcccattttatactaaacccacatgctgtaaagactactagtccacataggaaagttcttaataggaaagtggaaaggaaagggcaaatatagaattatttaaactgttgttttctagtctttattctgttttgtgctgagttgcacactttctaaaaattgatgtggaaattaatattagatttgtatcctgtgataacatgggacatataacagaataagatgctcatgtgtatctttatcatttatttttaaaattctgcatatgagtaaatattgtttgtttaagtttgtgtgtgtgtgtgtgtgtgtgtgtgtgtgtgtgaacccatgatcaacatcagttcatattttaattaccctctttctgtgcaatttcagatttggtgctatagaaagtatctctggtgatgattccaattttttttttttttttttttttttttttgagatggagtctcactcactctgtcgcccaggctggagtgtagtggtatgatctcggctcactgcaacttccacctcttgagttcaagggattttcttgcctcagcctcctgagtagctgagattacaggcatatgccactacacccatctgattttttttatttttttttagtagagatgaggttttaccatgttggccaggctggtctcaaactcctgagctcaagtaatccacccgcctcagcctcccaaactgcggggattacagacatgagccaccgcgccccactgattcccactttttaacattactgggatatggcaaatacgtttaaatagatatacttgttaccatcatgaatctaagtaatacatctgaacagtcttcattaaaaaaaaattttggcttcacatataagagtgtgtaagtgtatatgtttgtgtttcagggaaaggtttttaactattatttgtggtggaaactgtctggcgtaagtatgcttgtaagacactaggactagtaggacatagttactcaatatatttacttttagcaactttgtgtctgatttgtacagtgttcaataattatttgaattgatttggtttgaagcagatgtaaatatgctattttgtttgctatttaattttggagaaagatttaaaatattaaaaagtattcagttttgtatttttgtactccattaaaaaatgtgtactttctctacaggtttttttttttttttttgagatggagtctcactctgtcacccaggctggagtgcagtggcccaatctcggctcactgcaacctctgcctcctggattcaagtgattctcctgcctcagcctcctgagtagctggggttacaggagcgcaccaccatgcccggctaattttttgtatttttagtagaaacggggtttcatcattttggccaggctggtctcgaactcctgagctcaagtgatcagcccgcctcagtctcccaaagtgctgggattacaggcatgagccactgggtccggcctactgtttttttattcaatttaaaagagacaattttatgcactcaatagaaatagttttagaatttctacaagatggagtcctcttaggctggacatgtgtcctttgaatcctgttattgacaaatgctgctctttggtatagacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaggacatcattcacccaagcaggcattcacgacatggcatagatcttgtgaaaggcttgtgtttttctgaaaggctgatttttctatgtgttaatgaatagttaatgaagtcatttaaacctccaaatgagacattcagattcactgtggcttttttcctcctagttatttttgtaatggttgttgctgtatattgtagatgatatgacattgtgttgaaagctgtgtggatgctgaagaatgagtttctacaggaaaaacggatgataaaaatatgtttaggatggttggctgtagacttagtttccatcatcactgaggctcattgttcatgtgatcttgctcattcagattcggacattcagtatacttacaagatttcagataagcgtggatttgcatgtgtaatcatgtgtatgaggaagggaaatcacctctattttgacagtaaaaggaataattacattgtcatcagttagaggaattgcaattctcacttctttaaagagtgtaagtagcaattgcttccatgacagctcagatggtgataaacattagaacttctaaatgtaacacagtgcttttttgttctgtaaaaattatgagcattaaaaagtcctagcatttatattaaaattgaaacatttcacaatgacagaatgaaaactgaagtcagatgttctttgaacttacttaatttaatcaccatttctatgctttaaaaatatttaaaaaatgttatcttcaaggtttgaagtcaatctcattatgccttcaatccaagttagttttcattctaatgtctttagcattaatttaatggttatagatgacttgctagcaaatattctgccttataaggttaaaaatgaaacttgaagattagtttcataattgagtgaaagaacagctccagttaaaaaaaacccaaagtgtggctaatgcaaaagaacaaatagtaataagagagaatgaatttgtttaatgtcatataacttcttaatctaaatattttgtagcaaaaaaagttaagtcaagaagaatcttcacaaatacctttctatagtaaatgtctatttaatggttttaaaagtcgtgatcatgaatttaaggtgttgttgttatatgtagttgtgtttgtctcctttacaagttattgaaaagattgattttatttatttttatttttttgagacagagtctcattctgccactcaggttgcagtgcagtggcaccatctctgctcactgcagcctctatctcctgggttcaagagattctcctgcctcagcctcctgactagctgggattataggtgcctgccaccacgcccagctaatttttgtatttttagtagagatggggtttcaccatgttggccaggctggtctcctgacctcaaatgatctatccgccttggcctcccgaagtgctgggattacaggagtgagccatcgcgcctggcaagattgattttcagtactggttttcagaatggattggtaagcttttggagaaaccagtatcccaaataaaagcataattatgttgtggaaattatctgctttttcagagagtgtaaagaagttgaacagatatcttctattcttaatatgttatgtgaaaacatgattagaatgagaagaaaagttgaaacaaaaagagtgctagcaagtctgttgggatataccactggcccagtgagataacttgaaatttccgttgtagacagtcttaatgtaaaaggaatagttatttgtgcatacagtgtctcatgaaaggaggggacaaataggccggcctattaagcttgttttaccatttccatatggaagtagaatatgggctctgagactatttgggtcccacgtgattcagatgaaacctacttggaaatttgttgagaccgagaccaactacagcattatcttattattttgttgatagacaactgatatattttaagactacataaattgtgaggtctgtgaattctatgagacatgtcttacatgtttttggactttgggctccttgatcacatgttcatatacaggggaaaactaatactgaaagggaccaaggaaaacacctagtttataccctgtagattacagtggcttagagaggttaagtgacttgattataagagtagagtagaactagaactcagttttctttggagcctgtctcacatcttcttcttctttttttttttttttcaaaggtagaaagttgaaccctagatgccaagaattttcttttgtttaaaatcattaataactttttacagtgtctgtgattcgttttttaaatctccattctttactaattcaattccatttgtttaccagattctttcttacatgactagagtaaaaatttaaaaacttatattagtttctattctaaaatttaaatataagtactctagagttttgtcatgtcagatttaaattttctatgtagtttaccaactgctgatttattaataattataatttaataattaatgaattcaggaattaaatttattcttttaaaccagtggctacacaaatctgaccaatggctagcttatatttattacctcataccttacctgttttcaaatgtataattttatatgcatgacagctgcaatttactatctccatcttttttactattattagaaaatacgaccctctgattctccctctccatcagtctcctgttttttttagaagtaaagggactgaataattgaaaagcttgaggtatatgcagcatattggagaacatgatcatattgttgtattaatgacagatgctgacataccatgttgaattaagcctacaattttttcccctcagatccttctcattacttctattcaataatgtttaattttttcaatttgcttcttcagtattaagactgcccttagaaatcaaactgtttccctttggcaaattaaacacttgacaggtgtgtaactgagagggcaaaaaagccatgccctgaagggatgtgctatttaaatattgtcaaaaatattagcaggtctgagaatataattgatgtctctgtttaactctgccacattgtgtattgttctaacgccagctaaaaggatgcatgctattaaacctgaataatctctaatagctctggttcatttcctattgcatgattcctgtttaagtgaagagaaaaaaaaagaactgtgactgtgtgtcaatgatctgtcaaatgcaaattctcaagtagtgtcctcactgtcacctagtcatcactgctaatcactacagggcttaatgcgtattcatgacaaaaatccagctattgtgggggaaataaacacgttagcagtttaataatagaaacttgtcagccttgaggatattggatttgcatatttattctatgaagtttctccagtccagtataggtggatgctactctcttgattaattaattgcgttgccttaagaattgaccagtggcactaaattaatctttttaccctgaattatctgtaggaaaactgagaattaaaatgattaatttcaatagaaatttaggaccaatacttaaaaatcgacattgctaagattatttttaaagctatggcaacagagaccaattccaagattggagaaataatgtagatgactcaggctgcaaaagctgcttagatggcaaataaacctcagcacagaatattcaggaggtctctcctcgtcaatgaccttcagactttttggagtgtggcattctattgttttgttgttggtgtttctttaatatttccaggtttttagttcatttactttcctcccaaaaagtgtaggcttacacatatatcatctagatgcgtaatgtgtatgcacacaaaattaaggcagacttttctttggaaattttatgacaactcttgaaataactgtagagatgctgtgttaacatgggatcagggttgaaaattactcttaaatgttgattagagtaattagatctttttttgaaattttttcgtgaaatgagatcttcatgatgtaaaattttggttttatatttctatgtaagtttttgttaattacatttcaaaaagaatttgaagcaacttctaatggcaagacttgttaaataatgaatgattcaaatgtaaacctaaacaaagaccaaaaaaaaagtcacataactagatataccaaggaccttgggttactaaaattgagtatgtcatttaatttgtttcctagaagcaaagcaaaaaaaaaaaaagagatagaactgaaggactatgtattgttcaatgtgggattcagtgaaccagttttcccttggcaatgggtgggttatctcatggaggctcatattcttatattcatttaataatcaagctttgttgaacatctaaaattaataaaaatacaaagaataataagatggaggttctcactatctagaggggaaaatagaacagaaagaaaacaaagaaggtgaatagtaaagaaggaatgagtaacttttactagaagaaaacctcacagtggaggcaacagcatggaaaatgggtcttgaaaaatgagttctgcagaggtgggggaaatgatttcaggtagagagagcaatgtttacagggatacagagcagttcacaacaggattattttatgctctccattcccgagggaaacttggcaatgtctggagttagttcttactgtcgtgactggaagatacgggagctgctactgacaggtaatgggtagagttcagtgatgctgttaaacatccttcaatgtacagcacagcctcctacagcaaaaaatgactgggcttataatgtctgcattgctgaggttgagaaaccctggtatggagccccatgcagacctatattatcagagcagtagattatatgaggggtattggcaggagaggaaactatggagccagactgtgaagaacctttttaagtaagatgttttatttgttggttggttaatcacctttgttcttttgcatttttttttttggatattgtattaactttgtcttctaattgttctagtatgtaattattttagcaatcattttgttttttatttcttcacattttttaacatgataaaatcatcctaacaggctggatgcagtggccaaggcaggcggatcacttgaggccaggaggttgagaccagcatggtcaacgtggtgaaaccccatcatctctactaaaaatacaaaaattagccgagcgtgttcatgcatgcctgtaatcccagctactggggaggctgaggcacgagaattgcttgagcccaggaagtggaggttgtggtgagcccagattgcgccactgcactccagcctgggcaacagagccaggctctgtctcaaaaaaaaaaaaaaaaaaaaaaaaaaaagcatcctaacataaaattaaggtagtggttttaatgacattttgataagtaagatcttcagttataattgtgaaatatagtaattgttctttaaaataatgctgctttcatcttactaattctaagaatacagcatcacatcctaatttactaatggtttttctgcccaaggccacacaagtaatatacactctgtgtgaatttttttttctgatgctcaaaacaggagcaaattctagaaaacctagaaatgtaggtagtcaggtagtcaatgtgtacttcagaggttcagcttcaaatatctgaggtaagcagagtttgttaggtggaacacacactataccaggacatgtctgaggagtctttattctgtagatacagatttgtacgactgcgaagagttcatggccaaagtgttgaggtatgttgcttttaagtagcaacagcagcagctcaaataatttcttacatttatcattttagagtgatgggaaaatgagaaactttgtgaactgagcattttcttgctctattttaactttgacaatcagaaagatactgttttgtttgattcatatcttaaagagcagaagtgcctgtgtttccctctcttcttatataaataacaaactaaaaatgaccctttccctatagtttctaatttgagaccgaaaggaggatgattcacctatatgcttgctatcagtaaaggggagatgactactgtctttccaagaatgtctaggttaagttatgacttggtgttggtaggggaaggaggacagaacgaaagaaatatgctttgatttcattaacaagaattatttaaaaatggagtggaactcttcccagctgttgttacttgtgaaaatgaaaatgatctttcttacacctgaaatagttttacttttatgatagagctttgtagccacctgacagcaaagtatctatttctcgagactctagtgtgcattatctaggagaagttaaaagagaatgagtggttcttatgtttttacatttaccgtaaagtttatttactgtaggaatttcaaatactttatttttggtacaataacagcttttaaatgtttgttcctttagctaaaagtttgtaaatatagagccattgaagggactaaaatttttgttttaccgtgggcaagaaggcactgttcaagctttttatacagtgctggattaaaatgcaacaccatcttgctattggctatgcatgtgtgtctaaaacagcaaatggtgataattgtatggtatttttgtgacaatgttaaatggtctttggaggagaaggaaaaaaatgtgaaatttactggttataacctaaatgagttttttttaacctccaaatttaagactaataggccttatttttcacttgaagctacaacaattacctttcaagaagcccttatgtgctatagactttgcctcatttaactagtccatcagttccaggaggtaggttttgtcctcattttatccagtgaggaaattgggggttagcttgtataacataatctgacccacacaattattcattgatagacttaagagaatttgaggtctgtctaaccctgaagccagtctttttttttttttttttttttttttttacttttattatgttacactgtttctgaatccttagttctctgtgttaatgaacaaataagatggaaaaactgttaatagcatccctgaagagaaatgcacttcagctaaacatcatctaaactcaaattcattaacttaaaatatgccatgtcctataaattcttctcccagattttaatcatagattctttttaacgtaaaccagtacttcattctggttatattaacaattttgctagattttaaagttaaagtgaatgatctggttaaagataatagtggaatggagagagaatgtggcaaaatattatcagtcttcatgtgtccattcctatataattatacttctctgtaaggctttattttatttttattttcctctaagcagattgtgaacagtgagtcagtttgtctcctagaaatgtgggactgataggaaaaacactgcaaaaattctaacatgttgtttgtttaaattttcagtttctaaattacttatttgccttccattttcaaatagattaatttacttaattttgataccttccccactatgatgtagaaaatttcagcataccttgataagaatataatttttgctcaagctacactttttaaatttttttctcttggaaatttagctaagaaaacacagaattgttgagatttaaataaagaaaagacattctgtaaatatgcataaacacacatgcctagactgtggtatatgctacattccacttgccatttgttcttaacaagcataaaaaggagccttagaattaattgtatttcaggtttgcttgacatccatttaccacttttggcataaagtccatgccatattcatctttaaatactttgtaccttatatgatacttaagctctaaaactgattgcttaataaatgaatgcatgagtattcttaaatattcaaaactgtcattcattatttatctttccttgccagacaactagtttttaacttaagtaaattaaccaaataactgaagttattttggagaccctactttttctcttagcaatgacattgaaaaggtacatcatttatcatatcatagcaattatcatagcataaagtcttactgtgtgcccagaactgttctagttctattatagttaatggtttcatcattacaacaatactataaagtcggtaatatgattttcctcattttatagatagggaaatggggttatagagaggttaagtggtagagccaggcaggctggactccagagcctagatcttaatcatagaactccatattttttgttttattttcttcttacacagcatagtgaatatagtttaaggatttctgggtgatttgagggcttcttatgattatctgatctcagattgtggcagcgtggtctaatagtagttggagacaaacctgatccagatttgtattctggtaatgatatttattagtaggtgatattaagtaagaatttattctcaagacatatatcctgtgaaacattttggtttcctgatcagtttgtagtcataaattattattaaggtctgcaaaaatcttttgttcatatggttttatctatcaatatatgccatgttagaaatcaaaattcagaagtgttttaaatatttatttatttaaaaatcacagtagtaaacccattacatgtttaaaaattgaggagagtggcactattttatatttttgcacatatatttaatgtgcagcttaatagcagaatactagattttcatcggcttctgcattcaatgtttggatttgctgttttagttgatgtttttgaagaaaatcttgcctcacacagatatgtaagctgggaaagggagggttacagcttttcagataattgtggtatccttctttgatagtgcatcaaaatttgtggagttttcttaaagtttagttgcactgttgaagtagcattgttgtctggggtaaatacacaaggttcgtcatcttgcaccaagaaaattaaggacacggacacatgtgggtgggttgaggaatgaaaagtttaataggcagaagaaaggagagaggagaacagctccttgccagagagaggcatccgaaagaaggggcaaggcagccgactgcagcatattttataggcgggcttgagaagggggtgtctgatttacgtagggctctccggttggtttgaccaggtgtgatgttgtttacacggttcgaggggaaggctggtcaccccactgtaatcttattatgtaagtggactttccacttggctcttgccatcttgtctgctccttactgtacacatggctggcaaaaagagaagatgtagccaccattttgaacatgcctagtcccaggtagtatagtccagtgggcacaactgctggcattcacctgtgcaagcttacagcttggttgtttatgtctgcagctcagtttcacaggctgctctttgttagagaagaaaatgattttggggctgcttttctggaaaaccttaccaaggactataccctcgctatctgcctaagtaatttcttcttaactcctatatcactgtgaaatctgaaaccaaatcaataagtatttcactctctactacaggaaaatctatttgtctatcttgctctttgaattttttttaactaaagcttaatttatatttcattggtcatttggaaaatttgaaaaatggaaaaatcacatttctcatttcattatataatatacaaaagttatacttgctgatatcagttgcagtcttatcaacaaattcaagttatggaaaggtgtcaagctcaaggtggcagatacagatgttctaaaattctaattttcacttgaaagctcaaattttattatgggcggcaaatactgtctgttgtcttccttgaagtgacaggcttactttgtttatttttgagaaaatgtcttttctatactcaagtctatataatcatagtttgattttcagtaatttttttttttcaaatacgatacaaaaaaagtagctaggctagttcagcttgcaactcaaattagtgttttctgtgagacaatcattgaatttattatgcagcataaacactttgtacttaccattttacctttttttttttttttttttttgagacagtgtcttgctctgtcacgtagactgggctggagtgcagtggcatgctcatggctcactgcagcctcgacctcttgggctcccgtgaccctccaacctcagcctctgagtagctgggaccacaggtgtgtgccactagccaggcaatttttttttttgtagagacgggcttttgccatgctgctcaggcgggtctcgaactcctggactcaagcaatctgcccacctcagcctcccaaagtgctgggattacaggcgtgaaccaccgctcctggcctgcttaccattttgaagcatggaatatgaaaaacacatgttcttgagggtcaagatttaataaaattaacaagttttactgtatcaagaatttgtaatttaaaggatggagaaatagaatattgctctttatgataggcgctgaaagcaatttgtagtctttttttcagcgtatcttggacaattctatccacccagtaacaataataagaaataaagatactattaaaaaagatcaaacgtatttgaaaaaataacccattatttttgaaattaggatctcggtggaaactcaggggagaggtaaaacatcctggtacgttctacttcattgtaggagcgaagtttttaaaaaagaaggtaaacaattttttgataacaataatgaaaagactttaaaacaaaactatgttttaacttcaagttattttccaatctttattcgagtgttcataaatattttatgaaatttggggaagtgggagttttaatttttttacctaagtatattcccaaaggttttagtgtcatttaggccttcttaaagaagaagaaaacgagtttataaaatacacatggagggctgggcacagtggctcacgcctgtaatcccagcactttgggaggctgaggtgggcgggtcacctgaggtcgggagttcgagaccagcctgaccaacatggagaaacccagtctctactaaaaatacaaaattagccaggtgggtggtacatgcctgtaatcccagctcagctacttggtaggctgaggcaggagaaccgtttgaacctgggaggcagaggttgcggtgagctgagattgtgccatcgcactccagcctgggcaacaagagtgaaactctgtctcaaaaaaaaaaaaaaaaaaaaaaaaaaatatatatatatatatatacacacacacacacatatacatatacacacacacacacacacacacacacacatatatacagaaacacacacacacaaaacccagcatttagtgcagtatgccttgtggattgattttaataaaaatctcttattacgtagttttaagaatgaataagatctttgcaggtttgaataaaaactaaaatattaaaataatctgttaactcctcattcatccacttaagtcgacagcattgtataaaagctaaagtctatagctttgtatttgattttgtcatttaacaggttataacaatcagtgttacactgggtaggttattgatcatccaggtacaccttcccaaatataaaaagggaaaagtcagagtcttacatactctttatttccttgtttagtttttaagtgttctttgctttctgtctttaattttatagttcacagtttaacttttttagcacaagggaattttaagacaaatatgctttgtacctatataggggcaggtgcagaaaatttacattttgattacttaaaatgactccatcagcattcttgggttaaggacttattttctaaattgaatacccttatcttttaaatttatcagcaaatgatagtcaaaggctacttaaaaatatctgcaaagtataatgtgtgttctcaatcactatgttttggtatttgagaattcatggctgtgaacagaaaggtatcttatctcagtatctgagtgaactaagcctagtagaataattttataggatatttaacacattagtgattatggaaagcattttgtcactttaattactatccctatcacctagtgatgtttaagacattttagatgctcaataaatacttgaatgaatgaaaggaaggtctcatagaaaatgtaaaattgtgcttgttctatttgaaaatattgttttcccttcttataacttattgctccattttgtgtctcatttagttcaggagctaggagctaccttatgtccaaaatagtttcgtcacattaagctaattccctttgaacatgcagttcaatttctttaattagctttaaaaataagggtcattaaatcagagtgccaccatcaattactgtgcaagggtttgcctgttcaataatgcatcagagctgtgctttaatcagtatttcactgaaagatttatgaaaaaggaggcctctctaggttccaaacttgcaatggagtcctatcatgtataaaaaatttttcttgtgattgctatcatgtttggtgctgtatttcattgaatgctctcagcatcctatctttgcatttcatagttgggatcatttccagagagtgttttacagcatttttggtaaattcacaagaaaaaaagcacatgtttttgtcctgcaagaagaaaatacaaggtgcatgattaaaaaaaaaaattctgcatttctaagaggtgcgtctgttacagcaaattccctgaagaatggcttatttcttgtttctcattacaataaggtgtagcaaataaacaaaaaatatgggaaactgaactagcaatgtatgtcagtttaaacagtttaccaaaactagggttgcaaaagcagtagtcattttttcttactaacctaatttaagataacatatattttagcttttaaatgatataatatccatcaaacataagtattttggtcattttattcttactgctatactgtgtattgagaataagtcaaaataacagaatcataaaacagattttgataatctaccaaaaaatgctttatgaaataaagtttgatcctaagcagtcatttttgtaggtaattacagaaatacttatgcaaaaattgatggtaaccactaaaacaaagctattaatattaacttccttttcacttaacaactcagaaggaatagatgaaatataagaagtgatattttaatgctttatagcacatttagttaaatgaatatatgtatttgaaaatattctattgggttaaaattgagtgcattatcatattgttatatggtcaaaatattataaatgttattattgaaaagaagtataagtaatttataatcttgaaatctcataattacattagccttgtaccagcatatatcaaaatagtgtgaaagtatggcataattattatttccaaaaaagaatttggtatgcaataaaatgattaaaagttttaaaaatttataatatttggggaagacaaatctaaatgtattacagagattaaaatatgtttgttgaggattcatctttacctgagcacttgttaaaggactccttctgggaatgggaattagccagttgaatccacatcaaccctgtggagggccacacatcacagtggtagaccaactttgtcttcagttatttagttcctgtgctctgcattcattttaaggtgaatgtctggtgaatgaactttaaattcatagttgcggatagacaaggtgtagctttatgtatacaggctgtcgctactacttgccttctttaagaggcgtgtttttacatcattcactggaatgccccagagtttttgctttgattatatgtcttattttgcaaactttgaaaacttgagaaataacatacattaaagggaaaaagtgtgcccaaggatttttttaacaaattaaatatacatgtaaccctcaccgaaatcaagatatggaaaatgatcagcactcataatttgtttcacctttcagtcagtcctaatcctcccctttaggaatcactattttgactttatctcggagataagtattactatttgaattttatgtaaatacagtctgagcatatatgctttgtgcctgacttctttgtcttgtctttgtgtctgtgagattcatttgtattgtatgtgtagtagtagttctttttcattttctgtttgaatattctagaatatacttgtccactcttctgttgattgcagcttttggctgttataaataaatctgctgtaaacttcctactacctatgttttaatattcataagtgtgtatttctcttggatgttcacttaagagtgatatttctgggtcctaaggtatatattcagctttcgtggattctgccaaactgttttccaaagcgattataagtccaactctctcacgatatttagtgtatgaaagttcttgtggctccacatcaatgctcacacttagtactacccactttaaatttattttctccaattttaatgactctgggggatatgttatagtatcattttattgttttaatttgcattttcctgatgagtaatgatgctgagcacctttccatatgggattggtcatttggatatcttcttttgggaagttcctggtttttttttttttttttccacccatttttctattgatttttcagtctttttcttactgatttacaagagttctttatatttcctgaatacaacttctttgctggatatttgtattgtaaccattttctcctttgtgttttgcattttcactcctttaattgtatcttttaatgaccagaagttgtttttattttaaaaacaaattttaaattttaaaaataaatttttttctttgtgggtattgctttttttttcttttttgccctatataagaaacctgtggctacttctaaaatacagagattttctctcagaagctttattaaagttttaccttttaaattttgaatgtggtgtgaggtagaaataaagtatttatgtgcatgtgtatgtttataaataattttccatttgaatatccatttgacccagaaccatttattgaagagatcatcctttctcccttgcattgtcactattgttgtaaatcacggggtcatatatgtgtgggtctgtttctaaaccctatgttgtgttccaattaaacaaatttaatcatatcttgaacagatttttagaaaacattttagtttctaattgttttgctgggaaatacagtttattttttggtattgattttacatccaccaacttactaagttcacttattacagctaatggtttatttgtggattcatttggatattcagtacacacaattatgtggtctgcaaataattacagtttttgtttcttcaattctagtctttatacttttaatttattttccttgccttattgtattacctaaaaccttgggtctaatattgaatagaagtggtaatagcatggattttatccattattttttttctcccatcttttgaactgatcctgtttttctcctgtattctgttcattttgtgaattagactaaacgattttcaagtgttaattcaaccttacatttctggaatgcccaacttggtcataatcattttcctctttaagtatctttgaattgagttgttaacattctcatttagtatttttctatttatgtttatgatctatagcttttctgtctagtataatccttgttagagttggcaattgaggttatgttggcctcaaacaaaaagtagagaacaattcagccttttttttgtcacaaaaaattgatgttaattcagaaaaaaaaaatgggaagaatttaccagtgaaactctctaaacctgttcttgttttatttttgcggggaggggggatttttaatagtgcatgcaatttcattgatagatataaaattactattattattatttttttaaatagagttgctctttgtcacccaggctggagtacagtggctcactgcaacctccacctcccaggttcaagtgattctcgtgcttcaacctcccaagtagctgagattatgggtgcgtacaaccatgctcagctaattttttgtatttttattagagatgggtttttgccatgttggccaggctggtctcgaactcctggcctcaagtagtccacccacctcggcctcccaaagtgctgggattacaggtgtgagccactgcacctggccaaactattgatattttgataaatgtgttaccaaggaatttgttcatttcatgtatttttttccccatttttttgcatatggttattgcatgcctgtagagtctaattatgttccttttttttattcccaatgctggaaatttatgtttgctatattaatcagtattgttagaggtttatcagttttattactctcatctttgtctcaaagatcaactttttgacttttttgaatttctttattgtatcattttcctgttttgttgatttttgctgcaatatatgttattttcttccttttctgatttggttttctgttttattttagctttttgattcggatgcttagctcattgacattttgtctttcctttttttccctcttacatctaagtctaagtttctaagcatttatttagctgcatatccaacatttctggatgtagtttgcagtatatgcagtatgtcgtatcttcattatcattcagttaaaaatttgttttaaattcctccctcccgtttccctcctctccctctgttttgtttgtttgtttttacttatatagattaacctagctatccccacaatcaagatcagatctattttatcaccacaaatatctcccttattctattcttttatagtcatatttaaccactttcttacatttgtaacccctggcaacctttaattcattttccatctctataattttgtcgtttcaagaatgttataaaaataaaatcataatgtatgtgacctttagaaattggcttgtcttcatgcagcataatgcccttgatatcttgaagttgcatatattaatatttttcttcttttatttttcagtagtatttcttattggatttacctactgaggggtattttgtttccaatttttcactattatatataagctgctgtgagcgattgtgtatggattttgtgtggacctaggtttttatttctgtacaataaatatccaggagtgcaattgctagattgtatggtaaatgcatatctagttgtttttagaaactgcgaaactatttttcagtggggtgtaccattttacatttccaccagcaatgtctgagcaatccagcttctctacatcctcaccattctgataggtacgcagtgatatttctttttgattttagtttgcatttctttaatggctaatgatgctaaatttcttttatgtacttatttgccagccatatatcctctttcatgaaatgtctgtctgtttttttctgcccattttctagttggattttttttactattgaattttgagttttctttatatattctagatatgagtcatatgtcagatatatgtatccttgacttatttgattctactttaattagtacttttaccactttccaaaaaatgcaaggaacttaaaacacttcaactttatttaccctactcctaccttttgtgcaactgtatgtactttaattacatatatatttaaagctctacaaatttaaattatttactggtttaaggaattcctactgatttacatttttaaactcctttttgtactataatactttctgcatagggatcttctgagatttaattttttttctgcccaagattttactctggtatttcttttatacaaatctaaggtaattgtgtgtggggtggatgggggtgtgtgtgtgtgtgtgtgtgtgtgtgtaagtgtggtgtgtggcatgaaaaatctaggttgtcaggtatttttatctttttttttttttaaatcatcttgttaacatctgacctttattgtttttcttgagaagtcagctgttggtcttattgtgctttgaagattagatacctttttgctctagtggtttttaagattttctttctgtcttggcttttagctgttttgctatgatatgccattctagtcagcctctaagatggccagtatttcttgccttctgatattcatgcttctgtatattcccctgtttaatgtgggctggatactgccttctttgcatcaacagagtatggcagaagagttggtttctttttgatacctttaaagtggtttatttatttgtttttaacagcttttatacacatttttaattgttctcagtggaaaggttactctgatacagttattcacacagagtgaccttcattgtatatagaactaaagataaattatgttttcttggatgctactctagaaacagctctcctagcacacctgcaaatgaggaacttcctaagaagatactgtccatttcttctggaaggcatattgaatgatacccagggcactaaacagttgtctattcagagatgctctagtttgtgtccttcgctagcttgtaccagctaaatgtgcatttctcaaaaagtcatttttaaagctatttgtaccagttgtatttattttataattgcacaactttattatataatatacaaatttatgacaagtttttctatgaaaatattttgataaactatataggtgaattgataaaacaattattggtgaaattgttagttatgttaggtcaaactgtaaaacatatttatgataaaagatgtttatgattatgaaatttgttacaggctgaggatcccgcacaccaatggctaatggctatggtatgttggcatagtaaaaagtatttgggcttatgctatggtaagcaagattgaacaaattgcatgtatgaagaaatcctatatacaaatgaatatacatgtgttttaagttaaaataaggtacatattttttctttgttattttttctgctttacttgaccttttgtagtatgtgaatcaatactggttctgactgcatcttataagaggacttttcctgtacttttaaatacttagaaggtgttttagtttgccctttcacatagaatttgcaaacttttaaatcgaataagttgtataatatttaggttatgttttaggtaatagcactaattaaaatccataaattaatatatgtttatttgctaaatacataaaagccccctttagactgaaatgttcagccagaacttaaacagaaaacagataattatttggtgactcttgctcatttactaacaacttccataaattatacagaatgtttatctgtatataaaaattgccagatatttatgttttcttttgtttattttatattctataaaccaaggatgagaatcaagatcttttcattaaacatttgtggcatgactgctatgaacagacctatcaaggcaaataagatacactcgtattcctcaaagagattatagttcagaaagccattttaataaacaattacagcataatcaaaggtgcctttctgctttttcttatgagtataaatttgccaatttataaataagacttttgtatggtggtataattaaataatagtttttaaatatgtgatctctataacctctgcttttacatttatgtagacctcaaggtcagggatgaagcaggaggagtcattgaccttcctcaaacctttaacaaattaggaaatgacaattgatattaaatacttttatacagttctcattttgtaatattttacttgttctgctctcactcactttactcttagaatgcctgtatacctactctttcataatatcagagcttctcttttaccatgaatctcttacagacagactctctattctcgggatgcgatttgttcattctggcttaccatagcataagtccaaatattttttcctatgcaaacataccatagccattaggtcttggtgtgtgggatcctcaggctgtcacaaatttcattatgccatctgcttcaacctgagctgcgtgtcttctgctggcaaactttattgaagttgccatggctcaggataaaaaaaaaatcaatcttggcataagaagcttacttttgaaaaaataataattgatcatgcctgctatagattttaaaataaacatttaaaaggattcccaaaagtctcttctcaacacattgatctctttttcatctgtgattgtagaaagctaatataatggttaagttattggtaactttggtaacttaatgagttttctgttttatttttaaggataggtaacaaactcttatgtatagattttggtgacatattgtgaaatattttgatagcttctgtcagtggatgttctttacctaatgttttattttaaatgatatctcaaatgttttgtggataatacaaggactgtatgttttctgtataatacaaggatgataggaacaccgtgatgaaaaaaaatctaggtcacaaacaacttagctgtgtgactttacgtaatttcatcatccttagcattgagatgatacttgaaaggttgttcaggagattggatcagagttagatccttaaaaaatagataaacattttttttctgccaatgtatgttgaacaactctgtataaggcattcttctagagaacgagggcatagtaaaaataaaatagtcaaaaatttccactggagagtttttgcattctagtcggtctccactgactgggatgaaagcttcatgacagcagggtgtggatcaggtggtaatgagtgccatgaattaaaacagggcacagtaagttcgtggagtataatggtgctgtcttagataggaatgcgaaggaggacttttctgtggtgagattaggcacacctgaatgaaataaggaagcatgtggatatttggggaagaatatacctgtttggtagagtgaacagcttggcactttgaggcacagtgaggaggggagcacagctagggctaagtgggtgagggacagactgctaggagatgaggtcagagagtgactcaaaaacatcaatgaagtaagctttctgataagtagttatagataaaaagtcacaatccaggcacccaacataaatatgaaattaggattgactgcattgctttattattatttagatttaacttcaaactcttttaaaaggcacacacaaataattatagaatcatttcccaaagtgggatgatcttttccgttgttgttacgtgtgtcattgtacttggagttagccagacagcacgatttgagggcacagtcctccagactgccagtgctgccccacacttctgataccaactgtggcgagttagggtccagctacaaagttaaaggtataaggatacacaaaaccaccctcacttatgatgtcagctgcaaatttgcgaggttcccctagccaccttgaggtttcataattcactagaaggtcttagagagtctctgaaatctgttaaactcatggttatgatctatggtagggaaaggatgcagtcaagagtcagccaaaggaagagatgcgtagtgcagattatgggaggattccaaactggaagcttccattttgctgggaaagtataactctcccagaatcgatgtgtgacaatatgtatagagtacagccatgtgtcattaggtgatttcatccttgtgcaaacatcgtagggtatacttacccaaaccttggtgatatagcctaccacacagctaggctatttggtattgctcctagtctaccaacctgtacagcatgttactatatggagtactgtatgcagttgtagcacaatggtaattgtctgtgtttctaaatatagaaaaggtacagtaaaaatgtggttaaaaggtaaaaaatggtacacctgtataggagacacgtaccatgaatggagcctgcaggactggaagttactataggtgaatcagtgagtgagtggtgagtgcatgtgaaggcctacgacattactgtacactactagatagtcaatatactgtatgctactagatagccaatataatggttgagttattggtaactttggtaacaatgagttttctgttttatttttaaggacaggtaaaaaactcttatgcatagagtttatacataagttataaatactgtacacctaggctatagtaaatttacaaaaacttccttcaataataaattaaccttagcttactgtaacttttttttcctttataaagtcttaatttttttttaaacttttgactctcataatagcacttagcttaaagcacaaacacatgtatagctgtgtttgactgtgttgcaaacccaggaagattacctgatcttggtgttcagcattttttattggcgtgttatttcataggtgtgattgattgccctgcctatatgattaaaattcagctccgagtttgggcttatatcatgtggccttggggcccaccatgaagaagaaagatacctcatcactcaggaaattctgagaggggaaattctgagagtttagaggttacttcataggatctggggacagaaaaatatatgtgtggatgtatatatttatgggtgtgttttaatgagtaccctgaagttgaaccctggcggtagtttttgaattttcccatctaataaatggtgctgcattgaacatttagtgatgcacacacatctttgtgtattatcctaatgttcatccttgaaataaatttcccaaaatagaattgctggattaaaggatttggacattttgaaatttcatttgtatgtccttgtacccttgggatattttctatgaaatagtttatggaatgtcaaaattcttaataatccctgcattactcttaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccaggtaagaacatttctttctgttagttattgtaatacctgtagtaatttaagaatgtgatcaagttatggataatttgaagaatatagtgacatttataacatctgaaaacattggaacaaaaagtcagttttgtgggagtttagatggttcagacgttttctattacagttttatcatcatttaaatttgagtattatatgttgtattatagaaatattcttcaggataaagtgctaacaattaccttggaaaaatgttattcaatttcttttttttttaacaaagaaatgattctgataagatgactgttactgcagtaattggcttttaagtttttttttgagacatgccttgctctgtcacccacactggagtgcagtgttgtgatcatagctcactacagtcccaaattcctgggctcaagggattctcctgcctcagtctcctgagtatctgggactatagatgtgtgccaccacacttactaagttttattttattttttatagagatggggtcacattatgtagcccagtctggtccctaactcctggcttcaagtgatcctcccaccttggcctcccaaagtgctgggattacaggcgtgaaccaccatgcatggcctggcttttagttttatttcttgctttgtttcctaaacagggtcgccatgtagaagtttttgagctcctcaaacctccatctggaggccttgggtttagtgttgtgggactaagaagtgaaaacagaggagagctgggaatatttgttcaagagatacaagagggcagtgtggcccataggtgagatggtcgcggcgtcttctttgtttttgatcccacattctgaaggttttggttactatgcaggaatttagaaaaataataatgaatggcaacaaaaaattgaacataatctgttattaaccagtttttagaagtcattaacattgttgtgataaaatagcaggttctttgaaatgagagtagcttttagatatagtcataacttaagttttggtaaggaaagaaaaatttgaggataacattattttcattgttaattaaatgggctctttttgattagatttttaaaattaccatgctagaaatgacccataataattcgagctgcattttttttatgtacccagagcaataatttaatatagttgcccctcagtatccatggggaattggttccaggactcctgcaggtactaaaatctgcaggtgctcaagtcccttatataaagtggtatagtatttgtatatagcctgtgcacattctcccatatattttaaatcatctttaacttataatgcctaacacagtgcaaatcctatgtaaacattagtagtcatattgtatttttaaaatttgtgtgatttttttattgttgtggcattattttttttgagtatatttgatccccagttggggatctaatctatggatgtgatccccagttggggatctaatctatggatgtgatccccagttggggatctaatctatggatgtgatccccagttggggatctaatctatggatgtgatccccagttggggatctaatctatggatgtgatccccagttggggatctaatctatggatgtggaacccatggatacacaaggccaactgtatagatatatccactttcatttttagaagatgagaatatccaagatgtaatgtaggctgagtaggtagctgaaataaagagtacttttatatgggaggggttcagtaggagtagcagtgaaataaccttacgagagttgatgacctgcagccaaggcgtgtattttttttaaagtagaactgcaggaaaaagcttagagtgtgggaattaaaaataggattaaaaatgacttgaacatacatgccaaagaagctgtcatttccttgagaactctcagattgtcttttatccccttttgcatccttgatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggtgagtacctaaaattttcaaaaggaacagaacgtatttttcaagttgtttttggttatctccaagtttctaatttgtgtagggtctttgcacttcttgagtttttgtctgactattcttttatttttccccagcctggaatatttgttctttaagcatgataaagcttctaagttctaaaacaacaattacttttctttgtgtagttttgtcctttgacagcattccttaaaaatgaaaaatgtagtcctttaacaaaattgactttatctgtagacagatacaagcttgattttgctttaaaaattatacaattatattgttagagttagctgtcagtaacttttaagaagtcatctaatttggaatcctgcctcaaggcaggattatgcagaagacattcttaacatgtgacctttttttttctttgaactttttctttttttttaaagaagttctacaaaagatcttgcaaatcaatgcctgtctttaactgttgaagtgaaatcattatgatgatatattgataatttcaagaatgattctgtcaatggcacttacattctgttgaaagggaagtataccaaatgaaagggacattgttaggactcattattatgtctgaatttaattatttaatattaacaaaataatcgcaaaaatttctactgtaatgtaaaatggtagtgctttgtaaatttctacaaattcatatatgagctttgtttgtaggttcactggcaacacatggaaacgattgaattggtgaatgatggatctggtttgggatttggcatcataggaggaaaagcaactggtgtgatagtaaaaaccattctgcctggaggagtagctgatcaggtaggctacatcaatagatcttttatgctattttatcaaataatatgggtacatcttttacatttttttgttggaaagaagaaactttggccttaaatgatgccaaagaaattgagttagaatctttcgttttattgagtgtccctaaaatgttgtcttagacctaggggaggaatacctttgaaaagggacagtaatcttaagttatagttttagacaatgagtttaacacttttgaacctcagactaaagccaaggttatggatttgataattgtggaggtagctactatttgttttatagtcataattcgtatttatatacctagtcagctgttttatagtcacagggtattgtgggaaaatatacttttgtattcaggcagaaaaacaacattcaccttgttcctttagtgatgggtcattggtatcatctttgtgtatgaaacacagcctgttttttatcacttgagtagtttattgaggcattaccatttatgatatgtgacattgttgcaatatatgtgagaaaagatttaacacatttgttatgatttatatcttaatttgataaggcttactggtttaagtaagttttgccttgattataactttttaaaaaataaagtggttgtttatacatgtgtgtttgaacttaaagtaggaagtccagctcatcaaatattccctgtattcataaatgaaattcctgtttaatggcaaccttgtcagtaggggtgttaacggtaatataatagtatgcaaatttttcttccttttaaacattagttagcatctagcagcatcaaatgaaatgtctctcgttgactagcatgtgatatttacatgctttatcttcaatgtggagctgcactcttcaatattgtagctgtctgcatatcacctttaaaattaaaatttaagttaattaaaattaaatgaaattacaagttcagcttctcagttggactagccacatttcaagatctccgtagctattgtattgagtagtgcagaagagttccatcattgcagaaagttaatggactgcatgtgtatggaggctcataagactgcttttcactcctcacatctttctgaattttcacttcacaagtatttcacctgcacatgagttcttttgggacatttataatagaaatagccaggcagaaagttgtgatattaatataatgctttcttgtggtttataccacattttaggtaatatatatttgcatggtgatttatatacaactttgcttaagggcattttcttctttccctccaaaaaattcacaaaaaggcatttaggtagaaatcaaagtgaaaagttcatatgaactcttggtaggtagaatcaaaatgaaaagttcatatggactattgatttaaagactatatgtgaatttcatttattgcatcacactgaatgatgctaggatgtttcaaaagacagttaatattatacccatgtgttttattttatgtcctgattggtaactcatattattgcttttctaaaattaatcccttctcatttaggatttatctgttgcagttaaaataataatagtctaattattcaatattgttttactcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacgccagagttgcgggtaagtagttaagagtagttaatgtgaaagtcagagaaataacacttagatgacgacagtgatgtttacttagaaactagacttactaatgttcctatattagtgctaaagaatggaatgaaattcaaatgtagggatgctttagcactaatgatattttattaatcaggaataatgtgtaaaacaaatgaaaaataggttgcttaaacatgctagattattttacatttttatttaagcagcatatttatgaggataatgttttaaagtatgggtaaaagtttaaaaattatttggtactgatacctaaaatgtttaattctgtctttttctcagttagaagactctctgtaaggtgggtcatagttctaatcattctctttcatcaactttcccattagtatttttgtttttgttttgaatgtgtggaggttgaggagtgggggcaggcttggtgagtatgaataaggcttactaaaaccttttagtgttattgttttaaagtatgtcttagaactgttatcagatttgtaataagtagtcattattctgacccagttatataattttttaaacaaaagttattcttttggtgttataacaaaaactttattcatatgcatagcattccatccttgtcaacttgatatgaaaaaagctagagaatttcaaaattattggaaagtagtgggtatctcagcagatttacaggtcgcaagactacagaggataaatatcaacaaaataatttatccagaagtctcttaaatatttaagaattacacccagtttctagataagccttatagtaaatacacgtcctatattcttttcccatagatgtaaaaaatctatgttttgttctattaaagttttttctaagcagttgctacaaattcttttttaatatcctaacctcctccacaagccctttaaaactttattagaacacttgtaatttccatgattctgttgtttttaggattgaatttggttgctattttttgcaaagagaaagaagtaaagaatgcttgtttatgaaagtgtttaaatggcattcttttatggtaaacaaaacattttattcagcgatatataaatgaatgcaataccgaaaaccacttgatgtaattgaaagcttagaaaaatatctgttctgtgcatatcatcatttctgaagcttgtgccccttttaaaaccattcgatagtcaaattgccactctctaaaatagcactcgcataagtcttattaaaaatagaaaacacatttgtttcaattgaagcagatttcatcctgtcattttcttgtaattatctaaactttaaacttttgctaagtttgcacagataattatgtgcaatgaaaaaaataaatcaaactttactgtaaaattatatctcatttaagtggactgtcagagtttgtttaaagaaattagaaaacatcagctagccccaacctgactgtccattagaatctatagctttgatttctttgtgctcttcttaaggttctctgtaggatctgctgacaccatgctaatacatagtaccaatagcttattgatgatatattgtaccaatcaagtaatgcttaattttagggagacttgctcttcagtccaacatagaatttgtaacaactctacacattagagaaggtggcatctgagaaacccactttcagttatcattcaggatgctgaattatgaggaattatgaggaataatgaattaagacatgtagagtcttaattctgagttacacacaaactgctcaataaatggtagctggtctagttgttgttattcttttcctgatagttgaccaaagtgatattttctttctagatgaagtggcaaagctagatttaacttgttgatctgaattcataacattagttctttcagatgtactgcatcctgacttctccagaaattaagatgagccatctctgaaaatagaatttgctaaaaaaaacctgtttgatttaaaatttattgtacgcaaacaataatgtattctctgataagggaaggttcaaccttattcctgcctgatatccctttctgagcaaaaatatgatgatgcctatccctgttttcaggattaaaggaatcgtctctgctataattctttgctagagaattaaagtaggcctgtggctttattttatcatggtttttttgtttgtttgtttgttttttgttttttgttttttttacgtattatttcactgtatatttattgattttattttaggttgatgcttctactcagaaaggtgaagaaagtgagacatttgatgtagaactcactaaaaatgtccaaggattaggaattaccattgctggctacattggagataaaaaattgggtaattttaaacattaagtattcttttaaacttgacaattacctctgatatctatctcttataaaatattgagttgatattacatgtttcaggttgttggataaactggttgaaaacttccttaggaataatttagtgtaggtgactcttatattgtatttaagacagacaaaacaattatcttattctttagcctgtgtttctactagatgatacgtatttattctgaattagagctttatagttggagaatcgaagatggatattctttgaatgtgctttgaaaattgtgaaaaataaactatttctaatcttagaaccttcaggaatctttgtaaagagcattacaaaaagcagtgccgttgagcatgatggaagaatccaaattggagaccaaattatagcagtaagttacacatttaacaatagctttgttaattttcatggttgagaattgtattctcctagtttacttagttttgagagctagagttaactctgtactaatttaagcttttttggtgacttgaggctattattacaattaccctttctattattttgtggaagtaaaataagggtattggatataagctttactcatctcagttccaaacgggagacttccttcttgaataattcctgatatatctaatttctggttgtaatgaatttattacattaatattacacttatacgttccttgcagatactccagaggtagagaccagatgtccagtacctttagggtattggaatatgaattagggatgcctgcattgtttttttttttttaatcagcagaatgatactgttattgttggctttatggccgcggctgctttcagccctgaggatatataagaatgaaaaaaaaaaaacctagcttcttgtaattagttcaagctatcattgttatcgttgtaacatcaatgtgttttaaacatggctattcaaggcactgtacagaagagcccaactttaatttcagtgttcagttgataccggactccccagactgcagcctgaaacagaaattcaagagaccctgcaacaaaacttccttatcaaataagtttaagggaaaactgcctacaatatagtcttgtatgaattcacagtgcacatagaaaaattgaagacagctgggtgtcttcactgagctggtggctcatgcctgtaatcccaacacaggcagatcctatctctaaaaaaaaaaaaaaaaaaaaaaaacaaattgctgaattgctgggcatgatgttgtctgcctgtagtcctagctacttgggaggccaaggtgggaggattccttgagtctgggagttcaaggctatagtgagctatgattgcaccactgcactccagcctgggcagcagaatgagatcttgcctctaaaaaaagacaaaaaaaaaaaaaaaaaaaaacctgcaatagagaaacctgtttatctgttttaccttagtgtttactaaacttttgtaattgtgaggtctttatttttccaaacatatattcatattctttgaaagacatcttgagggaatgctgatttatcttattaggtatttgtttatgcttaagtttctgttgttcccttagaatcttaataatagtgagaaagtaggatattaaggtagaggagtccttattcatagcaatattattcacactcgccacgacatggaagcaacccaaatatctatgaatggataaacaaaatgtgatatatatatatatatcatatatacacacatattgatatatatgttgacatatatagatatatagacacatattgctatatatacacacatattgatatatatatatcaaaatgtgatatatatatatccaatagaatgttattcagtctttaaagagaaggaaatcttatcacatgcttcagcactgaaaaaccttgaggacattatgctaagtgaaataagtcacaaaaagacaaatactgtacgatttcactgatatgaagtatctaaaatagacttatagaaacacaaagtagattagtggctcccagggactggggagaggggaaatgaggagttgttcaatgggtatatttctgcagttctgcaagatgaaaaaattccggagacctgttgcacaatgatgtgaatatacttagcactattgaattgtactattcaaaatgggtaagatggtaaatattgtgtttttctaccacgattttaaaaaatggaggagtcctttatctctccctttaagtccacattataactccgtgagtcttcttgggttttgttctgtgaaactcctacctacacctgttcacctcttcagatctacactaaagatcaagttgtgcttgccacctcatctggctatatgcccgaagtgagctttctctgtgtatctccattttaccatacaatgtaaatgaattactgtacatgtttttgttttgagggaaagtgaaagacagaaggaatacatacggagtctaaatccatatctgatgctgaattacaaattgaaagcatagctaatttacttttttctcctaagtaatctatattaatcaattagaaaacttttaaaaaaataagcttgattgaaatgtaattcacataccatacaattcacccatttaaaatgtacagtacagtagcttttagtgtattcacagagttgtgcgttcactaccatggtgaattctagaacatttttcagaaccctaaaaacattttcagtaccccttagcagtcaccttctcccccattctcccagtcctgggcaaccaccaatctactttctgtctctatggatttgcctgttctggatatttcctgtaaatggaatcatacaagatgtggttctttgtgactgactcctttcacttagcataatgctttcaagtttcatctgtattgtagtatgtttcagtcttcatttccctttattgctgaataatattcctttatatggatataccatattttatttacccattcatcaattgatggacattcgggttgtttctactttttagctgttatgaataatgctgctgtgaacattcacgtacaagcttttatgtacatatatgttttcatttttcttgggtgtatacttaggagtggaattgctgaatcttatgataattctgtgttttaccagttaccaaatgccctgattcagtttcttcacttacaaagttgggataaggaaacttctcttgtgtgatattcaggaaaatcaaatgagtattttattaacaatatctgatagcagatatctgatagcagtttaataattaagcagatattatttattgagggctatcattgaaagagtctcatgataacttccccctaaatttgtcattatcttcattcttatataagtggaatctcaaatataattcctcttaggcaaggtcagtgatgaaggaaattgttgatgcaaaggtggaagaatcttttctctgaattgttttcttgctttcaataaaatcacttgacttcactcatcaatattctgatttttaatttttagcaaacattcttttactacaaagatataagcattttaaattcctggagaacatcatgcaatgcttttgaacatgtattaattttttactaaatatcaccatcttgtggacttttgagatatttgcagtaatgttcttcacatccagttgcattttcacaactgcagtctttgtctgttatttgttcgatttttgttttgacagcagctattaggagtataatctatttttattttgtagttgttgaagtgatgagattaagaaattatttcttactattttgaagagttattttgtaacttaaaaatattttgttataaggttcttgttttacacattgtgttctgtggacccctgggtcaacagggtttcactgtaggcattacagtgacaaggaatagactgaatgtctccatttttcccatttcatatgttggtattctttaaataatttgactatttgacaaaaggagtctgttgttttttcaaaaagttgaacaaacttgtcattagataaaaacactcattctttttagtttgatattcaatatgctaaaagcagtaggaaattatgattgataaaaattattaaataagcatataaataaggaaaagtgtcaaacgttgcctttggttttctgtgactgtgttcatagattgaagttctctctttatacgtataggatatgttggaggaggccctggcaacctaggttgagtatgctcaggggccagattttgtaagttgttccaactagtatttctcccctgtaattgttcctgttaattgcagtgtctgcagtgcacactacgaggatgttggctctcttctttttttttttttttttttttttaaaccttgaccaggtggtcttgaactcctgggcttgacagatcctctcgcctctgcctaccaaagtgctgtgattacaggtattagccaccgcacctggcctggatctcttcttttcatgagatagcacataggcaatttgctgccattatactacctagttctactgcactcttctctgtggtaccatgggttctgaactgacttcttgactctcttgtgataaaggggaaccagagctaaccaggaccccttaggcttcgtgactttggctcatatgtagcatgggtgtgattatattgaacaaaaacctctcccagaaaagccttggagatttttatgtttattactcacttctttactcttttaataaccagcttctgagtatcttcccagtacaaagtgccatgtggtataattcttggaaaatagatcttatttccataatacagatgaaggtaactaagacatttgaacagaagtctaggtttaaaagttcatgactgttccattatagcagtttcttctgtgctagtattattctctgtcatttgagtaaggaatacattttaaaatccaagtcatcaagttcagaagataaaggaaaaaaacacagtttttaaacatattttaagttgttattaaataaacaaaatcatacacattagatttttctaaataaaacttcacttttagatagaattgaacaataagaatgttttgcagataaaaaacagcctaaagttctatgcattttatgaattttcatggagccccaacatggagatttttgccatttttttcctttattactgtgagagtaaataacatgttcatttattttacattaatttttgtctttaaggtttaaagaatataaaatttgaacatggttaaaaagccttctcatagaaaccactcataatagccactaataatagtttatggtttaaaatttagaaaaattctatgtatttatacttaaatagcatcatattatatttgcctatacctttttattttacttaaaaatttacctgggaaaggtagttatgtaagcacatgtaggtgtgttgtgatatattgaagcaggcttaatcatggatcgttatgttgtttacagtttgttgttacagacagattattacatactaccttatatttcttttaaggacatgaaacatttaaattctattttgttgctgtaatactattatttagatttgaattttacttattttgttgctcagcactgtatcttgtatactacagatttcttagtttgaattttaaatccaattaaactcatttggctggagtgttttgagtaaactttacagaaagagaatgttttagcggactttctaaactttttgtctctgagaacgtcttgtgttgacttcttatattttgactatttagttggtgataacaaatatgttggacaaagaggatttattaggtataatcttaacttaaaaaattttgtcatcaactgccccttttaatttttaatggggaaggttcttccctttcccctagaagaactcttaggcaagtcttcatgtcttggggtattcttgtagagtaagttatcctgtggccaatcaaaataatcagacacagttgcaaattagtaataaaatttttcccatactaaataatagtctaatttcaaatgaaccccctggcatattagaagcccgctatgaactgatggcttacctagagatagagggtatatcactcagtctgtctctccccacctaatttttcttttctgcccacaccttattttggcttttatggtgtaaaagttgagagaagagaaggaagaaggaaggggcattttgtctgactgctgaaagatggctttgtgctaagtgagcctggcagatgttcagaactgactatctctgagggtttcttcttgggctcttggaagattccagtggaggtatatttggcttaattttccatgaataacagatgatggatttttaacgtagctgactcttcttcccactggcccctgatttctcagcagtctgtttcatagattgtctcttttgagtcccatcattcccttggagtcctgtagtaggtttcaaaatgacttgagcctggctcactcctgtgtggtctatgcccagacaaagtcagggaggtgagcagctcccaacataacagaagtttcctctggctccactgtcaaagcagctaaacaacctcttccttatcctcctgatggcattagacacaatctgctgcattgcctcttctgcaggtgactttggacttgaagtcaagggggaaatacctgggtgggtagggtatatagcattctttcctcttaaaaaaaaaaaaaaacttcctcttaagtttttcttaacatttaacaacacttagttcttttatgccctgaatgtgtgtgaattgtagttctttaccacctagtttaaatttccgcttggtggccctttttacaacttgctttgatataggatattaataatcatagcatctcaagcacaatttctgttttctcatacatcacactaagtataagattcttggtttgtaatttcttttccacaattgtacagataacctagtctctctctttgctgcctagaggctggtagatcttttttctttttatctttgaaatataagaattttaccaggatacattcaggtgtgaggtttttttttttttgtaatttctcatcattttctgttttttcatgtgcctttttgatttgtagagttgggtaagtttcccttctccctaatcctttctttgatttttttccccctcatttatcatcttctccttataatttcttttattagtgtgttggatttcctagctcagcctatgagtctccagccttgtttctgatcattttttatcggtttattcttttcctctgagctatgggaaaattgcatgcatgacctggactttgtttttgcagtacttaaaatcttgttgactgccttcattgtaagttttctttttcttttttttggggggtagatacttgtttcttctttgtaattcctgcttccataaatacaaggaaatgtgaactattttgatagtaagtttcaggaaatatcttttttcctgttcactgcaataacaacttcataggaagatacatgcaccgatcttcagtgtgcaacctgcttttggaccgtgatatttcacattccatgacccttggtcattctcaaaaataactgggcttatacagatagaagttgagatgggttctgctgcagattgtatggtttttttccagatgttttaagaattgacaaagtgacagggaaggggaaagtttaaatttactgtagcttcacttgattcatttgtagattaacaaaatgaagaggaaaccagtggtagaggatcacactgggggattttgcctgtttttgttttctgtgtttgctctgatagccaggagttatttggagttgtgtgtgtgcttgtatgcacacatgtgtggttaaggtaatttttattacaaataaagtaattctgtgctattacatgcaacccagcttagtatggcctttagtacttggtgtgtttcttggagttactggttaggatccacatataccatctgattgcctcacttaatgagagggtgttttttgttttttgctgaagtttcttcttacagaccagacaggctattcccacacatacagagattcagttggcctgcctttgatctggccatgcgcagaccatttctagtagaaattcctccaagttgctggtctaaggaccttggtgcttctttggtttccagttttgttgcagtgttttctctgttctattttgttagtttttctaacagggaatcagcagggtggagatagggagaaagaacagagccagatacttatgttcaagtcaccatccagctcagaagtatcatagaaggtttaaggaactgacagagtatgagattttcatctagatcagaggtttctggatttttgattgaatattccctctagtaaaaataactactcattttccctctttcttcctcactatatattcatatatattgttgttatatatattatatatatatatcctatataaacttagacattatatgctgtttacatatgtgtacatatacataattacatatatacacacctacatatacacatatttacaaagcaaatgagtttttaaaatgtttatttagaggttttattatattctttcagaaacctttgcagtaagggtactccatcttggagacaactgatctaggtctttttttttttttaatatttatttatgtaagacagggtctcactctgatgcccaggctggaatgcactggcatgatcatggctcactgcagccttttgaaccttctgggcttaagtgatcctctcaactcagcctcctgagtagatgggattacaatcatgtgccaatacgcctgggtaatttttctgttttttatagagacagggtttcagcatgttgcccaggctggcctcaaactgttgggctcaagcagtccttctgcctcagcctcccaaagtgctgggattactaggcattagccactgcgcccagccttgatctagatcttataattttcacatatttactaagttagtaaacatctgaattacaagatttagattataaaatccagatcttttctaacttagtaaacatttgagtgcctaatatggccccactatgcttggaaaagcattacacgtacagtcattttatagtcattttgcaattctaaggaatattaatgactttgaatttcagcattaaatttattgctctgctttttcaaattgtttttactgtgattttatgaattaaacaacatgttgttaaaatttatatttatctacctcagaatataatttgctttacaaataagtttttgacctatgagccaatggctctatattttaatatctatagtatggacagcaccatgttttgatgacactactataaggaaaaatgatacagagcctgtccttggagtatatagtcataaactgcataatagcagaaaatgtaaaattaaaattctgaaaaatgctatgaggaagaatgggtaaaagggggctttgacggcagtcaaagacatcaaggtagtttattatgaaaacaactattgaactgaaatataaagcaattatatgtattttctaagtaagctattgagaaagagcatggtctagagtgggctatccagagagtccaggctgaggtaacaggacttgcggagactccatggctgaagagagaactgcaagtcagaggaatggaagtgagccctctgtggctgaggggcagagagtaatggacagcatcatgagagatgaggttggggctggtgggaggtgggagcagttggcacaggccattctaagccacgttgagaatttggagcattgtcctaaggagttttctgtagaagagagggttggggagatatgatcatatctatattttggaaagatcaccgggacatttttgaatgttttgtcatttgtgaaaaggggaaaatcaaatgtatttttctgaaaagacaaatagacaggacactttttttctttcttttttgaaaggccatataaatatgaccttgtgatacatcagtgcactcagtgagcacatttatcactgtcttctataccttttaatcctgcatagttctggttccaaacttaactgtgcattgagatcacctgaggaatataaaagcatatttagaaaggagtagaagtagggcacagtggcctgtatctgtaaactcaccattttggaaggctgaggtgggaggatcccttgagccctggagttcaagactagccttagcaacatagggagaccccatctctacaaatttttttaaaaagtaggccgggtgcagtggctcacgcctgtaatctcagcactttgggaggccgaggcgggcagatcacgaggtcaagagatcgagaccatcctggccaacatggtcaaaccccgtctttactaaaaatacaaaaattagctgggcatggtggcacgcacctgtagtcccagctattcgggaggctgaggcagaagaatcacttgcacctgggaggtggaggttgcaatgagccgagatcgcaccactgcattccagcctggtgacagagtgagaaagaaaaaaaaaaaaaatagccacgtgtggtggtgtgtgcatgtggtcccagctacttgggaagatacgatgagaggatcgcttgagcctaggaggttaagattgaaggaagccatgattgcaccactgcactccaggctgggcaatagagtgagaccctgtctcaacaaaaagggaaaaaaaaggcatagaagcctgtgtcctaccctagaactagtgactcattttctggatatggtaccccagaatctatattaaaataaacagaagcctctcaaatgattctagtgcatccctgttaatactggtttccaaagagatattagggtcttactgtcaattccctgataaggtgaatacttattctccattcttttcacactaacaactatacatacacattttgtgaattggtaatacaaatatccatttatttaacatgtaacatgcttttttttttttttaatcacaggtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaaggtaatcctatgttaatctggtttttagttagacctttatattgtctccaattttttttaaattccaaagtaacttactatttcagaatggttcttaattattcagaatgctttttaccctcaactattcattataaaccaaggcgagtaaagaagtgtaataaagtcaggattgactggaaccagcaatgtgtttataaactatggagtaggcttctgaatagagcagatttctttctatcctattcattgtcaccatttctcagttggaaacaggcagtcatttacctttctgtttctgccttacttctggatgtcattgcaatgttctcactttagggggatgctcttctgcctggattatttatgtgaccttcataaaaattctaaatgcccagcctttccttgaaggaatcgactttaattccacatttagaaatgtcattcataagctgtttgtacatgaatatgtctgcaaattactgaaacccctgtgtagctcaggggtttattggtagaaatcaggcttttcgctgaaaagtgctgtttcatttctaaaattgttgaccattctgatatttatgccatttatacatattgcactattaagagacagaggggcaaatcacaggagaaatgtattcttttccattaacagaacttgcctttaagtacatatagttattgagaagtttatctctgaaaaacagattctcatgtaggagttcaaataaatatactgggtttagaaaaattcaagtacttgattatactaaagataaaattactaaaatatttttatctttaagaaaattatgaaaaagatgaagattttttatcttcgacgagaaacaccaacatattaccaactgaagaagaaggtaaacacctagcgccagcttattgtgtacttcattatttttcttttttagaaatgatttttacaaatgtgattaagcctctatggatatattgtaagttactaaaaaaaatttcaaaaagtgaagtttgtaaatccctgtttataaatgtgactaagtggtcttatggattaaaacattccatttatagctaaattatacttttgtttatcgttcacttacactttcttgctgagtcaatctattcttacttccatatttttatttgaccagaactccttaggaattaactgtttgtatgtgtggttctaatttaatctctttgtttctatacagccaacataaactaacagtaataaaattataaagtatttaaaaataaacacaggagaatcattaacacataagctcttgggaatgagactattcaattttgggaggctttttatcacttcttaatttttcaggggttccaagatttaatattgggaagtggtttggaaggtaattgcagataaattatcataccttctgggaattctctcactataaacttaggacccattaagctatttttaaaaatttagagtagcattattattattattcgtattagagacagatttcgccatgttggccaggctgatctcaaactcctgacctcaaatgatctgcccaccttggccttccaaagtgctgggattacagatgcgagccaccacacctggccagtagcattattttaatacatagttttgccagaatgttgctgccctctttttattctgttgtgctgtgtgcttcctttacctttcagattgctttaggtacttggtaacttaaactcactgaacagaatacaagactgatctccctcccttcatgtgaatatacttataccgaagctttgttgttttttaacatatctgttccttcattattggattttctgctgaaaattttgaatgagctttacaattttaaagggatatttatgtttgcagagatattccagaagttagatctatagagttcacttgtactaataacattctgccatttttacactaataagtaaagaaattatttaggctaaagtgaatatcaggaattgtaggaaagggtaaaattgtttagagcatgatacttgtgatattaagtgggcatgggtgtgggagtcgtctccaaggcgcagaaccatctattttgctttggtgaaggtagctaatgagaaatccctctctctctctctttctctctctgtgtgtgtgtgtgtgtgtgtgtgtgtgtgtgtgtgtgtgtgtgtggcaggatacatgggggtgactatagacctagaatcaggagtcccagaatcttttttaaacaaaataaagcacaaacttctaagtgactttaatgcatctgccctagtactagtcctcagacaaggggtaagatattattgcctcttccacagatattttacacatcgtgcaagcctggacaagtcatttgactttccagcaagatcagaggtttagactttatgatttttaaatatatgcctgaaatccagtcttggggcagttgtgagaaggtgagaatggagagttgttctgctaaaggttggttgaatatgaattgcagactgtttttatcagcagcacgattccccactttctccattcataatctcacccgcttaaatcactgtctagctgtgtaaacacagcagacttagaaaaaggaagtgtggaaagagataggactctgaactgaccctcctgtttctcttgcagaatcagttcaaagcttccctgtagtctgtgttcatccttgcatacttatttctctctgtactgaatttgtttatttgcttttattatttttaattgacctataataattgtacatatgtttggggtacagtctgatatttccatacatgtatacaatgtataatgatcagatcagagtaattagcatatccatcacctcatagatttattttttctttgtgttgggaacattcagcacaacatcttgctcctctggctatttgaaaatatgcagtaaattgaagagtgacatcaacaagatggcagattagaagtgcctcccacatccttcttcctatatacatacaactggaaactatcaaagacaaaaataccaccctgagttcaccagaactagagagagaagcagagaaacttcctgggcctacagaattgagaggagccatgactgataagataaatggtaattttaggctgagctgcacccttcctcaaactggcataatgccattcaaagagaatttctttagacccacagctcccaagatgagaggaggaaattggaggtagacattcattctctccactggtctggtaatctttcactggaaatccacctaggtcccattcctatgaaccactgggagttccaggagggctaaagcacttggggtgaattgggagcaaagacagaggcactgatcacagtgactggcatgtatcttggcaggtattctgcactctgataagtgggtacgccatgttgaagatactggctggttccatggtgcttctggggtacaatctgtggaaagatcctgtccttagttggattttctacaaaatcctggtcctctcatggagccatctcctggcctagaaacaactgaaaggttgggattaagttttggtgccagcttaaatcttccccaggctggagacccatagcaggacaacaataaaattctagggcagtgtttaattttcagtgctcactgtaagcctaccctagaggaaataatagcaagtcaaggagttagttccagggaagtgttttagttccagtactcatgtaaatcctccccagaatgggaaaaaaacaacagcccagcatttaagttctgatactaagtagtaaatctctaacaccaccaaagagcacttgcaaaaactggaagaggtagccaactcctcaaatgaaccatcatcaatgtaaaaatacaaggattgtgaaaacatggagaaataggatactaccaaaagaaaccaacaaacctccagcaatggacgcagaagaattgaagatctatgaaatgttgtacagaaaattcagaataatcctgttaaagaggttcagggaatcacaggaaaatatggatagaaaacaaaatgaaatttaaaaaataatccaggatcacaatgagaaatttgtttcactgtatcttttatttttatctttgtatcttttatttttatcttttataaataaaagatacaaaccttagaaataaataatacagtaagccaaaatctcattagaaagttttgattgaagcaaatttgatcaaacagagaaacttagtgagcttggagatagaccatatgaaataaccctatcagaggagcagaaagaaaaaagaatttaaaagagtgaaggagacctatgagaattatgggataccatcaagtgaactaacctctgtgtaatagggactcctgaaggagaccagagagaaaaaggcctagaaagcacatttaaggaaatagtagctgaaaatttctcaaatctggagaaagacaacaccatccagctacaggcttagaggtaaccaactatattcaatacaaagaggaaatccccaaggcacatcataatcagactagcaaaataaaaaaaaaatactgaaagcatcaagagaaaagaaacaccacattcaaagaagccccaatattgctatattgctttctagcgaagtaatggagaaatttcatgcaaatgggaacaaaaatgaagagcaggagtggctatacttatgtcagataaaataggctaagtgaagaacagtaaaaaaataaaaagacaaggtcattatttaatgagaaaagcatcagtaggtcaatacagcaagcagttataacaattgtaaatatatatacacccaacatcagagcacccaaatatattaaaaaaaataaacctgaagggagagatttactataatatgataattgcaggggacttctgcaccctactttcagcagtagacagattgtccagacagaaaatcaacagtaaaacatcagtgagacttcattgtagaccaaattgacccaatagacatttacagaacgttccgtccaacagctgcagaatacacatttttttcaacaacatatggaacatactccaggctagaccatatattaggtcacaaaacaagtctttataaatcttaaaatatcaaaatcatatcaagtatcttttctgaccataatggaataaaactagatatcaataacagaggaaacattgaaaactctacaaattcattgaaatttaatactatgcttctgaacagtgaatgagtcaataaattaaaaaggaaatttaaaaatttcttgaaacaaatgaaaatgggaacacagcataccaaacctatggcctacagcaaaagcagttctgagagggaagtttataacaacaaatacctacatcaaaaaagaagacagacttcaaataaacaaactaattatgaaccttagaagagcaagaacaaaccaaacccgaaggagcagaaagaaagaataattgtagcagaaataaatgaaattgagacgaaaatacaaaagagtaagaaaacagaaagttggttttgtaaaggtaaatgaaatcctcaagtctttcgccatagtaagccaaaaagacctaaaatagataaaatcagagacaaataggagacactataattgatactattgaaatacataggattgttagagactattatgaacaactgcccactagtaaattagaaaacccagaagaaatgggtaaattcctggacacttacagtctaccgagattataagattaaaccatgaagaaatagaaaacttgaacggaccagtaacaagattgagttggtaataaaaagtctctaattaaagaaaatcccaggacttaaacttcactgcagaattctaccaaacatttaaataactaatccagttctactaaactattccaaaaaattgaagaggagggaatactcacaaacccattatttggggccagccttgccctgattctaaaaccagagaaggacacacaacaaaaagaaaactacaaatccttcatgaacgtagttgcaaaaatcctcaacaaaatactagcaaaccagattcaacaacacattaataagatcattaatcataatcaagtttgattcatcccaaggatgcgaggatgtttcaacatatgccaatcagtaaatgggatacatcaaatagatgctgaagcagcattcaataaaattcaacatcctttcatgataaaatctttcaacaagctagcaatagaaagaacatgcctcagaataatcaaggccatatatgaaaaatccacagctaatataccgaacagagaaaagtccaaagacttttctataagatctggaacaagacaacgatgcttacttttaccacctttttttcaacataagtactgcaagtccttgccagagcggttaagcagagaaggaaatacgggcatccagattggaaagagataagtcaaattgtccttatttgcagataaaatgatcctatatttagaaacctaaggagttcaccaaaaatggttagaactgatacatgaatttagtaaagttgcaggatacatactcaacataaaaaataagtagcatacaccacagcaaataatccgaaaaagaaatcaagaaagtgatcccatttacaacagctacaagaaaaataaaatacctaggaataaatgtaaacaaagaagtaaaagatttctgcagtgaaacctacagaacactgatgagagaaattgaaaaggacacaaaaatatggagagatattctatgatcatggactagaagaattaatattgttaaaatatcaatactaccaaaagatatctatatattcattgccatacctatgaatataccaatggcattcttcacagaagtagagaatgatcatggactagaagaattaatattgttacaatatccgtactaccaaaagatatctatatattcaatgccatacctatgaatataccaatgacattcttcacacaaatagagaaaacaaccctaaaattcacatgtacccacaaatgactccaaatagccaaagcagtctagagcaaaaagaacaaagctagaggcatcacaccaacagacttcaaaatatgttacaaaggcctgtcctaaaacacacacacacacacacacacacacacacacacacacacacacacagagagagagattaaagacctaaatataagaactgaaggaaacgttaggaaaatgcttcaggacattggatttgtctgggcaaagattttttatgtaatttcacaaaagcacgggcaaccaaagccaaaatggacaaatgggatcacatcaagctaaaaagctttcctgcacagcaaaggtaacaacaatataaatagacaacccaaagaatgagagaaaatatgttcaagctacccatctgattaataaccagaatatataaagagctcaaaaaactcaatagaaaaaaaatcaaataatctgattaaaaatgcagaaaagatctgaatagacattcctcaaaggaagacatacaaatggccaataggtatatgaaaaaatgttcgtcactgatcatcagagaaatgcaagtcaaaactacaatgagatatcatctcacccttattaaaatggcttttatccaaaagacaagcaataatgaatgctgacaaggatgtggagaaaggggaaccctcataatgctgttgatggtaatgtaaattagtacagccactagggagagcattatggaggttcctcaaaaaacgaacagttaaactaccatatgatccagcagtcctactcttgggtatatatccaaaagaaaggaaatcagtatagcaaagagatatccgtacccctatgttcattgctgttctgttcactatggctaagatatggaagcaacctaagtgccgatcaacaggagaatggatgaagaaagtgtggtgtatatacacaatggaatatcattcagccacaaaaagaatgaagttttgtcttttggaacaacatggatgaaactggaggacattgtgttaagtgaaataaaccaagcacagaaagacacataccgcatgatctcacttataagtgggcgcttaaaaagttgatttctggaaatagagagtagaatgaccagaggcttggaagagtttgaggaggggtgggatgaagaggtattggttactgggtacaaaaatacaattaactagaaggaataagttctagtgttcaacagcacagtagggtgacaataataacttattgtgtatgtcaaaataggaagaagatttggaatgttcccaacacacacaaaaaatataataaatgtttaagggaatggatatcctaattatctgtatttgatcattacacattatatacatgtatcaaaatatcacatataccctataaatatgtacaattatgtatcaataaaatattttaaaaagagaatatagttaatcatagtcacccgatagtgttagaattgctcagcatggtggcttattggtgtaatcccagctactcgggagtgttactgagaccagaagtttgagaccagcctgagcaacagagcaagaccccccatctaatttaaaaacaaacaaataaacaaacaaaaacactggaacatatttcttctatctagctgtgcttttatatctgttaacctctggactgaatttaattttgaggaagtaacacttatttggggaggctagtcttcaaactaaaaatatatatatatatatagtttattgtttacagtcttttaaggagaaaacagaatcatcttattagcttaaagcataacagacctacaaaatatgcctggaatgaaagctcctggatattcccactaaaagaggaggcaactaataagaaatctgaattttttaacattttttaaatttgaaatttgaatgctaaaaaggatattgaaatttaatttagagaatagtgcctaatagagattttaaaaagacaaatcttacgagtaagaactgttatgaaatatggaaatctttgactatgacttcaaatttctcaaccagtttcttgttttaggtaagcattttaaattcagtattgtttacaaaatttgtttagtgtttttctgtccttttaaaaatttctctttttgtaaattattgagataccaattaataggcttttattttaatgtatagccttagtttattattatttctttatattttctcatatatggagttatatatattatttgttgatttcatttgtttgattttgtgaaataatagcatagtccttttttcccctgatgaactaaatgaaaataaaacagagaacattgaagacgacatccctttttactgtagcattaccagaggactatgaagtgaattctggaactgctcagagtccttactcgtttaaataaaaattagataatacatgggcactttaatggaggtaaagatttaaaatacatctgttaaaagtgagtagtgtcaaacatacaaattatagggttcttaattgaagtatttaaataattatggagatgagaatagcccatatattgggcgaagagtctgacgtgatacagcgggttctgatcagagaatccttggtacaggatgttaagatgtggagatttctgtagtttgctgctaacttaattgccttgactgtttcagggtatccattactgtcagctgagatagaagaaatagaagatgcacaaaaacaagaagctgctctgctgacaaaatggcaaaggattatgggaattaactatgaaatagtggtaggttagctgaccttctgtaattttctaacttgtaactgtatttgagcaggcagttcgagggaataatagaggcaatcattagagttccagagaagaatcaaatgtacaggccttttttagacaacctaaatatggtgatccaggtaataaaaaaaatttaggttggagaaaggtatatagtaacgaactgaaataaatgggatggaagttttgaaacttgcattttatcagtattttaatatttccagtaatagtatgaataatatagacacaaggaaggatttttctgatttttaaacctatgatttatagaaagaatcaaaatagaatgagtttatttaaaaataaaacaaaatttatcatgacttatgaacagaattgtaaaaggactcttttctactctttcttttccactcctatgtatttaccttcctgaagaggttaattctgcatactttttttcataccacttatgctgtggtgaatgttttatgtttattagtagcctgtatatctagcatagccattgtgatctaccatcccaaaagggggtctaataaaattgttataaattatcaatcttaaggtacataccataccagcaaatttcacggatttcaaaagaaaaaataaaatagtatgttaggtagaatttttcatatttcttgtaatatttatatacctctggactagaagggagaagatacaacagatgacatatattaataactagcgtttatagcatactttgtgccaagcagtagtgttcttagtatttcatttagtcctcatgaccataatcatctttttgtttgtttgtttgtttttttgagacaaggtctcgctctgtcacccaggctggagtgcagtggtgcagtcatggctcactgcagccttgaccaccagggctcaaacttttctcctgcctcagccttccgagtagcttggactacaggcatgcagcaccacgcccaactgatttttgtattttttgtagagactgggttttgccatgttgcccaggctggtcttggacttctggactccagcagtctgcctgcctcagcctcccaaattgctgggattacaggcatgcaccactgcaccttgctataatctttttttttttaaacattcaaaatgattaacagtcaaatatgaattgagtaagtatagctgttactaccattttaaattgacctaaggaaaaatagattaaggtccatcttaacagtggttaacatgaaacttcagaaattattttcatggagggatagggttaatgtggcaggtgtgcataactgagactgcagtccttcgggtggtaattgaataatgaaggagaccctttgactagccattttgttgtaggcatcagagctcagactgaacttttttttttaaattttacttttaagttctaggatacatgtgcagaatgtgcaggtttgttacataggtatacatgtgccatggtggtttgctgcgcctgtcaacccatcatctaggttttaaggcctgcatgcattaggtatttatcctaatgctctccctccccttgcccccaccaccctacaggccctagtgtgtgatgtttccctccctgtgtccttgtattctcattgttcaactcccacttatgagtgagaacatatggtgtttggttttctgttcctgtgttagtttgctgagagtgatggcttctagcttcatccatgtccctgcaaaggacatgaactaattcttttttatggctgtgtagtattccatggtgtatatacattttctttatccaaagactgaacttttaactgccctttgtgctcatgctttcttggtggcattcctagtaatctgtcaagtgcggaagtatacaataaatgaaaaaggactaagatatttatgggccttggcaagataaaggtaataagacatagatctgacttcaaattgtttgctatgtagcgatacagcataaatgaaatcataagggaagtagtgtaacaggactgactaatggacattattggatgggacattctcaggggaagtgatgcctaaattgggttttcaggggtgagaaggatttcatccagtattagatttcaaagtcaggtgatatcgcttctgaaactgacttctgcacgttatcattaaaatttgaaagagctctttttaatcaaacttttttttagtccttttatccctcagttgccttaactataaaataaaagggataaagtagatcgtctttggcatacattctgattttaatattttatttattggattctgtgtgaaaatgaacagctttctaatattcttcattatttaatgtaacagtagaaaattggaagttcattctttggttttaaggtttgatcatttttaaagaccgttgtctctggttacagcataaacccaggaatgtggttctgcgttctttgtttagcttcaaacccttttctagctgtgcagctctggtcatggtaccttttctgaacctcgtttttctacttgggaaacaagagagaaattgtacctatttatgagaaacagatgagacctatgtaatgggagcttgcggctcactgcttcctttcagtttgtaagttcatgaaatcaaaagacaccagtactctttcaaaggaaaagccccaaagctttgcagttttacaatatggtttttgaagctttgtgagaaagatgaccacttttgggtaaacataaaacataaaatgtgtgcatgagtaaaaataaaaagaatataaaaattgtggtgatctttttttttttcttttcaggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaggagctatgctgttccttctcctccttaaataagacatggaaaagcttgcaggaggcttaatgtggtgaataaattctcattttaaatttcccctccaaaggggacttgagagaaatctacagataaaaacaacccaaagcagaaattttgtatctgtgtatctgtgtgtacatttagctttagaactaattccatgccattttttatttaggttcagaaaactataaaaacagtctttgaaattttttttaacatttatttaatttttagaataagtaacgcattcagatgtttaaaatcacagagaatacaaagataaagaatggaaaagggtctccttcctgtcccaattcatccagttctcatcacccttcattaggtaactactaatatatttgcttctttgtaatctgccagtatttttaatgcataaacaagaaagtttgaatatattattttccctcactttttaaagtacactagcatacaatatatgtcattgtccaattttttttttactttataattatacaaaatgtcaaagttttatactattcttctccttgtccttttcattctttggaaatatttttattgtctcttttttccagaccactacactggcagatcaaacatagatgaaagctagtggtttttctttgagtgctttagaagctccaattccaacaatactctaaacttgcacataaatttagatagtatttccacaggtctcactatagttctgagcacagtaaactgtggtaatgactatagtaaaatttatatttaataaaaaaattgtgttcaaaagaatgttcatattatgaagtgttgtttcttggacaatgtatcttttttcacaggtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaaggtatcagatttgcatacatgaggctaacctacatatataatggaaaggctaaatggcttaaaattttttaagcatttttcaatttggtatttgatttactcacatcgcccatggcttggaggatagaatttaaagtcagacaaatctgggtttgaatcagacttgacactagctgtgggaaattgggcaaatcacttcatctttctgaacctcagttttctccttggtaaaatgtaagtcatgatgcttgtctcaaaaagttgccctgaaggttaaataaggttatgtaatcatgttagatgttaatgcatactatatacttgtttaatttacttgcagcatttctatgaagtagatgctcatattcgtctccatttgcagaagagaaaactgaagtatatagtgtgtacatagtacatatgtggtaaaaaatatttttaaataacctacccaactctgcctggcacacagttaccacttagtgaatggctaaaatatggatggacacagcatttctgtgtggataggtcttacttgtttacatactatccttttaaaatacaataaatttggcccataatgatacatgtcagataattctctgtgacattcaggaactcacattttcctgtttgtttattgtttttcattcattcgtatcatgatgtcaagaaatggagctaatcagcttttctgaggatacacaatacatagctaaagttaggattaggactttgcataatatgtggtccagtcaaatctcatttaaggtatattgagagatgatgttaggatttgatttatagtatattgaatgaatcagtacaatggaataatttggaaaattttgaagaataaaatgcatagtttagtattcatatgggtgattagaatagggtagaacaagaaacataattccaaattttatagcactcaaagtctagtaccctatatgtatccatacatgtttttatgtgtataatgggattattacaataaagcaaatgggtgtcatttgtatctgtggtcctaggctgtgcaataattgattagaagcaaagatattctacaaactagaatttcatcctcataaacacatctttctttaagttatgttcatacagatgaacaaagttgaattaacctatattaacctagtattttgaatccctatttctgtctgatgctttataaatgttacttcatttagtcctcagaaaattctatgagatgggtaactctgggacccagttgatgaatattgctcaatgtaattcagattttaaatattcaagctgcttcaagctgggggcaaatctgatttcaaatcttatgttttgccactgtgtatgttaatttgttaatgaaataaccatatgcacaagtcacagcattttagaactcttatttgtatagagtatagaacttttgcatatatccattttctcttgtttttatttatcataagaattccttttatttaatatcaaaatagctttacatttttttctgactagagatgattgaaacactgatgaaaaaagtgacagtcacgcacaatcctgctgtcgagatataaccattgcatattttcatagacctttgaatcatatatttttaatgtttgttaaaacttaggtatttcttccttcttaacaactttcagtaattactaccttaattcctaaaggtttcatgaaaagctgttgctactcttgtttgaggatgttttgtttggacagatgctgggaatatcccttttcttgtagtgttggtatgtgtgtcagctaatgcaatgcctctgaaataagagctgtctgatattatccagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggtaagtatatactacttttaacaatttttaaaggcctattgttgctatcaaagaaaaagcagatgatgatagtttataaccatcaaagatgttttcttttttctagtcagtctttcaaaatagtgatttataggattcactgattatcataaaggatttcttttaacattgagttcattgagctatttttatttcatctcttggaattggaagatacattttaggaatatcatagtgggtgttttttcgttatttgggaagtgcttatgctatttgtatttccatgggcttatttgatgactcatattttagtggtaagtcataaagaagtaggtatttcttttgtctataacatgaatgctaatttataatctgatattccaattaatatttctgctgttccaatcatttgactaaatttatgaatatacttaaattggtcaagttggcctttgtccctgcttgcattgcattctttgctaagggaggagatggtaaagcctgtctgatagagtgcagctgttgttccttacttacactaaatcagaaagccaccttggatgactccaggaagttgtgttcatagggcctgactctggagccttgttaaaacattaaggttgctgtgtgtctgaaaacacttcactaccacatactttatggccttgctctctgttctttcatttcaaaaggatgggtcctaccttcagtgcacttatatctagtagtgagttgatgttccatacagtaacaccctatttaacaatgcttttgttaataattaatatacccaacatctggcctccaataatagttataaaatttgataacttatcaaagttaaaattataattttaaagttatctgtacaatttaagaggtctactcaggaacattaggaagtgagggtgccattgtttaaggtgacttcttcctaaaccctctaaaatggagatagcttttgtctaaataattagaaattttgtatggattttttttggcatgaaaatttttaaaggcacttgagacaattactcattcgttacgatttagagtggacgacctgtagaagaattttctttgtaaaatgagctgactctttccttttgccttctgtcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccgtaagaattcagactttattgcttccctttatatttataagcaaaatggttcataggtctacttttcgctttaggtgttctcatgattgaatcgtgacttttagtagttttcatcaacgtgattactagctccattcgtataaagatttagttttgagtaatattcaaaaaaaataaaggaaagaaaatagccaggaagtttataaataaacttctaacttactggtctttggttcacttttgacattgattgattgattgattgattgatggagccttgctctgttgctcaggctggagtgcagtggcgaaatctcggttcattgcagtctccacctcctagattcaagcgattctcctgcctcctaagacctcctgagttgctgggactacagccacgaccatgcctggctaatttttgtatttttagtggagacggagtttcaccatgttggccaggctggtctcgaactccttacctcaagtgatccccctacctcagcctcccaaagtgctaggaatacaggtgtgagccaccacgcccagccttaacattttatatttgataataaggtcatgattaatgcaaaatcaaatattttcaaatgaatatggcttacaatatctataccaatgtaatggggtgttaaaaaaattaatagcattaactaacaataaaatctttaatcacagtgggataaagtagaatctctgtcagagtggcttcaagttgctaaattcagttgacttcaacacatttgctgtctagttactgcagagcaggaaattaaactttccaaaatgggttcatcagtttgtggctctcctggcagggaatagctcccaaatcataaattactgtaataatagaaacaactttatgaatccgtgctacataaagcagtatgttatattaaatgtagtgattgcaacatggcacttatcattgtattgcagttaaatattagagatgttctcaatatttgtgggttttttccagtacgtgaatatagtttgaagtcttaagaaaatgcaaacacataaatataatttcgtaagtagcaatatgggtttgttgatttttgtgaaagaatttgttaaaacagtaagctttgttaatgtattttaagtgccaaagttttgtgcaccactttttagtccacagagaatttcagtagcctattaaaatatatttatgaaaaaagaaagagaaggaggagggcaggatgattgaagaatatgttaatccaatctgaaatcgaaccaggcttgtaaaaattatgacaaaagagcactatggatgggaatgtaagaataaagataggctatcagggactctacctatttattaagattggattatgcatttggttctggtctttctgttggacagagagaaatggcaaacatgactcaatataccttttagttttactgtccttaagatgaaaccataccagttattcagaatcagtcttttttttttctgtatagttccaaaataaatttcttttatgacggtatttgatattttaaattcagtatgccttgcagcatatgataaatacctctacttcccaaagtgaggcttaataaatactaaactcacatatatgggcaaagaagaaaaacagtttcttttcccctataattcttcttctgtatgttttgctgatgccaggtgatgtaggcaggctgattatctaaatattttagcccatttcgtctgagagtggaataaatatgttagcttttctgtcagcgtgaccaagtttgtgatacgatatctctaacctgcaagttaagcagactgtggatatgtagagatttggtttttgtttcgttttgttttataagccatgctaaattgaattcccgtagagttcactaacattccttttcaagtaaattggattctttaaaataatattcttgtaagggatgacagaagttgatatttctttttaatattttgtttttctgcaacttcttttattaatacctaaaagttgcttcatttctatattaggaagtcattgtttgaccagaatattttgcagataaaaataaccggaagattattagaatattaaaaaaaaaattcatttaaaaaaattcttataagaagaatgaaaaattagtagaaagggattctcatccaacaggtgatttttatattagagtaaataatcctcattgtgtcttatcaaatgaatgtcaaatatgaatatcagattgcatacttaccattctatgttgaagtcatatcgttggaaaactttccaatttctttctcttctcgcccccctcacttttcctacctttactcttcttttccattttctttcttctttgctgttctctctcttttccatgaataccattttttccctgcagctttcaccagaagaaggttatgtttctgctaaggaggattcctttctctacccaccacactcctgtgaggaagcagggctggctgacaaacccctcttcagggctgacttggctctggttagtggctatgacttatcaagctttctttcagaaacctgatatgtcttactttgcctttcaaaatattctgaagaagtctattatattctttgttcattattatatttggaaagataaacatgttttctccaacttagttctcacaattgaaaatgggaagaaaaaccataataaatatgaaaaacatttgtgaggaaaacttaattaacgttgcattgtagcagtatgtagaattaatctttgtgccatatctaaagtttgtggagcatttgtttgctccaatttcacgcttagatatctctaggcattctttaactgtgctcaatattcagtcataaatcactgttttggctgtatttaatgaggtaataggtatcttttttccattagatattaatagtgtgagaatcatataaattggttcagttattaagaacaccagttttatggaaaggtaaaccccatgttttctataaatacatatatgtaagtatactgatttaccagaaaaattataaattaaaattttatttctgtttgatgtttaaaatagtatccattggaataaaagtatttgcaggcactctgcccttaagaaactttttcttgtagagggtacaatgctatatcaataactaaaggataaaactaaataccaggcatgaatatacatgtgacatttactcaacataaatacaacaaattgtacatcctgttcacattacccctactattagagctaggttccttactcaacgttttttgtggggcaaacattgtgcactgttgctaaaaaggaatatacttgctttttaaatacttgtttgagtttcattagactggagaaaggtttaaaacctgttaaattcttcattatgtgtttataactgcgcacatcttgctttaaaacagagtgaattatttctttgactatatatacattttgctgattgtaatttcgggggagacaattccttttgctaatatttttaaattgcaagctcttgaaatagccatttgaaaagttttggtatatgttataataaatgcaataatttcacactgtaatacttaacataccaggtaacttatggccctgctctccatgggtattatgttagcacttcaaaactagatagcttagtatatacaacgaattacatacagtactgtggtgtaaatagtacccagccatagcaaatacttcttgaaatgtcacaggatacaaatactatatatgattatttctaaagtacccgacgaaatagcattctctctagcctttacatggcttccttgaacctccttaatggataccaatcaaaaggaagattagttccacttttatgtgagcttggcatcttataatagtaatatgcgtcctgggtcttctccttagccagctaagtaatcttggactggtcactcaatttctttgagtcttagtgttttatctctacagtaaataaatgaattgattgttaatatctctcctaagatcctaagatatcagcaatatacatacaaattatattgaggtattctttcattaatgttacttaaatatgtattgtaatctatgacacaaggcttagttaatagtgtctatctagattgttgtatgttatgtatatttgtaagggtaaacctccacatagtgactcactagtgaatttgaacatgtatttaaaatatattattaggcctatgaagtatatttgaagagaaaatcacttcaaaatggcccacaggtatttttaatagttttttgtaagaatgtgacctgatataatgttataattcttctaacttctcctgggtaagcagtaagttgaaattacaaaaaaaaaattagaacatatggaattttgccaagatagacagaaaatgctggtagtatcagagaaaggtagtatatatgtcagttctgcctattctcaggtatgactttgagtgaattgcaaaaagaacttcaagctcatcataatttaaatattaatcttgattctgtgacagaagacagcaataggattattagagaatatgtagtgaaattctctatctcactctttatgagttttcttacaagtttataacttaaagcttcaccataaccagatcataattaggccccttgtttgttagtataattttagcatgaaatcacagattttctttttggtttctgcaacttgaatggttttaaaatctagttcaagataatttaaacaaaatatatagttttagtgtggcttacaaatatataattgcctagctgcctcattgaataacagtttattttagttgactaggaaaaattatgacacaattttattataaaattgtaagagttgggcatgggaactgtaagaaagtaaatatttttcttaactatggaactgtttaaacatagacttcatccaggccctttgttaattgttgcctttagcccttttattgatgaaataaaataaccttgtatgccagcactttctgctgtaggtgggctatttatccttgttctgctgcattagcagtgtctgatgagggttaagagggcatatagaaaatacaatagataaaagaatgataccagtttgccttttagtctcaagtggagattgtttgtcatatatgtaatagaacagaattcccaactgatattattgttttgtttctaggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggtacaaaggaaaagccaatttttcttttataggaaagtcttgtgtgtaattttccagagctcagtccttatggggagttgtgggaataacatattggagacattatgtttctccagttgtggattcattattggattaaagtacaatttcatttagctaacgttggttggatagctttcagattactagaaactatttaaatttagtgtctgagaatgatagatacagaggctcaaagctttgattagggtttgcatgtcagaaagaaaaatttagcatcatatatttctcaagttgtgtttttagcagtgtctactttggaaaaattacaagaataactttattttcttaatggttttaaaactgacttctatgcaaagttggatagtaaaatatttcttgcattaatttaacatttactagctaagttaaacttaatgctgtcatatgtttttatacaaaatgatgccaaagaatactttacataaaaaatcacagtgaatggtaaattatgtttatgtcactggatgtgaacgaagaatttagtcactatttgacatatctgtgccatttatattttagaaatagattattggcataaatgccccaactctattcattttcttggtgacatactctataatgttcaataagtaatactttaaaatgtatccaatgttttgggtgtgaaatggtatcttactattttaatttggatttcctgattactaatgagaatgaatgtttttttcataatattggccatttgtttttcacttttcatcaaagatctcttcatatcttttggccattttgtattgggttgctcatttttcttttgattctttgcagttgttttttggaaattgatatgcaaagcaattcaacatatatttttaatgaatatctatgtacatgtgtgtagtaaaatctaaaaatgtgttggcaggatacttctcaacttcaaaaaagaagttatccttggagaaaaaaggaagtatgagaatttagctatgtgtctaatacattataacatattatgaggaaagagagattgatgaaaatatggcagaatgtttatatctattaaatcatggcaaagagttcatatatgaatatattttctttatttttctatattggaaatataccataaacatacatttaaaattaagttgaaaagactggacaattttttttaatatacgaaatatgtattttctgcataaattgaattcaatgggaaggggtatttatgaataagttggaaagtagaatttccgtaggtctagcactgttttcctcctttcctgattaacaggttttttggccagaacattttcaaagcattttcttttatgttcaaggtgcacctgttatccttgcaaatgatgctgggcagtctccttgaaatggtttgcaaggtataatcttgagtggagcagctgctcctctctcaccacacctgagactgtctgtctggctgtgtcctgtctggaatgtgttctggaatgtgtttagtctttactggcctcagggctggaagctgagttcatctcctgatggaatctcctaatccacagcatagcacacgtcttcttcccagtggacagattgcattgtttaacttagtaattgttacttaaagggattacacaatctgcatactgagaagcatatattttacagggcaaatgctggctgtatgcagcacaacatattggcttaccgaagtctgtttgcctccttttgtatttatttattttgttttccccaagcagtttactcttttgttgaagcaaattttggcaagctcgtttatcaactgaaatacttaaactacaaaacaacaaagaagacattaatgagggtgttttaaaacacattgtgaaactcctgtgtgcttttagttttcttaaaaagtaggactgttcctgcatcgtggtaaaatctctgcaacattttatatttttggtgacaactttctaatacctagacttttgctaaaaatttttatgtaaataaaataaatatataatgtgtccttcctgtttctttgcaacaaatttatattaaaaagacacaatggtgatttgttatggaatttacaattgacaatttttcttaaaagtgagcgtacttaaaggctttttaatttataaagtaataccgtatagtatatgatttttaagaaaaacaaagatgcctctatcttgatttgaaagaaggattaaaatagaatgtgaggatctcagcaattccttagatttttgactttgctaactatgtgattatcttgtagccttaaatggcaacagggtatgaacaaataattttacctgtctcttccccttgatgaatggtcttttggccttcgtcaggtatactaccagaagtgatcagtgctaatcacctacagcacagactcttcatagagggaggcctcgctcttcagggcagcctaaacaccaaagggctgtagccatatgttggggctcttcctcacaaaattatctaatttgggggtccattctgctttacttttttaagagtatgtatttgcttaatttgattagttaccatgtaaagatttacgggaaataacaattactcaagaacctgaaaaatatacccgcctgtatggcatttggcttaatagaggcaggtcattgaaatatggattttaagagcaacatggctctagccgtgtttttcctttcttattattttatgtttgatttctttggttaatcattttactccttttcccttgttacctccaaagatatgacaaaatgcagaaataattggtttttaaattggcagacttttgtttaaaattttaacatggtttttagaacatttttttttcctattttgatttaaaaatacaatggataaagatttaatatctattcaagtttccccttctactccttattcacacctctacaccctgccctcccgtgtacactcatactcttactctgtccggtgatgatattgttaccaatgtggtgtctatccttcgttcttgaatatcagttctgccaggaattactttttattctaatgcaggttgaacttgatgtttatcaagataggaacccttttgcaccttgtacgtcaactcaactaacggatttaatgatattttttagtagtctgaacattcttacaaattattacttagtgtcattgtctagcataaaatattattgccttcacatccatgtttagaatgttgatactatttcttatttttttttgcagatggggttagaataaaaaactaaatcactctaatcaaaatgatgagtgactgtgagagtcttagtgacaaaattgcaggctctccaaggtataaaagatgttgcctttttccttagtaggatcagtgtcaaaacaataaaggaagtgtaccttatctcagaaagagtgggagaaggacagttggagcagctttggttgcaatctattttttaaatgtataataaggatcctctggtagactgcttattgaagaaaagcaggttatggctattaaatgctcgtgtatttagttagtttttgtaaatatattatctgggtaaataatatgcccaactctaaccttaatttatgcattgcgcttaagaaatagaacttttaaaaagtatatttgacattttaatttaaccttttttaattttttactgaggacaagaatatatcaagtgaagtcacatattaatatagacttttgaaagacttcactttagatatcaagttgcactgggaaattgtggttatttttgtacatcttatgagggaagaactgtttttcttttagatccacaagacttttaaaaataaaactgagttggttgttgagcaaccagaaacgtttctgaagtgggcgtatgttgtctactgtgttgattagctctttcttttctgtgtgtctgtgttaactccttcatgaataatgcatgggactgttataccatttacagtacaccccagctaacaagggcgacttgacctcttttgctaatgaaaagcaattttgattgttatctttgaggcatgggggagatgatttactaattattataatcaatttagcaatatggaagctaaccagttctgtagtaagtacattattatttttcctaagaataaaattatcaaagttgggtgagggagccaacaggttattgtttagatcctgggcttgtggaggatgataccttcctgtcatttgtttctgaagatactacagatgttaattgcttatatgatgtttccacttgcctcaattctttgtactaggaatatctgataattctagagagataataagtcacattcaaggaaaggagtgtaataaattgtgttggagcaattaattacccgtttagaaaaaagtgacagacccatatctcacaccataccctgaaataaatcaagatggttaaaatctaaaagaaagcatttataaaagaggaaaaatactagaaagcatttcatttactttgtgtggaaggacttattaagtaatatataaaacgcaaaagcacaagagaatgacaaatttggttgcagaaataatttaacttctgcacgacaaaatattacctgtacaaactaaaagacaagtgacagactgggagaatatttgcagtgtatatcacaaagactttatattcagactgtgccaatgacaagaagaatgtctattcgtcaccataaatacctgtaaatgcctattaagatagttttctcttggaggctcctgtgaatccagatcaattaacgtcatatgctttatgctcttgatctcttcataaataggaactttaaagtgattagaactgaattgcattttaagtgaaatttgaaattatgagttatttgcctctatatgtaatttgaactcagagaaaaatcggataaagaatatgaagagagtgttaacagaagaaatacaaatggcttatccttgataattgtcaggaacacacatagtaatacactaatatttcttacaaatcagattgccaaactaatctaggactggcaagattcattaacaggtattcccatattttccttctgtaagagaaaattggaacacaagttagcagtatgtaccaaatttttttttttttttttttgagatgcagtctcgctctgttacccaggctggagtgcagtggcacaatctgggctaactgcaagctctgcctcctggattcacgccattctcctgcctcagcctcctgagtagctgggacttcaggcaccagccaccacgcccggctaattttttttgtatttttagtggctcacgcctgtaatcccaacactttgagaggccgaggcaggcgaatcacgaggtcaggagatgaagaccatcacgatgagaccccgtctctactaaaaatatgtaccagcattttaagtgtgcatatcatttgaccaaccattgaaattctagtggttcatagtgaatatatcttcacacatgtggacaaagatgtagaatataaataacagcagtagctaacaattattgggcattttctattaagtcaggcctgtttttagtactttgtggatatgaatactctctgtcctcccaaaagtcctgtattagtttctattaatttccccaattaggcatagtgtttaagtaacttgtccaagctctaacatttaattagtgttgagccaggatttgaactcaggcatcctggttcacagtctacacaccactgtctttcatacttaggaataacttacagccataagaaaattgaagttgacttgtttttaaactgacatggaaatttctcacatcaagatgaaaagatactgcaaaaaaagtaaaagtgctatttattgtatggctgtgtttagtttttaaaaatatatatgtatatctgcttgtatgtgtgagtgtgtgcatgtgtacttatatgtatatattatgcaaatgcattaaaaatttgatggataaacacctaactgatgctagccatttttactggggaagcgaatggaagtagaagccatagcgaaaactcttcatattgtattctatatgcatacacagtatatgtctgtatcttgaatcctttatgcaatagtatgttcatatgctacttttatacattgaaactatcaatgaaagaattgaagggaaaactgatatgtttattcaacagcagtttatgaagcaactgctttcccaaagcactcaagtgatacaatatatctgttgtaagtagatatacatatttatatagaactctacaattttagagtttcagaggattgtagaaattatataaagagaggttctgtgatatacaaattgttaataacagagcctggatttagagcatacattttatgacaacccgtcttactattccttctgttatatcgtacagaatatttatgcaaatttttcctacgataatttgaattgtaaaactttctattcttctccataaatacttataaatgcctatcaaaataattttctcttggaggcccttatgagtccaaatcaattaatgtcatactttttatgtccttgagctcataataaatgggaacttcagactgatgggaaacaaactacactttaagtgagatttggaagtatgctacttgctcttctatgtaatttgaactctgaataattttatttgtaaatagaacatagtatttctaaatgatcttacgtacagtatcttgtacaagtataactcagtagaacgtgagatgtatgactttcaggaaatgtatttaaaagcatttatgaaaataaagatatgcagaaaatctgctaagtgaggaattgtgtttgttaatgctttttgagtaataaataattgttatgttttacatttcactaaatagttgttcattaagaagtgatgttatatattgatgtaattctggtcacatttttcatgttttgttgttgttgttttttaactaccaggatgttattgaaaattcttgtgatccagtacttgatctgcatatgtctctggaggaactatatacccagaatctcctgcaaagacaggatgagaatacaccttcagtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaaggtaatattttaaagatatggtttgtgttttatgatgagatagggaatagtgaagtaaggttattctggctaatctcttcatttggaatgagtgcttcttgacactaagattttcagaaggcaacctatgaacttgttttggttgcagattcttgcaaaataaagcacaatcaattagagaacatgcgtgatgttgaaatcacgctccaaagtctagtttccctttccatgtgacttgtgacttctttttctttcttaaagggctctgagtacctgcttgaacagagctccctggcctgtaatgctgagtgtgtcatgcttcaaaatgtatctaaagaatcttttgaaaggactattaatatagcaaaaggcaattctagcctaggtaagtttctcattttcctcatatacctactcctcaacccccttgacaaggggaaatattgaacatggtaaatttcaattttttatgctgtagataagagaacagatggtagaaattttcctgtagtttttatttctatgtcctcattatttttttgaaatggtttacaggtttgtttacttcatatgagcagaaatccctcattctcttaattcagagtattcacaagcctcatttacattcagtaaaagatatatgaattgtttgtgtatgaaacagcaaatcagaaaaggaattcttagaaaatgaaaactcagcaatttggaattctaaattctttggaaaagtaaattattagttactttgaatgtaccagtgatgtataagtcagtttatatttaatttctttcactcactgaaagaaagactaaaaagacaaccaggtgtgccaccaccaaaatgtaaatgtgagttattcagtaggacttcccaggtggcaggatttttttgtcctattttaaccacaaaaccctctgaattgggcaaaaaagactttctgtagaaatatcctaattacaatagctaaaactgtgttgaggcagagcacatttgttctctcattgagttacacagtcatgtgactcagccctgtctttcttgataaatagaatggtagatgagttgctctgagtgtccaaatgcagcccaagactctggttaattcagcatcagagatccttttccttctatgaagtaagcaaccactacccgttacactgacgtcttatggcagggtcttgtttccttgttaagttttgagatttggcagaggaatccagcagtgcttacttgatgagtgggatttcagccttggtctccaagattttgttccatttgatggtggcggggtactaccaacagcagctaaacagaattgtagcagatagtatttgtgttgttgtaatatttcttatgtacgttatgtttaataggatgatgatacaaagcttgaactgcagaactttgcataactcattaattatgagacagatatctaagccatgccagaattatttcattggctaatttagtatttctgatgccatgttactcaaaatactagttttgtaggatgttaataggagttataaatgagttccaagtttaaaagtttgggatgagataaatttaagaagacgggtttctttttacatctcaatatcttttatactccagtgtgcattgtgaatcactaagagattatcaaatgtagcatttttcacatttaattggccatagaacccatttttcttgaataattgataaggcagagattttgcaaagcctatctgagaactattattctagtgtatttactcaactagcaaacatttattttaatactatatccactatgcatagacaccataatatcactgttcttaacacaagtttaagagagtaagctaattgacatttaaaatcctaaaggcattaaaatattgtacatgctataatagatacttacagagaacattaaaggcttaaaagagggaataactaatccctactctccaagtgtggagaactttagaatggtttcagaaaagaggagatgtatgatttaggtctaaaaagaggagatttttaccacatagttgaggaatttgaaaaagatgaaagctgcttagaagtaaggcagagagatgtgaaatattactgaaactggtttgttatggatgaagtgtggtatgatgactggcaaaatcagagttggaactaaaggaaggataaatgggagacaactgctggatgggtttgtgtgtaggacacagaacttctgctgcagccatctactgccttatgcttcatgtaggcagcgggagctaagggtagaagagtgacatgagcagatttgtgttttaagaagagcattcagcttaggttggtgaagcagttaggaggctcttgtaagagccatggtttgggtacatcagattttgcaatctggctatttggattgcttaccaattttttttttttttttgagagagagtttcgctttgttgcccaggctgcagtgcagtggcatgatctcggctaactgcaacttccgtctcctgagttcaagcaattctcatccctctcagcctcctgagtagctgggattacaggcctctgccaccatgcccagctgattttttgtgttttagtagagatggggtttcaccatgttgcccaggttggtcttgaactcctgagctcaggcaatccacccatctccgcctcccaaagtgctaggattacaggcacgagtcaccctgcccggcctgcttaccaatttttaattaattgtaagaatgctgaattttgtcaaagcatttcttcatctattggggagattatatggattttcttatttattctcctaatatgtcaagatacattgattttttattgtaaaatagacacagcataaaattgaccattttcatcatttttaagagtacatttctgtggcattaagtgcactcacattgttgtgtagccatcatcaccatccatctccagaacgttttttgggttccccaattgaaacgctgtatccattaaacaattattccccattgctctctctaccagtcccctgtcaactaccattcatttttctgtctctatgaatttgatgaaatgcttcatgtaggtgaaatcatacagtatttgtccatatttgactgtgtataatgtcttttaggttcatccatgttgtagcatgtgtcagaatttcctttttaaggctgaataatattccattgtatgtatacactatactttgtttatttattcatctactgatggacacttgagttgcttccaccttagtttttaagttttgatataaaatatactaggttaattaagttattggaagaaaacagtgaaaggtagaagtgtccttcctttccatcacatctagaaacccatttaaacctccctcaacagcctgactttaaaattaaagtataaaagagccctgtcatttttttagtgaaagtaaaacatttggccgggcgcggtggctcacgcctgtaatcccagcactttgggaggctaaggcgagtggatcacctgaggtcaggagttcaagaccagtctgcccaacatggcgaaaccccgtctctactgaaaatacaaaaaattagctgagcgtggtggtggtgggcacctgtaatcccagctactcaggaggctgaggcaggagaatcccttgaactcgggaggtggaggttgcagtgagccgagatcgtgccactacactccagcctaggtgacaagagcaaaacttcgtctcaaaaaaaaaaaaacaaaaaacaaagtaagacatttaagtgtgaaatcacagcaccattagtttaccattcacactgtaatataaaagtgtaaatcacaattagtttaacttttctgcttcatttccattattgatatgctatgcccaatatgtttatagggctttctccctggcgttttgatttcctgggacccagtgaggttcctctggcattttggagttaaaatttactgcatgccaaggcaacaacattacattactctgttacctcatttcagaggagatgctaaatgttcagatttctatagcacttcgaataactaaatgtaaaggaatcttgaaaaatctatgtaaatattaaagcattaaattaagctttagtgtaggaaggttttggctgtataacttaaagtaacaaaaagtgtgataaatagtatgttaggaagtctaaatagaggctgggtttgtgctagtggaaaagtatattatgaagaggtctatcaatgagctcattttcttagattcatagtctccccttaatcagctatatgcagttgtttgcagttttagctttgtggctaattttttctttgtctagtgatgaccagaagaagttattaataaatgacagctttctgtaaaggctgtcataatccattgttttgatttcatgaatcatttgggtttttgaattttgttaaatttagagtgaaaatatatacagaaatacagatacattaataaatatacacgtgcatatagtgacctttgaaaaattctaatcttgatgctttttgataagtctgtggtcccttgcttaataatgtggtgtttggacttgaaggtaaaaaaacaaggttcttcaggggaaaagaaaggaagtctttatcttcccttcactgattagatacagaaacatagacagactcaggaatttctctgaaattactcaacccttaaaggggtagagtcagaactcaagcctgtctatctctgattttcacatagaccgtacaatacattcagtacttgagttacccaagggcacattatgattgttgtactaacaggcttcattttgaagctgaattaagatttgcatttagtctttagggagcaatgtaaccttggtttgggggagagatgcattttaaacatattttatgagttttgttttgtttttagttttgtgactaaattttgtcgtacactttgtgtcaggtattttcaaagtactattacatatgtgtttctcacttagttctttaaacaaccctaagagtaaatgtcatccctttttaaaggtaagtaaactgaggctctgtgtgaggttaagtcagttgcaagcttgtgctgattggaagtggtggaattcaggtttgtaaccagttctctatttacaaagcacatgatttgggatttgggatttgggatattctttaatacttcttccaggaaaaaaattgagagatcttacaagttacaaccaaaatctggttagtggagattacctccaagttattgcacctggaaaattgtcatttggtgaaaggaaagtataagctcagctaactgatgttgacctcttggtttacatggttgatgtgacctgacagccttaatagctgagaatcgtgagttaaatatgctattaaaagtgaattcagagatcatgttggccatagctcatgataggttccatgtctgtgtcttgccttattgtagtctgcatggtgctaataagaacaagatggtaagttagattcccactgtgatccactgagttaaattttactttgtgctgacacatttttattttaccaaagtacagttatattgtgggtattggtgggaaggctggctttaacagtacaaaatggagtaccttttgaaaaatttcagattcagccttttttctcacccgaaacggtatcttattgttttatggtaagcagaggtgtcttcttaacaatacacttcaaaatcgttagtatgagtcttaacagaatattttaagtacatttaaaaatgttttatttctatcagaaaacagtaagtaggagcctgaattgcccacatccactatgaaatattaggctagaaacaaaatcagaatcattttttaaaatgtttgaaatatcatatctaatttggtatgagtagaattaatatttggaaagacatcattttttaaatatataaaaacctaaaaaggaatttgtgacatctgtcaaagaaaagtttttataaataccctggtagctttatatctctccatagcttgtttaattatataattttgttttggaagaaactttcagcacttcgttttaagtgaacttacattatttttgcaaagtttcaaatataatttataagattttatatttttcaacgaatagaatgaggataggatgcaaagggaacattaattcagatagagtctgttgagaaggactttctgaggaagtgatattgaagagtgagagggagttagctgtgcaagagctgcagaaagaaggtgtcaggcaaagacttcaaaacggacagagacgagatgcatttgtggctagaacttagggaaccaagaaggacataacacaaagcaaggatgcacactgcaaaggccagtgtacccctgtcctacagactgtgctgagcaagtatgttgtgtattactataacaggaaactattgaagagttgcagccaagggactgataggatattacttgtctttttttttgtaatggcctctctgtcttctgagggaagtatgcattgaaggagacaatcatggaaggcaggtgaccagttaggaaggaggcttttgcaaaaagtcaggcaagagaaggtgttgccttagtctggagttagtgtctaaatggaaaaaggtaaatggattcaagataaattttgaagatagaaatgacaggatttggtgttggattaaatataggggataagagagaggtatgcatcaagaaagaccccggtatttctactttgaataatggagggtagtgtggtagtgcaatttaccaaaaaagggaagaaaaatggagaaataaagtgaggtgaaaaattgcaggttcaattttatacatgctaagattgcatttcctgtgagacatccaggggatgtgaaaagagggcaatttaatatccaaattagaagcttaaagaagttcagagataaaatggaaatagattaagttcatataaattcatttcaacaaactgttatactttcccacaccactgtggtaggctccaggtatgaagacttcaatacaggcttcttgatgttaggaattctgtgctatgctgttatcctaagcaaccaacatagtacttggcacatattagccatatagtaaatagatcctgaataaacaagtgataaagaattaaggtaatagcggataattgcttaatttacatgatgaattttccttttgtagtccttttattctcttttatgtgtaaaagctgaactaatattgtaaaactgatttgatactatcatagtactctccctgagagacctttctattcaaggggtcagcacatcacatggtctaaattacattcattccacaatgtagatctgttttgtttataatgtattgactatatacaatttcacaaacatttacaatttacttaaaaatattttttgttagaaacactttttcctgtttttgctatgctttttattgactgaaatgttacttgtattttttaatctataaatcatagaaattattaaattcaaattaaaatgaattgaaaaatcatgtatttaattatatttgcatttctcttttcctgtaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaagtaagtatcatttgaagcccagtttaacttgggaaattcaggaatttcaattaatcagaattctttttcagtattcacttctgtttgagatgcaaacgttatcacattttttttaacataaatcactcaagaaattgactatttttgagtagttctcgattgtaagtttagtttctttgagactatatcagtattaaaaatttggaaacgttgctttgtatttttaattatacttctccagtgatttctacaacaaccatagaagtgagggatgcaatgattctcacagagcaagagggcccacttttaggatcttggaaagatgtttggattggctttgatataaggaattgtaccctacctaattgacctgtgtgaatcctagaactaagacagttctttaagggccaggcatgcaaaagacaacataaaacagtgtccatctgacccaaaacttaccgtttcttgagctatctcatgaccccaggggatagaccaatatgttgatatggtctgtttgtaggtcatggaggatattttgtcaggaagtgcttaaaatttccaataaccccataatgtactaaaagcacatcatatatgtggtttgttttttaagtcactaaccattccttgagccaacataaaaatcagctcattactttattgtgacacttcatcaatgtggcattttcctctagcattaatcattgaatatttgtttttaatgtatgagggataacatcataaaataagagctcagggaaagattgtttacctaaaatcgatgtaatgattactagtatgggggacttttttgtattaatgttattttactgactacattctctattactagtccttttgcaaagtatgtattgctagggcttaggtaacaaaagctgtacagactgtttttcattctgtggtcaataaaaagaagaaaagtatataccatttggagcagattccgctgtcttatataaaaagtattatttttaggcaaaatcttcactaatgggctttcatatttgtgtatgcttttttgacttttgtttacagttgaacagatcatcagatcatattactgttccttaactgccttataataattggagtacaagtaaacatcattaaaaatgtcagtccttttatcataagaaaagagaaacttcaagtgttttctttaccgcttatggccagtgttccatgactagatcatgtggagactatgtatttatcgcagggttttagtttatgtggattagatgtagtataaaatgcagatggactagtaactgttcatctgatttgttgtgccatgatgtacatttatgctgtgtgtgctgataccagtctgctgcccactttttggcattctgatcaccagaattagtacttggtactagccctaccactcagttctaatgtactgcagaactttaaaagtcgttaaaaaataagaccattgtgacaccagtttggcataagtcatgcatctggtcaactctagaaaacttttgaagtacattttcaggctcaaagtcttttttcccctttcctcatttttttgttgtgtatttccgtttcccctctcccactgattcagcagaatttaccctatcatgtgggcagaagctttattatgactatgaagggtatctagagagctagcttcataagtacttgctttaggatctcaggaggcaaaatgtactatagaatcttaaattattttaaaaagaagaaaaatcgtacaaccttccctcctctggaaatcagtcatccattcattcagtcagtgagtctctctctcgtgtatgtaaacacacatgcagacattcaaaacacgttgatttcttctcacatgccttaaagatactctgattcaaatgcttatagcttaactcattgagtaatgataaaaataaactaaaatcatccttacataatgctttttcagaaaaaaaaatatgttagattttaaaacacaaagagccatttaggttgaccagggctgagcagcatgttctgtgcattttgcatgaagtgtttttggcccttaccacttgtttcgtgaagcaaaaggtttagaattaccttgaaagctatgtgaataatcttcccaaaaggaacttttagtccttccattactctgaatagaaccataacattgcctcaggcccattaagctttgtgctcattacctggatctaggctccatccacatctctttctcattatttttctttatgaacctagcttaatctgggtggtggtggaggggtgtattgtaggaactttaaaaaaggagactgtggttgagttacataactgattggttttagggaaagcattgcttattgagagaatgcactggatttcttttttgccatttacgatagatagctaggaacttttgtgtgtgtgtgttcatgcatgcatgggtagataatttgagtttcaagagttcaagaacagccagtttaagatccaggtttcattattttctatggaaaaccagatgcgaagcctcaccagaatgcattctgtttcacttctccctccaccttgccaggagctcttatatttctgtaataatagccagggttttgtgcttagcagcagctgcttataacatctgccagataattactgagctgaatcagaattcacctgccttaacctaaagtgtgggatgaattcctgatcaaggaataaaagactgattgcagttacattttttcatgcttgttaataatcactgctatagacactagtaaagagcagatgcttttctgggggaggtgtagatgggagggaggtggaaagggggaaaaaaaacaaccaggagcacccacttttaactacatatgtatgcatctcacattcagcacaagacattgacatttgttaacaccattgtaaaaagatgccgcggcgtatgcttcacattctagattttctgcagcacctgctgacgatcgagcccccttttatgtgtgagtatcagtgattcgaaagctcattatggctgtgtgttacaacttgtctgtgaaaacaattttgtgcttttgtaatgtcccaatgcaagaatagatccagatatagattttgtatatacattttagattgttttctttgtttaagtaagaacataaaatccaacagagctatgagattgttacgttttcagattgtactgatgattgtgaactcatttgaaaatcatattttccaattatgaagctttcaagctcctttgtaagggaacgatcctgtctgcacgtgcgggaatagtctctgcattaatagccatatcacatttcagcatctctaatggtattcttttttcttctagtccatgtgtaaccaaaagttagtccatgtgtatccaaaagttagtttgaatttttaattcaactctcaaataagcatttcagtgtgttctcgcagctcataatttagctttggcatttttgctggcgatttggaagttctgtatgatcctgtgaccaggcttgtgctagcatggctctgcatgttctgttgcattgtgggatgcttgttctggtggcctcactctctgtagtggctaaatagttaggaaaactaccgtctctactctttctcactgctatgcaaagtatcagaaaaatatttgtaaatgcctacactcctcacctttcggtaaaataaaaaacaactttgaacaaatataaagaaaaactcatttttaacattgtttgggatggaaacatctttaccttctttctcaaaccaataaaaaattaaagacttcgtactgattgctattatttttgctattctatcctgcctttcttccctgaccttttcctggctttttaaacttacgttttatttatatgagttttactgaatctttaggaataataccagttttcttgaataagcttttcacattttaggttttatgtttatctttattttattttttcattgtttaaaatataatcagtcttctttcctgacataatgtattatttgaagggctaaaagcaaatttgctattcaatatatttttgtagcaccatagagaagatgtctttatagatgaataaattaaatagggccagaattggaatgcaactttttcagctagcctagtcttaaatccattgatctgtactttgattcagtttttgacctttgaggtaaaagtgtcacgaagagattcccagaggccccatgtattctgcccaagtgatcagtatgaccaggagagctgatgacctgtgatagcactcacttctatttggattgtgctcctcagcttacagtagcttcacaaaagtgacatcctttttgtggtagagggtatggaggttcagcagtggtgatttaccccatgacactctgcgtggtagcagaactgtgtcttccgactccaaacccaagtgacctcgcactttgaagtgaaagagtgaatgctttctatagaataaccaatatatttgaaattatgtatactcctctttcagtaaattatgacattggtataaatttttattttattacaacataaaagacaatctttttatctttgccctccagtgctgaggttttgtatacttattattttaacagataaattatggacagagggtttaataatctttgtgatttctaatttttagttgcacaaacatgctgtattgagttcagatacagtatttctcttatgttactattcattaatttgaagatcttgaaacagtttactttaaaaagtatgtccaccatgtcagaagcaggacagcaggacagcagtagacttgaattttcatttatcagtttctaaacattacagcaggagtcagcatctggcacagtgtcttccgcataataggcattcagtcagtacttgttgaattagtaaatggccattcacgtgtaaatagtagtcttttctttgagaccaaagtgaattttttaaaattgcttcaaattagtaagagtctttccataaactcaaatggtttaatctcatacttcagacttaagagttcataacttaatagagctaacataattattgaaaatgcttgttaatctctagaattaattatgtattatagaaagatgcaaagtaatttgtgatattcagcattttaatagagtatacctaatttgtttctgctagagatcccagaaatctttgggcaaaattaatgttattgctgacaatcattattctagggatttatagatcttcctaatttaaaaaaaattgttgttagccttttcatttgataatataaataattgttttccttctctgcatgatgattggtaaacacatagttaatcagcagcatttaaaaacttagtttctgttgttactcttccctatagaatactttatcctattgaagtttggattctctgctgaatatactgattaaatgagttgtatgaaaaagtagggagaaagggacaatatgatttgtttcctttattttagaagcttttcctaacaattaggcaaaatattatttcccttcacttccatggattctggtttgttccagaattacttatgtgcctgcagaacatttggaagagttcaaaataagcttgggacaacaatctggaagagtaatggcactggatattttttcttcatacactggcaggtaagtgaaacattaaatctaatacaatgaatggtacagcaagttgtagagaatttggaattcagagtcagggaggactagagcaaagaaaaggtctgaatccttttcctctttcaagattttaaaaaatattcttccctttccctcaattatataagtaattattatatagtatggaaaatttgagaaatatataaatattcaaattaataaattaatatttaattttaccacacaatgtagcacttttaacatgttgagttttgataatttgccccaaatgagtattattccattaatttcttagaacgtaagaaattgtatgatttttttactcttttaatattagcaaacttcttcagaaatgttatttattcttttattaacatgcatacaaattcagaatttttttctttttttttttttgaggcagagcctcactctgttgctcaggctagagtacagtggtgccattacagttaactgcagcctctacctgctgggttcatgcaatcctcccacctcagcctcccaggtagctgggattataggtgtgtgccaccacatcaggctaattctgtattttttgtagagatggggttttgccatattgctcaggctggtctcaaacttctgagcttaagcagtctgcccacctcgtcctgccaaagtgctgggattcacaggcatgcaccaccatgcctagaccagaaacattttttatttgtaattttcttgctcttttggagaatgttgagctgaacccgttagcatatatgcatgttaggaaacagtgtttggctttttaaaggcacttgatatacaaagtattaagagcctttaaataataaagggaacgttttcttttttcttaggaaaggcaggaactgggttttgatgctgctgctgactgagtcaagatcagggagagaaataatgtcaaactgcttttccatgaagaatgtaccattttacactctcagttgtgggcctgtgtttttcagttgtgctggcaactgactaccaaatttcttgtaagcatgtggtagagcagaaatggccttgcaagcactctgaggtcttctcagaagagagttctacaattcttttttttttgagacggagtttcactcttgttgcccaggcagtgcagtgcaatggtgcgattttggcttactgagacctctgcctcccgggttcaagtgattcttctgcctcggcctcctgagtagctgggattacaggtgtccaccaccatgaccagctaattttttgtacttttagtagagatgaggtttcaccatgttgggcagactggtcttgaactcctgacctcaggtgatccaccagcctcggcctcccaaagtgctgggattataagcgtgagccgccatgcctggtcgagttgtaccattctttagaggatgtcagaacatcccagaacaccacggtctccagtgaccttgcattcattgtgatcttgcttcactgattcctctgcacattacagatgactacagaatacagaaagtgtcagggaaggggaaggtatgttatttgtttaataaagggaaggaatggcatggtccttggggcctcatgaatattatgggaaaaggagtataattgtccctcattatctgttggggattggtttcaggactccccatggataccaaaatccacagatgctcaatcccttatataaaagggtgtagtattcgcacataacctatgcacattctcccatatagtttaaatcatctctagattccttataatacctaatacaatgtaaaagctatgtaagtacctgttttatatatatatatatatatatatatatatatatatatataattttaataatgacaagaaaaaaaagtctgcacatgtattttgcagatgcaaccatctatttttttcccaaatatttttggtctgctgttggtttaatccatggatgttggacccaaggatacgagggataggggagacgcctatatttactttacacttacaaagctcagccacactccaggatttccattgtagggttaatggcatgagttggttatagtttcctggtgcttcctgtcaaactggtaaaatcaattatttcaatgtccctctgaaatattgtgtcaaatgacttacttaaagaatacaccaggtaacatctgagtcctgttaagttctagggccttaaaatactcaaaagttattagaaagaaagccactttgagcactgtgcttcctccaagcacagacaagaggatggcctggattgtcctgtgctgtgactagctgcttcactgcagagaaagtatattttctgtggatatcagaatgcttaaaatagaacaaatggatatgcatttttggtggaacaatctgcaagagaaaggttaagtaactttcctgcagctaattaatgccagagccaagtgtagaatgtaagcatactccatgttcttaccattggaagcaaggaaggaattgcacaagtctacgaagcatgtgccatataaaaatatgtggcagcatagcatgaaagttaagagctcaggttttatggtaagatggcctcaatccaaatctcacctatgctgtctgccagtgtctttctcatcatgtgtctttctcaccatgtgactttctgccagttactttacctggtacatatttgcagatataaagagatctacttattatagttgataacatttttgttggtattcagtggtttaacacagtggaaaagcagttgattgacttctttcttggctgagtgcatgcaggaagacatgacacttgagtccctgaaaccacacactaagatgagtaaacaataatcagcacctatagaggagcatatatggggtttgcgaaaggattcaagattatagaatcatctgaagagactggggtccttgtattggattattcaggatatttatcttcttgtacctaaaaaggaagaagcaagatgcattgtggctacggtgtttctgaatagctctcactgcttaggctttagggctaaggacctccccccatcccctgcctgtcactgaatattttaaggactgtttctaagttctaattcttgtctgtcttctaactctgctttcttcgtcatactctgtcctgttgtatttccaggtcagggctaatttttacctctctgccttgcatcctctggacaaagatttcacttttactatttctctgtcaactctttgacattgtttttaggatctccctcttggagctcttcccaccagtcctaccctagtgtcagacttagactctaggagccctaccctcattcgaggcgttattctttaattgcacaggagggaaattcaaacacaaaaccaatgggtaggacctatagcaaatagattttattctaatagcttaaaaacaaaaacttaacattcaggtccaagaaagaatgagatgttcttggagagcctggacatttgcttgccagaaatgttgcaaagcgcattcaagctcagatggatgactggattagatgacttctgatctttaattcaacatattatatcagttgagacagttcagtattcctgtcaggggagaatggctgtaattttacatactttcttttgattcttcagtttctgtaaatatcaactgaaaacatttattgaatcagagtttttatagccttctctgctttaagaggaatatgtggacatatttctttagaaatccaatttttaccaacagccaaggcacaggccataatcagtttaaccattctctattgtcctctcagcctcatttattgatacaaagtattcctttggactaacaaaatatttcttgatgttgttattattgtacagttttctttacagtcaatcagtagactggacacattttgttacatgcctggcatttggcaaaatctaaattgctacataaacggaaggtgaccttgaacacagacgcgttgtaaactgcttcttccattaagaagtattctgtgccaggttcctctggatggggtgaagctggaccaaagtctttcacttaatttttcaaaaatggaaagaaaatcattggtccatccttaggaagcagagatactaaactcttggcaaacttgattagaaattcattcaggacaaggttcagggctgtgcatacatgcttaaaacctacatggtgcttctagcttcctgcacattataggaatttaagacatgcttgttcaatgggttttctttacaaacttggtatttatcctattttccccattcctttcctttatgctcctatgtctcatcaaggaaaaaacagactagacaagagtcttagtgttcagctctacgctatggtacgttgattctaaagcaaggttttaattttgtttggttacgtttttcttccccccgatgtaaaaatattttatacttatggccatgtatggtgaaaacataaaacagtcctgcatttttagctaaatcaatagtagagtacatataatcttgcatgtttttactaggattttggggtactcattgtgtaattctttaaccagagacattccagaattaccagagcgagaagagggagagggtgaagaaagcgaacttcaaaacacagcatatagcaattggaatcagcccaggcggtaaggactatttctgtcttctgtccacccaatggatatatagtgtttaaagataagcaggtgtggtttcaagtactggattacaacttgcttcttgttatatcgggtgagttgtttaatacttctaacccatcattttttaatgtatacagtggagagaataatgtgtatcacacagggttaaaactaacatatatggagatatctggcacatagtagggactaaattaaagaaaattattcataggtagttggaatggataatacgttctgtagagttttatcttaggtataccaaaaagtattcatttaaattttacctagcatttgtagaaactagataggcaaacatatatattcagaacgtgtgtgtgtgtgtgtgtgtttgtgtgtaaaagtaccctcatagccttgttaccacaggctgagtttatcctaagtcataatctgtctagcaccagtttcatgtataatagataagatgacatcctcaaatatacttagatgtatcacgtgcatcactaaaacatactgatgtgtttatgctgagtaaaatcaactttagtttaataggaatttactgagtcctgattatggacctagacttaaagccaatgattttgtgaataacaaggaaataaatagaagatgcaaatcctgcctcaaggaacctctaatgtacttggctgggcaagatgtagagacacatgaaacaatttaagaacacaaggtatttcaccttaagagtaaaacataggtaatcagtggacatccaccccaaacagacctaaaggtcaccatcacaatgtgatgctttgtgttcagtaaacattaatatttgttacatagtgaataaataaaatgctcaagagaagaatttgtaatattcgtaaatgccagtgcaatttaatgacgtcccctgcccaccagtgataacctgcagccatcacatttaaatatttttaaaatataaaaaaacactattttatgttgctttcaaagaagcagcatgtatttccagccatctaacatgaatttcttatttgaatttcatcaaaagtcacttaactcacttaaaaaatcccaagctctctatagtgctgcctacattgagaacagggtataagtgctagatctgtggcagaaaatatattctgaggtgttaagtgtcttatttatttgtggatagaggtagaaataagttaaatgaaactgttttgtagcaggtagtcatagtgataaacttgaattttttaggaggacagtaatcacaggaaaaaaagataggttggtcagttttagtaacaatattatgagaggaaaagtagattttagaaggtgatatagtttggctctgtgtccccacccaaatctcatcttgtagctcccataattcccacatgttgtggaaggggccctgtgggagattgaatatgggggcaggtctttcccatgctgttctcctgatagtaaatgggcctcaggagacctgatggttttaaaaacgggagttgccctgcacaagctcttttatttgcctgctgccatccacataagatgtgacttgctcctccttgcctctgtcatgattgtgaggcttccccagccatgtggaactgtaagtacaataaacctccttcttttgtaaattgcccagtctcaggtatttctttatcagcagcatgaaaaaggattaatacagaaggcagtatgcaaaatggttggtgtcagtaagagccatgttagaattttggctctgatactttctaagacaagtttcttaatctctgctaggtctctgctactttatctgtaaaatgaggttaataatagaatcttttgaatttgggggaaaattcagtgtcatctaaaatccttagcagagtgcctggcacatagtgagtcagtggttggctttgtctgtattgataaaatatttgtcactggtacctaagcaaagagaaagcctttgacacagaaatcatgaaattttcttatgagaaagaagaacataacttctggactggaaaatttttatgcttttaaccttcatgcaatcctaagatagctctaaaggtgctaacaaccttacgtgaagaatacctccaaagattccataaatccttctaagaaggtactctgtactcactagtgtagtggttctcctagattcactaagctacttctaggggaagttcatagaacatgagaagaaagcttaatggagtaaccagagcttttaataaattaggagttagtgttgtgaacatggttcatagcattgaaaacatgatgggacagtcattcatgaaatcaacaaaaatgtactttgtatgaaaatagagaatttttagcaaaatataaattttaagattataaaatgggctgtattttattttgcatgtgattttcattttacacaattgatatactactacatgtattattttccattttgcttaatttttctctcaattcttgacgttttgtaaatctatcaagcttgatacttaaagatctaattcattcaatttagttgttgtgttgcatttcaatatgtgaatataccatagtttattcattgtcagattcatattagatagttaatagttatttgctattataataattctgttcagtaaatatatttatttctttatacttacacatgaaaatttatctagggaatatatccagaagtggaattggaattgctggcctgtaagtttatatgcattttttactttcagttgtcaaattgctttttaaggttgctataccaattattattattatttttctgagacagagtctcactctgttgccaggctggaatgcagtggcacgatcctggctcactgcaacctctgcctcccaggttagagcgaattctcctgcctcagcctcctaagtaggtgggactacaggtgcgcaccaccatgcccagctaatttttgtatttttagtaaagatggggtttcaccgtgttggccaggatggtctcgatttcttgacctcatgatccacctgccttggcttcccaaagtgctgggattacaggcatgagctaccacacctggctgctataccaatttttatttctatttccaatatatgaatgttcccttttccccacattcttgttaccacatcatatgatcattttttaaaaagttttttgtcaatctaatgggtggaaaatggtactctttcttaataaacaaggtgtggtaggtataacaggattgatcagatagggtgaacatttgctcatttgttgtatggattgagtttcagtttcatatcttgctttcattactgcagtaatcatcaccttcatcaccaccacaaccaccaccatcataactagtaataaaagatttatcaattgcttattatgtgccaaagcttttgttttggaccctacatgtattaattaatcctcacagaaactctgtgtagagactcttgttggctgtatttcacagctgaggaaagtaagacagagactaaataaatgccctgtgtcacataatcattaagtagcaaaagagcaggactggaacccagagactcagttcacagctcaggcagtctggcctcagagctgtgttttacctgtgtcttcctgaatttcattctttttaaacctatgtataaaactcaaataggctgccttttttttccctacataacgatctctgaagtgaacatattctgtagtttcttttctaggcctcctttttctttcactgtgtttctattgtctgttcagtgaataaatgagtctggtttctcattactgtgtcattttggcagttctgtctttgattaccttcttcattgttttaaggatttacaacctttacttccagggagggtattttgctatctgtgccaaaccctatgagagcaaaggtgctattatccaaaggttacttaacctctctgtgtctcttctcttctttgtaaaatggggccagtaagaatgtctaccttataggtatgatgtgaaaattaaatgaaagtatatgtaacttactcagagaataatactgaggacatggtacaacccttaataaacatttgctgttacttatgttttttgtattactcaagaagtcataagaatcactttctaatttgcaccaaacataaagagcccttggagacattttctttccttctttcttttttattttattttattttttattcttaagaaaagagttaaggagtcctacctatgtattctgggttgttaaatatttacacttgtggctgaacttactatatgtaaaatgtactatatgtacaatggctaaacttactaactcatttgccactttgccttaggaactgctttaagaaaacagggaagggacagttgtggtggctcatgcctataatctcagcacttagggaggctgagatgggaagattacttgagcttaggagttcctgagcccaggacattgaggttgaaagtcaaggctgcagtggactatgatcatgccactgcactccagactgggctgcagaatgagaccctgtctcaaaacaaaaacaaaaacaaacaaaaatagggaaggatggtggatgttggttcttttctgtcacagaatttctggagtaagagaaaacaatgaatgggattttaactattttattcacaaaaattttataagatcaaggatcatggtaaggtcgttttaaactaaacaggtagagtttctagagttacagatttgcagtcaagaaaaagagttactggccaaaggaagatgtgcctcagtgtctgctttcatttcagctggttcccatcctttcctctttgtggtgctctttcattcccagcctcttcttacctcaatcattttgcaggattccttacttcaacctttcctcttctctaggaactccttaaatgtcagtgttgaagacatgtttgacaatgctgtcttatcctacttaatgtccaacattgtcttcctttgtgcagcatggagcagattgcagggtctcatcatctccttaaagttctgtttcgtcgattttcctccaacaccctgaactctgactcatctaggccaaagacctcactgcaaatcaccttactctttcttacatcctgctttttcacaagatgtatgtgctttaaatatactcatagcgcttacagctatttgcagttattacatatgaattcatgtctttattttgtgggtataggaaatgtattcaagacagaggaattagcaagcaccgaggccccaaggcgggagcataccagatgaacttaaggaatagtaaggagatgatgtggtagctagagtggagagaggaaagtacagagcccatggcaggtatattagtccgttttcatgctgctgatatagacgtaccccgagactggggaatttacaaaagaaagaggtttaatggactcacagttccacgtgacttgggaggcctcacaatcatggtggaaggtgaaagacacatctcacatggtggcagacaagagaagagagcttgtactgggaaactcccctttataaaactatcagatctcatgagacttattcactatcatgagaaaagcacaggaaagacctgcccccatgattcaattacctcccaccgggtcccaccaacaatacgtgggaattgtgggagctacagtttaaattgagatttgggtgaggacacagccaaaccatatcagcaggggaggttagggaggtagtgagagaatcatatcctgtaggattttggcagtcactgctcttcatgtcttgactgttagtgaccaggtctgccttggcaagaatgacttctccttctacagaggtgggtttgtgacatagtgtgtgcaggagtgttctttcccttgatttggttgctaagcttagaagctgctatctgtttagcagtagctgatttttttgattacttaatatatgtaatactaagatcctgtaaaatcatccttttacactggtatgtgccacagcctggagtatgagtccagttttacttataacaaatcattttcagaaatacattaatatcagattctataagacacataattgagaaggtattttaaactatcttgttttactactagtaaaaccttaataaattgagcaaagtaatatttgtaaaaattaacatatatgacattttattccattgtgttaaaatatttttattattattttaagccatcctaaccatttgtaagtgtacagttcagtggcataagtacattcacattgctctacagtcaccaccaccgtctagctacagaacttttttcatcttgcaaaactgtaattccatacccattaagcaataactcccctttcttgtctcttcccatcccaggcaaccaccattctactttctgtctctatgaatttggtacctctaggtactttatatgagtgaaattaaatgacatttgtcctttattttacttagatgacttaacttcacttagcataatgtcttcaaggtttattcatattatggtatgtttcagaatttcatttttaaaggatgaataatattgaatgtatatagtattttatctactcatttcttgatagataattggtttgcttctacctcttgactattgtgaacatgggtgtataaatatttctttgagatcctgctttgaattattttgggtataatacccacaagtggaattgctgaatcatatgataattctatttttaattttttgaggaacctatatactcttttccatagcagctacacgattttacatttctaccaacagtacacaagggtttcacacgctctgcattcttgttaatttgtgtgtgtgtgtgtgtgtgtttttagtaggtagtagccatcctgttggatgtgagatggtatcttactgtgcttttgatttgtatttccataatatttagtgatgttaaacatcttttcatgtgcttattggtcatttatgtatcttcaagacacttgcccatgttttataccacttgtttttttgttgttgttgagttttagaagttccctttgtattcagcttatgaatctcttatcagatatgttattagcagatacttttttcctttccgttggttgcctttttactctattgagagtatcatttgatgaacagaagtttttaattttgataaagtacattttatctattttttcttttgttctctgtgcctttggtgttatatataagaaatcattgccaaattcagcatcatgaagctttacccttatgatttttcctaagagttgaaaattttatttattttttagggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaagcctggagatagaatcgtagaggtaccctctagtgagctttctgtgctaaaatttgtttgttttgttttatttatttattttttaattttactattattatactttaagttttagggtacatgtgctaaaatttttcacctgctccaccctttgtactgagggaattgtcatcttcatactagttactcaacccagcattcgagtaaaatgtgtgtgtggataaattatttctttcttatttgtttattttcatacgtaattttctcttatgtatataatgacagattatatgttttgatatagagactgatgtttggagataaagccaaccatttaaaaaaaaatggctccaaggtaaaataattatgttctgtttgaaagaacaaagcacaattctcagggaaaaattttgaattaagattacattagacatacaatatatgtatatgtacacacaaaaatgtagatataattaagttaatgagattttatttcaataagtactttattatcatttcattgcagataaactttgttggatgagttttttttttccaagtgagtcttttttagtaaaatatttaatgctgacacctcagttacctttcatgtaaatccttctcagtcgaagccaggatctcgctccttttcagtgctgtgttcattcatcaatgaaggctctgtatgtgtgcctgtgtgcatgtgtgtgcacatgtatgtgcattttgttatgtgttagaagcatgtcaagttgtgtgtaatctcttaattcaaagcaaagttcaatattttaaatagactctcctctcataagtcactcactcatttactcaacaaatattcctggaacagctgttgcattccaggtgctataacaggctctgggcatcccacagtaaacaaggcactgtgcctgcctgccaagtgggacagacttgacaagtaatcaagtcacttcagaacagtgtgataaattatttcattgggataagcataattttatttagaaggatagagaaaggagtacctgacctagattttctgagttttcaggatttacagagtagactaaaagagacaacttgcaaataaagacaattttattaccactgtaatgaccattatatttactttatacaagtgactctcattttctaaacccatataacttacacactggaagactttgtttagaagaagattataacatatcaaccatgactttaaatgcacgttttgatgactgattgattccttcattgactggctgtctttgagagccttagacggaagaagattgggacctgagcgaaaacagggaccatgtccttttttttttgatgaccgtttataaggaagagtgataggctttttctctctcctgcattctttcattagatgataccttagaccccttttaacgaactcttttatttaggacactacctaaaatttcaaattttggattgtcactaagaagtttattttatgcatacctcactattaaatacctttgacctaaatagcaaaagagatttttttttttttgtagacaagaatggtcataatttgctctcaaatgttgtttaaatatatttaaaaagttaaagttcacctttgaaatggaaaagaaagaacttttttgtgcgttttaaaatactgtatgcaatttagcaatgatttgtgccatattgcaagggcttttctagtatgtaggaagcctcagtcctctgtaatcctgaggattctaaagcgtgtctctgctaagagtttctcaaaatgtatatagactaggtgagtgcagatctgcaaattattccattctgagaatggaatactttggtcttgagcaaagataattaacatccttttaaatttttccacgaatggaatatatagtagacatatggtagatgtgaatactgacttttgttctacaaaaaagttagaagctattttaatatgcactgaaaaaaatattgtcatctaagtatcaacctgagggaggtttttatctaaatctatataattcttttaaagataataatgttctatgcaaagatctaataatgttcttttctagagttgtgtccactctgggtttactcttttgttgtatatatcataacatggtaattggaaatgataaaatgatactaacatcctatagttttctgacagaattagcatttggccttttaaactattttccttcttattcataaagtgtgtaagctgagttgatcaatactcaggcaaaccatgatcaataaaatttacaaaataactttcattgtcaaactatataagaattactaacaaataaacacaatttcttagcttccagctcctgtcatatctactgcaaggattcttttgcaaaactaaccttaccattatctgatttttctggatatcagaattttgttttgaacttcaagcttccctgtacagagaaaattatacaaggcatcaccccttacttcccaaaccaccctatagtcaattagaagaaaattagtacagtgactttcatgatgaagacagtgctgctagatagttccctcatataattttgttaatgatactgatttttttaatttaaaggagcagctgagcaatgtaaggagtgcagaagcagaaccttcatttcaattgattatgtcttgaactgattattggagacagagatatgtgtccaaagcaagggaccacaagtctgctggacagacagaaagttctgcagcttcacatgtagtctcaattatttttgatattaaagcagattttctaggagtctaaccaagtatccctaaaactccgtatccacacatttttttgttgttctatagattcttgaaatgttaagctgaggccttccattgcaggtggatggaatggacctcagagatgcaagccatgaacaagctgtggaagccattcggaaagcaggcaaccctgtagtctttatggtacagagcattataaacagaccaagggtaagcgaacacaaagggcaaggtaggcatatccaaacagtgttcaacttggaatctaatgtatcaagggccaagttgtctgtatgagtaaagatagtgatttttcaaatctcaggagacttgttagaagtttgttttgctttctcagaaattgagttatcctggaaatcccttccaccatgtttaataaagacttttgaggtctgttgaatatacacagaagtagatttatcagtatctctaggtatctagatggttaattattagtattcattttaatcacaaaatacacaagttattaaaaggaatgtggcatcataattcaggttaatcatctgtgatctctagtggagccccttagaaaccaaagaaatgacattttcttgaaatttattctctagacagaatctcctacttatgcaatcccataatcatctgtgaatgatcgttcatgtatttgtgtatcccactgaacgttaaatttgctcagggcagatttggtttgtttacaagtgatttcatcattgctgtactctagccacatcactgtatagctcttcatcactgtatagctgttggtggacagaaacctaccaacccgttttgccatcagtcaccacaggtaaaatagcattaaaaaacattttagaaaatgtaagttacatttaatgaatgttgttaacaaagatacagagcgaggctttggatttgttatgacttgatgctgaagatgaaaattatgccaagagtttaaaactgttttttcaactccttctttatgcctcatgaaaaaaaaaattcacatgcagcagttattaagtattttggattcacatacccctttgaaagttctttagaaacatacacatccattcaaaaattgcataccatttcctagatgtcctgaagcacttacagactccttttttggatttaagttaacaacctccatcatagtgattctctttgaatttcctgcttactagtttttagggttggttgtctttaaaacaaaaatatcaacatatgtgagggaagttgaacgcatcgtctaaaacttaaaatatttaattttatctgcaaaatatatttaattttaacttgtaaagttaagaatttaagatataagggctcagtttaacttgtgaaattaagaatttaagatgttaaggttcaaatgatgaaaataaccaacagctctttagatgagctctgtcaaagtaacttatcaatattctatgccatggactgtaaagtgaccagatttattttaatggcccttccttctgttgtgaagacaggtgtaactgtggtctgggtttactgtaaagagtgaatctagtagtttttaatgtaagcacttcaacatctgcaatttttaatcattcagttgtttattgttaggtaataattatccattcagaaagaaaatttgccaaatggtagggctgcatcatgctgcattctttacaaagctattccatttgtttaaataactataaatccttttacatttattcccatttgtgtgttaaacatagacacagcataataatgttaaatgggtgtttaagttaaagctattttttttgtgtgtgggtggattttagtcctttttttgttttatttataatttacaatttttacatcatttgggacaatactataaattgctgaatagtgattctcaatattgctttaaaaacttaaaactacaaatattcctttcaatgtcaggcacattttccaatgagccgggaagatcttgtctcatacacctggaaaatactcttattttgctctctgaggtataatgatacctgattttatagcaattgttccaggataaatcttgttatgaatgacatgtttagtcaagtcatacttattttgctttagaaaattaaagttaattttgcatttaaaatgagatatgttttgtttcaatgatttacttccttatggaaataattaggtctccagtaatctaaaaggaacaatcacaaatgcacatacttaaaagtctcttactggtaattgtgttatctgtagatataggataaagctcctaggaaatcttaaacataagctgaaaaaccagtgagttgctttggcccttaggctcttcaagaatcagaaatttccagaactagccctggtaatttcaccagtatgacccttcacagaattcagtctgaccacattttctcactgaaaggggggccccatttagaatgggccagagaatgtttttgtcttccctgtgcttcttcgttgttaatatttctgcttttctcagcccctgggactataaacagaagtttcatcattggttttttaataagaaatagtctgtttctaaatatcttttcctaataatagagtaatctaccatttcgtctgctgtgcctatgctatacttttacactttgctatcagggccaaattctaatcctctgagatctgcaaattaaaaagaaagcaaaagtaataaaaatttaaaaactagagctttctttaaatttgttgctagttttgttttctgatgttctacagaattatacaggacactgaaagtccaatgtatggagattagaaataatctccaccttccatagcattgaattattttgcctaggatatatttgtcacctctgcctagtcatttcttccacgttaataaatggtcatgtgccttggtatttgtgatcttctcttttgtaaagcaggagttgacattttaaactgaaaagcagggagaaagttgagatgagcagaaatgtcattgtgcccatttctttttcctgtcttccctctgtaggaaaaacattgcaagaagagcagattgaaagggtaatgtggcataagctttagtgcaggcatactgaggatagagtctttccagagtgttctctcatacagcgtggtgtcacatgacaacctctccctatacttgatgcctgccagtggggcttttttatagagaaaagtaacacaaacatttaattggagccaaaatgaattttaaatgtctgcaatttcccctgaaagatatagtcaataaaagaaaaagatagcgggtgtgaaaagaaggagaagaatttattgtgctaaggaaattacttttttttttaaactatgaaaatgctaaattctatctggcagtcatcctgactttaatatgtattttcaactctaacagtctggctcagggcttattactggcaagccacaaaacctctgagaaacactctaaggcaggacttcaaatattatctaaagcctcataaattctccagtaatatgggcaattttataggaaatttatttaaaacatgaatctccatgtttctacctccacaaaaactgggcagaaatagagaacaccactctacaggagttcattttttaataaattactgtttttttaatttaaaaaatacaattgctctgaagcactttaatatcaagtcaaaatatggaaagtttccttactaggatgcaaaataaaagaataatgaaggttgccagtgaactagcagaccagtttataatttgcattctagacagattatttaaaaaaaattagcttttagatgtagataaaaaattttgtggttttaattttgaacatgtttactggtattcataaaacatgtattaatatataagatgggcaaaatatatgtgcctctgttagtaataccgaagacattgagcaaaaataaaagaaatttgggatcagtttgacaactagtttcctttgtggtttgtggcctgatttagactcaggtatagattcaggtcattagagacaaatctttagttccagactgttttaagatgttgctattaatgactggatctgataggatctagtttcacacaggcagttctttaaatcggtatgtactttgcttttaaaactgagttgttttcaatacatttcctttgcgttcagcgcctcttatgtttccttttagaaatcccctttgccttccttgctgcacaacctttaccctaagtacaacttcagcagcactaacccatttgctgactctctacaaatcaacgccgacaaggttggataatgcccattgtcttgctgttggttgccttttgcaaatgttttgttctttgttactactgtgtctttgtcccagttcactatttgctacatttgggcagggaaaaaaaaacaaaaaaacaaagctgtttggagtgggcatgcagatcctttcttaagcacattttcctgccagagaatatttatttttattgctgaaattaaatggcccttctgaagagtaagggagaatcatgagtccagtgcctttctttcattttggtgtcatttaaaatttctgatatttaaatttttgttagttgccaaatgtatgatactttcacacataatttctttaaaaccatgtgttgatttaaatccttttcatacttctacaaggtgatcataaaagctcttccatgagttaatcactgcacaaataattgtgtatgtgtacatgcaggagtctgttgaatattcatgaagcatgcccatgtaattgcctgaatcaggaaacgtaactgtttcaatgctcgtaaatctatacttggatcttctcattttctgatgaaattataaaaccaaaatcgaaacacaaatttataagaatttatataccataatttgatcatgaaaaggaagaaagccatcaacaatttttttcaggaaacactttatgaatattcatcagacttccatgttattgtaacaaataccatgttattgatatggataaccaaagatgctgtatctgaaggaatatgttttctattgctataggaattactgaattcaagtagaattatcttccattgttccccaactaacccttttgctcccacaccctttaaggtttgtgtcagtgtggaattttcgtatgtgggtgtgttacagtgtgctttatgtgtgtgctgtacttgatgtatacatacacggcatggagtgatctcaagtatacactgcatttttgacaaggaaggctaaacaatctttgttaaagagctatattttcataaataaattttaaaaagtgtcactaacgaggcagatacatgatcttgatgagaatgagggtgtcagggatatgaaaacataacacctgattgcccctcaagtaaatagaggcttatattggttttattagtcaggtaggttagggcaccattttgatttactcacagtatgaaaatgttgtgcctgagatcccagacaatttttcagataagcaggttttgtttgtttgtttgtttgttcttaaaataacagctcagaaaaattatgcagcaagatgtataaaatgtcatctatagatttgttaaaattatgagaagtttaaattagcttttgttttaccttttaaaaagggaatggacttaatcaatgcttgataaaattttacagagaagtaaattttttttagccagaaaaattctaaagtacataccttgctcctctttactatgataatgaaacttgattggaccaaatgagggttttatgtgtgtgtgtttgttcatttttattggtatattattaatttgagacatttatggcacagcatttgggaagataacaagggttccatttacattagtaacttttatctgtttgtccaatgacatatagactgaacatttcaatatagcagattctgtaatctgacacttacgcccttaaatctctatcagtcagctctttgctttgccagaaaattgagtgctttctgaatcaacaaagaaaggtcgcattcagtctcaaatagttctagtgttacatatatttttaggtatcctaattcgtggcaccaattaataatttctaagtatttgtgcgtgtttatcatttaatgtatccttacaagaagtcagttttttaaaaaaaatcataatatttttctagatataaacatatataataaaacattgtatcagaggaattcttatgcagtaaaaaagtaaaataaagatatataggaaaactataggttcaaggtatcagggacaacttcataccgaggttagaactttagctggatgttcctgacctttgagtttggtactgtcttatttatgcaagttggaggagacaacatgatataatggaaagtgcactggattaagagttaagcaaaaagaagtctagtaccactgtttgattcgaaacaaaaactttcatttcttgtagcctcaggttccaaaggtttattcatctgcaaagtgaataaaatgaactcagcaacttaaagacctttcaaactctaacattgtttgatcatctgtaacattaggttagtgcaaaagtaattggagttttaatggcaaaaactgcaattatttttgcaatataagaacttgatgatgccaagtactttttttttttttttcgaaataggacctatgaccctaagtgacagccagtatgccatgctttggctttctattaaggagtctcctgtgtttcctcatttatcttgtgatctgccttggcaagggaaagctggtgttgtccttaaaaccatgccgctcacatccgagtgtgtgctctgtgctaacaaactggctctctggtagacaagcctgcatgtgtgatacttgctgtcctggatttgttaagagaatcatatggagagaggattcaggtagcaataaataattatttatatttagtctcactaataagctttgaagggcaacttctttgttaatttttttttctgcagtttcttggcagatttttctagatgcctcaaatcttacccagacccaaaagttataacttttgaatgacatttttttctagaagggaaagtttgtacaattttctaccaagtcatttaagacttcaaattcattaattcattggcttaaaatagcaaataaaagtttagtgaattattctctgatactacttggtttgatatatttaaactttacctgaatcccatctaatatttcatatctatctatctatctatatatatacatagatatatatggaaataagaatatcatgtcaaaaacaaagactggctttaaaatatcaaacaaataatggaaagctcatatatatacatatatatatatatatgtatatatataaaatatttaacaatctgagccttccattatttgttaggtattatatatatatatgagctttccattatttgttagatattttatatatatattatatacatatatgagctttccattatttgttagatattttaaagccagtctttgtttttgacagtatactcttatttcttcttcttgaagttttcttccttagactgtacaaacccactgcattctttttgttcccacaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggagtaagttgtgtttttgtgatgcatttaattgtaagaggtattaaaatagctctgagtttctcaaggatttcgccctggataagtaagtatgttgcagctttgtgatatatactgcaattctgtgtggaaagaaatagtgtttgttttgcttgaatacagcatacattcctgaggcatgaaatcatgctcttcctttcctttaaaagtgctgttaaagctcactctgccttttgtatgagaattaataaggacagggcactctctcagaagctagtattggatcagccactctgtgtctcaaacaagtcaccacccctttctgggcatcagattcctcatgtgaatgaggatattctggttgttgatatcacaccttgaacttctggtgtattttctataccagaatggtgacatagtataattgtggagataaaaactttaggcattgactaagctgtttaactgtctctaagctttagcctagtggttatctctctttttaaaatggagttctcccctcaggttgctaacattcaattagatagtgccaagagtgctaagcacagtgcctggcgcccagcagtctttcataggcagctgttattaggaccaatagggagtctctcttttctaaggaaataccattttgcaggaaaatatttaaaatttagcccaaagttatcaatgtcattgttttaaaaagttttattttaaaaatcgaattatttcctttaagaaagctgtagtacatctttttaggaagtacagaacataaaagttgtgctgctgtattgtggaaggagtcaggaaatagtttatgaaattgatgcagttaagaatcaatgtagaatgcatggcattggcccattagccatataataacgttttctaagatgactggtaaagtttgtagttttcgcagtctgttctcagtgacactagagcatattgctaacaatcaatgtggtcagaatgtaatcttgaggaaaacgtgaactgaaatgtttcagttttctattatgaagccaccccaaaatgtaatggcataaaacaataatttattattaatctatcaaagggcagtgggtgactgggcccagctgggctggacttccaagacagctcatttacatggttgtcaagtagtgctggctgttggctggtcgctcatctgtggctgtgcactggagcacctgcgtgaggcgtcagccctcttagattaaagagggtgcacaataaccatcacctcttgaagatgtggggtaggagatgtaaatggtctcatctcattaggacgtgtgtcccaaaactgggttacatatatcaagttgtcctggcctaatagctctgtgcaataagaaagctcattctcttcattttgcatatatctatcaagcaactgcccaacatgatgtgatacacaatgttgaaattcctatgggagaaaagctcccactgatcagtgaacacagatattctggatgccttagttctgttctcctctgcaaatgatcaagtttctggtttaatcatagtcttttgagagtttgtaaaatgaattacttctctttggtgtaaccactccaaggtgaactgattaatcagacattgtgctctctgcaccctagatgcaaagaaattcctcaaagtttgggtcctccaggaaaccagtcctgatgcccaagtgcctagtctatttagcttttaactgtcaaagcgtacattttggtataaaatctgtccttttgaggtaaaactaaatagctttccacagtaaagcatttgactgtaaattaactgtaaatatgtatttgttgttgttgttgtatgtagaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagaggtaagtttttgtggaaaattttgaatttattcttgttttataagggtaatggaactgtcagtttccagaaaatcacccataccttatagtgactgagaaagccattgcttgcttaataaaatagatgcattgcagcaaatctggctctaaaccaaatttctaccaagtagagtccatgttcccattaacttccattaaaaggtcatgactgtgtagcaccagaaacaatttttgccccaagatagtaataaagcttacacttcaaaagcatttgttttgtgtgctgcatttttattaggagtttttgaaaagccaagtgaccagtcattccccagaggctgacccactggacgttctggaacttgaatcactaatgggagaagtgatgagggtgaggtggggtggggtcaaggttaaggctaaagaacaagcagtaactcagcctgccgaacaaaataaatttgtggaccatactttatagggtttagaattttatttgcttgtgttgtttgtccttgcccctcctgggctgggatccacatgattttatactgcctttatactcttctcatgctgagtatgtttccctatagacacaggaggctcagtcaggcagtggctaaatgaccaaatgactgagccagtcatttgcgttaggcactgtgctgtttaggcacagtttgctgcctaaatcctgaatctacctagcatttcttctcccagtgacctatttccagggcttgagttttgagactaagtgggaaatatgacagtaaggaacttcccaggatggtcttgcaggtcgcaagtttttccacagagccctcgttttgtgcagagcatgctgggagcccagtgcctgccaggaaatttgttgtctactctcctgcagttggtccaagtggttcctctttatcagcagttcatggatgtcagacttcatttgcattattttaatgctggctttaaacatgagctattctttattcaccatgaaaagtcagtttcatgttttggggaggaaaatatataacatttaatataaaatatattttaaaggaagaaaaaatgtgcttttcattaatgaggaaggatgataaaactttatgatactaagatttcaggcccaactaatgatatttatttctcacagatcaatggtcagattttatatggaagaagtcatcagaatgcctcatcaatcattaaatgtgccccttctaaagtgaaaataatttttatcaggtgatcattttcttttgctagtttaccaaatactttttgttagcatttcttctctgagttcttttgaatgaaaagaaaacatttgtagccgggcatgctggctcatgcctgtaatcccagcactttgggaggctgaggcgggcggaacatgaggtcaggagatcgggaccatcctggcttacatggtgaaatcccgtctctactaaaaaaaaattagccgggcgtggtggcacgcacctgtagtcccagctactagggaggctgaagcaggagaatcacttgaacctgggaggcggaggttgcagtgagctgagactgtgccactacactccagctcgggcaacagaaagagactctgtctcaaaaaaaaaaaaaaaaaaaaaaaagaaaacgtttgtaaatttgtaagtgtcacagttccaggttttgggggttaaataattttctctaataaccttctgactcttgaagtaagagaatgaaaataataccatgatgttataataggttgttgtttttttgcttttagaaataaagatgcagtgaatcagatggccgtatgtcctggaaatgcagtagaacctttgccttctaactcagaaaatcttcaaaataaggaggtatatgtaacttatgtttgtttctctgggaagacttgattgatgtgagccttattaattcaatcaacaattacataacacttagagagggatattagaggtagataagttatagccttggccttcaaggagtgtacatcctagtataagaagacactcatggaaataagcataccacttatgtgaagagtacttgtagtctgcctagggaatagtgagggtaggaaaagagttatcagttctgcctctgaaaagaaattgaggataaaactttatatggaaggttacatatgaagtgtatgttggaagatttggggggcaaaaatgttgcaagcggagggcatggagtgaggaatggcatggagactttggccaatgcaggaagctaaattgtagagcatcactgagcaatgaggggcagggaatggaagctggtggggaaagggtcaatgttaaaggggacagggtcagatcatgggatacattgataggccaacatgtgccagctttgtctttgaggcagtgtggagctcaaagaatgagaaatgtttagttaaaaatttctctggcagtactgtagagaaaaatcagaggtagcaggggagagaggttagaggaagtaagataattattggaataattcaggaaacagttaacaaggacctgaactaaagctggaagagggaatggttacatcagatgtttaagacccaaattgataatacttcatccccaactaaatgtactcactgaggaaaaatgagtggttgaagatgtgtttatccaacaaatattttctgagtactctgccttataccagatactgctctttggactggagaataaaacaggtaggatatacaaggttttcagatatctgacttagtgacatgagggatggctgtcttttactgaatagaaaatacagaaagatatttgcaaaaatatggtacattctatttggggcaggttaagaacgaagtgcctgttggatagcctggtaaaaatgtacattgggacatttggtctccagtttagagatgatttcctgtatatgcagatttggcatttcttagccatggaggctgaggtgcttgctacagagagcatttagagagaaagagggccaagggcagaatcatgtggtagcaacagtaaggaggaaggctaaccaagagatcagagactatgaagaaccaggagggcatgtggcagagcagcggagaagagtgtccttcaagggtacactccacagctctacatgctgccatgtagcaagaatccagtgagaagatgagtggaaagagtcccttgggtgtggtaactaggagactgttagtggtttttgagaaagcaaatgatggacaagaagtcaaggagagagagaggcagtggctagagggtgacagagaattgggagagtggttttgttttgatttaggaaagctttggatacatgtgtatgatgaataaaaggagttagtagagaatgaaaagcttaaaattagaggaactttggtgattatcagtgggggtacctgtaggaagagaaacattctttcctaaatgaatatataaacatagagcttatgtatacataagatagatgtacaaatcattgtctcattccggctgctcctaacgttccactaagccacgtggttatttaagataattaggttataaggtaatatattttcttttcatattagttgtactaaatatgtctcttaaggaaatggagtattttaataacgttcattaaagttttcaattcacttgataaataacacagtaaagaataatgaatggtgtttctgctgatgctctgtcactgagtttcaccatttgttagctgggctaccatcggttttcattatacagtaaacccaggcagtcttcaagccacttggtctatctgtgctctcaactgattgctgtccagttacacctcgtaagtattttgaagagaatgtaatgttcataaattccatagaatgttaaaatagcaaaaatgtattataataaataaatgtattaaaatagcaatagtgtattaaaataaataaatgtaaaataattttatataatgtataaaataattttgaataagtggcctttatatttaaacaaatcaaatttcctaacactcagttgctctttttgtcatttctttccctctgtcagacagagccaactgttactacttctgatgcagctgtggacctcagttcatttaaaaatgtgcaacatctggagcttcccaaggtaaatctgctttgaattggaatgaaatgatgtgagttcctttacctcagtgttctaattcactgtgttctcaaaagtgtggtctccagattaacagcatcagcatcatctgaggttttgttagaactgcaaatacttgggcccactcaaacttatctgcttaatgagaaactctagggttgggccgagaagtttgtgttttattagacccgcctgatgcacgtttacgtttgaaaatgactgtgctgatactttatcaggggtccagcttgcccttttataattattccaagttatgaaatttagttatctgtccattgattccttcactaaggtcctgctacggaggaaataaaaataaagaaacagaagttatagtcttgtcctttaaaaataagaaagctcatatatttagaagtgaactttcggctccgatgattgccttaaaaaggcaatcttactatacatataagagaagtctttatcatggactattattgttgtggttaaaaagaaaagaagttattaaagtctttttacctttctatcaagaagtccatacacttcagtttgagaatccctcattctattgccatttaagagagatgacatcttcctctttccctttctgatttctgctcttagtttcttttcctcctaaatcctgaagtaagagtttataatatttaatgatgcagtcatttccctataatttgttaattatgaaacatttaaatgtatgttgaatactttataatgaatgatttttttaaaaaatctgtttatggtgatctttagaaaagtccaaaattagataatttttaaatatcctttcatggtattgattttaatgtatcatctaaggcttagtatattctaggatataatgactgcccaggaaatgtctgtggaatgaacatgttagatggataaagggcaacatactgtagtgattgggagcagacttaaagccagaccacatgtgtcagagacctagatttgccactcactatctatgagactgtgactttgagcatgtttcttaacgtgtacatagtttcaccttttgaaaatggacttaataattgtccaacttacctcatagacttgtagtgagaattaagtatatattgtgaaaattaaatatacatatgttcagtttccagcacctggcacacatatacaaatagtgcttgctattattattgttttaataattaggaatgaataagctggtatagagttgcctgatggctacctgtcactgattttctctgatgttttctgtttccacatctatttccacattaggctacctgattaaggtgcttgatagatgttcatagcatcttaatcccctactcagaacctcccaaggacgttcatttccaaacagatacattcaagttctttggctgggcatttagcaatgagggtggacagaagcctgtgctgtcagaagcccttctcacatcctgagtgattgcctataaatcacttaatcccattggtcctcactttcgtcttctgtaaatggtgctgcctatattaagggttattgttgggattggatgagctaatgagcaaggttccttcattctgcaatataaaagctggtttctgcctttcgcctccttttttatttattcagcagatgtctattatgtgtacttccctttctaaattagatgctattgaggaatgcaagaccttggagaacctcaatgtattgcccgctgaaagcttccatttatatgtagatttcaaacaaatctaaagctcaggtagctagaatgtatttattgatgaaagccaaagtaagtaaggggaacatacaagaatcttttaaaagtagctagacagaagaggcaattaaccatgattttaatgattttaagtgtgggctttggagtcacttaacttctctgggcaataggcaagccatttgttccatggtgagcaggtatatgcaaagcaacctccaaagactgagggagctggggtcctgaagaaagaggctgacaaatccagtttatcagaaagaaatacttaatagggacttaacgtacagaagccatgctgctggtggccacaagacagtggatcccagcatccaccctctagaaagtattctttacatagcagggataaagacatgtagctggtcacgtctcagaatttcttgctgaaacttgttatcagtggagaggttaggtaaacatctttatgaaggattatttatgctacagggctcgctacagaacaccttggtatgcaggagtcaaacattggtcaccatggcggtttcgcttcaaggtggtgtcactcctgccatacaacaggctgtttttctacaccgtttaacttgtctgggtctcactttcctcctgagatgaggaaaatccctttatattagagatactattggaaggattaaatgaaagaatttatacaaagtgcttaccacagtgtgagttattattattatttttgttaatacttctaaccatgaatttgtgagttccccatagaatatatccttgaacacatctcttgaggaagccattgttacaaatgatgttgagtgacatattacactaagcctggcactcctaaccccattattacatggctctgggagtaaaaattaagcaaagaagggagaaagaaacagcttttaacactcatgaatcagctgaaatcttttgtcatttttactatcctatatatttttaaattatagttatttgacaaagtaatttaatggtaatgtaacatttgttcattatgttatttacttcttagcaaccctgtgagcttgctattattttctccactttgaactgttcccataactccaaatagtagagctggaattgaactctggtcttctgcctccaagtcccatttcccatccattacctgtttcaacttgctactgggccccatctgcctttctgaaatgcctgtatgttccttctaggaatcctgtacttcagtcaaactgatttgaatcaagagctcatggagaaggttttgagaatttatccctctttgccttggtttatatcacttggtctttctgatttcttttaacttatataaatcctacatacactaaagatccaacttaaatctcacctctgtttattttgaaatattacttcaatattctggcttatatagtgcttactattaatgtcttcattttatttgtcacttaaccatgtttgaccctagagcttgtctcctgtgatgaactttgatgtgggtatcttttctgtacatctaaaacatacacatgctgagagaagaaattctcacttttttttccattactcagtgtcatcaacatagttcagactgtgtaagtatctgcgaaggaagagtgaatgaacggttatgtgccgtacatgcataaggggaaaaatgttgagatcaggagagtcaggaagagaatgatttttgcattgtctaaaagtgggagctctaataacagctcatttctagttctgttttgactccttagaaactcctgagaagtgaattatctttttttaatcttttatattttttaaaaatgggaaaatagaatataagcagaaagctctcatacatagaatctaaacccacagtagctgactgaaatgcaaattcaattgatcagaaaacatttttgattaaagatttatttttgacacagtttgccctaggaaaggacccatacatcaaagcaggtagtagccttctgtgattgtcaaagctgtgtttcatatccatacaagtttatgtggtgaaagccttgaaatatgatgaagagtttttcttcttttgaattttagagaagtttctaccttcaaaataattctccaaataatattaatttgtttagctgaattccacttttaattcttgtttactcttttctagctgtttaattatacaactcgttgttcaaaaatatatttccttggagccaggtacagtggcacatgcctgtagtcccagctatttgggaggctgaggtgggaattcaagaccagcctgggaaacatagcaagaccccatctctaaaaaaggtttaaaataatattttaaaacagaaaaaaacccacaaaaatatatttccttaatttgttttctattccctgtatggtagtgttttaataactagccccaaacaaaatatctcagatctcttcttgctaaggactatatgcactctggtaaaagtaagttggaaagttgagcagttagataaaaaattgcacattcatatgctgttatcctttcttatgtgtcatcctgtttttcttttcatttatttatttttatttatttatttatttatttatttatttttgagactgagtctcactctgttgcccaggctggaatgcagtggtgtgatcttggctcactgcatcctccacctcccgggttcaagcgattctcctgcatcagcctcccaagtagctgggattacaggtgtgcaccaccatgcccggctaacttttgtactttaattagagatggggtttcgccatgttggccaggctggtcttgaactcctgacctcaggtgatccacctgcctcagcctcccaaagtgctgggattacaggtctgagccaccacgcccagcctcatcctgcttttctgatatcaataaattgtttgttgatgtgtatatagttgtttttgtagtattctagttgagtttgggcatattatacatgcagatttgtagcttattgtttcttttaggactcctcttattgcaaataacagaaaaaaatgaactaattccatcaggtttcatcaaggaagaagatttatggactcaggtcagcaaccttcaagggtagttggtcctgtgactgaacagtgtcatcgagagcccgtttttttccctgtctgtgtgacactgtgccatccagtgtcagctttatcccaaggcttgtctttctcatggttttagaatggctgccaaccatagtttggccatgtgctacttcttttacatgtatcttgggagaagggagaggatggctgttcaagccttctgagcaaaagttccaagattcatcctaattgaatcaattcagatcatgtgtctacttttgagccagggactgtgaccatgggactgtaattgtagaattgacttcagttgttcaaaccccattcttggagctccttaacttttgctatgtaacaaattaccaccaaacttcacaacttaaacagcaggcatttatggtctcacagtttctatgggttaggaatttcagagcattttagctgggggttctgctgagaatctcttgtgcaattgccgacacattgccagctacagctacagtcatctcaagatttgactgggctggacattgcttccaagatgatttacccaaatggctgttggcaacaggccttatttcttctaaatggggctgcttgaattttcttaggacaatggcagctggcatcttgcagagcaagttatccaagagagacagcaaggaggaagtgcctttgccttttttgacctagctgtgaaattatacaccattacttctgctgtattctctttgttagaatcaagtcactaagtctagcccatgcttttaggttccttcctgaaggaagaagtatcaaagaatttctgctcatatttttaatctacagcctgaaacatagtgagggaagaagggggaagagagaatatggaggtggaggagagagaggagtgggtgggaaggctagatattctaataaaaatcaatttttatagaggggtaagatgggaagcagtattaggtaaacaatcagcaaatacccactgtaccaataaagtattttcatgactgttatgtgacaagtattattattccattttgtagataagaaaatctagatttcgtaggtaagaaaattgagaattagagatgttaagtggcatatccaaatttctatagttaggtagaaggtaaagtcagttctgctcactctaaaggtgcagcttactctggcagatagacatgactgattgcctggaaagagagaggtggtagagagatggtcagtgacagtttcaaactcatcaggcattaataatctacctcagaagagccacatgttgataatctttaaaatgatgttgaaacctaccttgatgtcacagccatgaccataaacatctctgatggcacatttaacttgtgtgtatatttcagagaaaccatgtcaagattctcttttcttttctttgctttttgtaacttttctctggagaaaaaattagaaggtggctagctctggcaatgaaaatgttaaaaactctgttttaattttattaaagtaaacattaaagaaagctaaaagccaatatttctgaacatttggttttgataaagggaaatgtggaaaatgtagcgaagtaggtgtagctccccagccttggcaggttctcagagcttgtcttgggactgagaggcattttcagtctgcagcagattgaaatgctgttgtctggagaaacaagtctgagtgttcaccccccaaaaggacagagtctgcatcagtaatggcagactgcctgctaaaggaagaagaggggcagaaaagaatgaaggggctagaccctgttgttatttccaagcgacaggccagagaagaagcgggattctttggttggttttgaatgacttattcagtcattagacaaaatttgtaaatgctgaatgttttggttgaattattgaatgtatttttgctgtctagatattttgctaaagttactaaagatgtcagacatatgggaagagtgaaaacacttgaatgtttgatggaggaaaatttattcccattaggaaaatttgaaagtttgtttaagaaaagacaagatttctaagatcttagatttaaagtctaaggtcttagatttctggacttcagaagagttttagttgtttttcttacccttggtatccatttggataaaattaatctgtttcaagtcttctgagcatttttgtttttacttttctaggatcaggggggtttgggtattgctatcagcgaagaagatacactcagtggagtcatcataaagagcttaacagagcatggggtagcagccacggtgaggtttacctttcttgctgtcattaagtagttggggagggaattacttttggaatatcactcaaattcttctacgtttccatttaggatggacgactcaaagtcggagatcagatactggctgtagatgatgaaattgttgttggttaccctattgaaaaggtaattttccaaaataaagtaaatggtaatgtaggcccatccttgggcatgattaaagtgtttgtgtctgcgatcatagagaattagggttatgtagctgtattagacatgttcttaaggaaaagaagagattgttcagaagttcttcaatttctatttcttattttccagttggtgttaaggtatttttcgttgccacacaaattattcaatattcactgggcagttttgataaatatttccattttttccttaggaaaactttaaactccttaacagtgactgttagtgccaaaatattttttaatgaatgtttgctgttataaatatccattgtgtatactactttataaacagattgtaagactcaaccattaaatacgtaatttttattagggttaaacatatcttgtacttgagttccctctcctcaaaagagatcttaatacttatttggtatctcatttgaggccttttatttattagtgccagaaaaaagctttgtttccttgaaatatggtatgctttttctttcttatagtgagagagaaccatataacttatcatttcttcattgtacagtaagaagcttaaagttactttttaaaaattcagtttttagtaagtatttaggccagatcctttaacccataaatctgtgttttaacttttcgtttaccttgacttttttgttgtatacttttcttattctgcttctaacatatgtgtttctattttattaaaactgtttgtgtaagttgcttctatagaatcaggaagtaggtaaaataacccatatatcttctaaggttgtaggcattcagaaaaacggatgagattagagatgtaaaaagttgaaagtcttatataagaaaaaaatgtggtcagagctagacttagagtagaaattaaccatggccctaatctacatcaagcatttggaaaagctagagagaaactagagccatttctttctttacccaagtcctgacaaagaaataatttgcatctgtccctccccttaaccatagagagaattagattccattgataatggtgactcattggtatgtctactaattcagctttgaattttgtttctcttccacacatacaccctgccagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaagtaaggcctctggactcatgagagtcctgcacatatggaacacctgaactcagcagagggtttctgcttgggagccagctgcctacctgtggctcactgtttggaaggttgtagtcagggagccctatggtgagggcaggatataaagagaggacttctggaaaaagagtactggactgttaggcaggcaatctatgtgctgtacattaagcagctgtggcatcttaggaaacctacccactcaaagcctcagcttcttcatctctaaaacaagggaatagtattctttgctctccaaaaatatattgctaagggcaccttgattccaggcctctaactaatgaattagaaatatcatttcgtagattctttttttaagctgggaaagtaatttaacttctctaagcctcagctttcttttctgtagaatggatatgcaattatcctatttcataggtgggatcagtactgcctgccactgtaagaaactctttagtcattgccatgatctacagatctgagttctatgctttaggtgtaatagtgggtcctgtcataatggaaatggatttaggttacgtgaaccatagggtgacactttaatgtgtcattacacttccagtctagtatatggaggtacattattcctttgagttactttttgagaaagaatacactggtgtgtaataaaacagtttcaagctctgcagcatcaaaacaaacaaaaaaaaataaggcattggctttttctgtaacggggggtggaggggagaaatttcttttggcctccaaactgttcttttaacagttttttaaggaaacactagtttaaatcatttgtaatgtagttggatgaaaaagtcttaaagtaatacatctccgaaaataatcctttatttagaaagactggataattcactgaagtgttaaaagattttatggaaattttctcatttttcaattttatgttgatccctaaatagtgttgtctataaaaatatgaaatgctagatgaaaacttaacataaaagaaaatatcttacacctgttcttaccatttaaggagcaagaaaatagtctgtttctgatttcctaaaaagagaacatcttgtctaaagcatacgctactataccaagtgtcctagctttcccaaaacatgctatttgctgtatgctctttgttgtatcgtaaaacatatgatatgaagactctgataaaataatgtgtgaaattatattccccttttctcataatctattcttatctattcatttctgaacatatatgcaccaggatttgacatctgaatgtataaaacatcaagtgagacccaaggagaaaactgcaaatggtgcatttttgctcagaattgattacataagaagagatgctctaggataagaagaaaacaaaaatgtaaaaagccccgaaaagcaggcatcagaaccaaaattattgatatgttttgtggtattccctgaatgtacttctaggtctttgccacatatctcagttatgagttctataaatcttttaattcataagaaatgtgtttgcctccattgaaatggagaatatcaaagtgaaacttgaggttcaatttaattctgttctctcttcttcatatcctctcctttatatctctaccaatttaaaacatgtaggatagcatagaaaataattaaataggtaatttttggcccactaccctaaattaacaatggtgatttaatcacatttgttttatttttaaatataagataattaaaagattgaggtaaatacaaagtctcttttcccacagtcatgggcccatttctctgccccatccctcagagtcaatctgtgtgatgagtttgatggatatgccttagtaaccaatttttatttgtatttcatttttaacttatttttagatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctggtgagcaccacccagaggtgcttctgtacaggccgtccttcagccaggcctcagagacgattatggggagatttctatcagttctagtaaaggaaatgtgaaggccgaaaaaacctgtatttgttattttaatttatagggcaaatattcaattggatacgggggaggtttcctttgagtaagccaataaatattgactcagcaatattctgctacactggtgattttgatcttgaaatttcaaagtgtttctatcagttcaccagtccttgctacattttaatttcctttttgctgatatccaggttgggttaaacccattttaagaggagtttgagccaggtgcagtggctcatgcctgtaatcccagcactttaggaggctgaggcaggtggatcacttgaggccaggagtttgagatcagcctgttcaacatggcaaaaccctatctctactaaaaatacaaaaactagctaggcatggtagcgtctgtaatcccagctacttgggaggttgaggcaggagaatctcttgaacgtgggaggcagaggttgcagtgagctgagatcgcaccactgcactccagcctgggtgacagagtgagactacgtctcaaaaaaaaaaaaaaagagtttgaaaaattgatactttgtagacaaagtcttctagatgtcaaaaataccttaaaagtgatttcatttatggataagaaagttatctctcatctatgtatgcatgttttattttatagtttttttctttaatcttctctatcattaggaaaaaagtataagctcctttgagccttttagcaaaaattgttgttacactttcccttgaattatatggagcttgtactgtagagccagagtttataacccttattgctgtctatcaaagtataatgtgtttggactccatttctgctcaccattcctaggagaatgggataagtatgggtatgttttgtttgggcccttagggtgccattattatccatgaagtttatgaagaaggagcagcatgtaaagatggaagactctgggctggagatcagatcttagaggtatagaatgcctgtttttgaccttcaaaattaacagagaaaaggctcctggggggagtgtttctttctttgcttctttctctctcttcccttccccacctaactctcctttacttctcatgttccttacagtcagtgtcccatttctgtacaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaaggtgtgattgaggaggacaaacccaatgctcccttggaaatgatgggacttaaatcattttaaagagtaatagcagtaggtgaatcttttatcagtggctagtgttcagtaggtagctgttgttagccccctcactaaggaaccataaaaagacattggttttggacttttaaaatcagaatattggaaggttttgaaggcacttaacaaaaagtcatttggtgtatttttgagcacctgctatgtgctaggaaatacgttaagttttcagaaacaaagttaaataagacatggttcctgaactccaaaaactcatcgtctggtgaacgtcgaattaaatatattcttgcaacaaaggaatctattgatgagtgacaaagatgctttgtgggggacccatggtagcaaaggagaaagggaccaagtgaccctatttaattaaagtgaattagggaaaatttccaagaaaaaaggtgtctgagctgaggctaaaagtgataagtgagtattggtttattaaaggagagtggaagatattgtagggagaaggatcagagcgaataagagcgtgccatcaacagggcctaaagcagggggcccgggtggtaatggaatagtgaatgcgcaaaaattcacaacctaattcatttgtatatgagtacattttaaaagtatttacatgtaagtaatattaacaaactcatttataagtgatattaacaaataatccagcaagtttcataaatctttcttccttttagtattataagcccatctggatctgatctcagaatctaccagatagctaaacttgtgaagtcagcattcagtaaaaagtgcccctgcagtctgcagtgtctctaagtttattttgtcatttcttgggcctcagatagccaccatttcaaagcagcttattttttccagtgagtcagaaatctgtgaaatggtgatctttatttcagaatatccttctttggaaataggcattcttcagaattgccaaaccagcagcatagacacctggttctgcagcgacttttctgtatggaaataaaaggacatttacaccattttgtttctcagagacagctaaaggctaattatttttaaacacagaaagaatttagcatattatttgagtgtcagtgggaatatgtctaaaaaatagactttttttggaatacagtatcagtagtctagttctcatgaaatatgacatgggtaacatggctactataggatgtggggtcaccaggtcatcataaaaaccaccattaatgaaccctaaactctgtgccttgggaagaccatacaaagaccgtctaatccaataccctgtttctaaagatgggaaagcggaggatcaaatggtgaaatgatttgatgtcatgaccttggcaagaacaagtgatacagttcagcttttactatatatttctatttatggttatcttcgtatctttagaagttttgggttttttttttatagttttgtgaaagaaaggatgggaataagatttgtgtttattttgcataaacctatctcgtgtggaagatgtgtaatgatttcaaataaaagacatcacagcaatggtacttagattttgagttaataaatggtgtttagtttgagatacacatctgttatgattttcagtaatattaatgatggtgatagcaacatttatgtaaccacaagttaatattattcaaagctccattctgatttggaaagaacagcagattttgcatccaaggactgactcttaagtcttacttttgccacttagtagccgagtgacccataaaatgagaatggtaatacacgcttctactcagtgtatataaatgatgaagaataaatatgcttattggagatcattttaatctatgaagcactgtaagacataagctgttatttatcaaaaaatataattctaatgttgccccagtgttgctccaaataacaaaacttttaaagtcataaaaacaagtaaaaattttgggtaaaaacgtaactttttattaaataagcattgcattacagttgagcaaaagataatgttgaaattcaaaattgtgtgtagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaaggtaaaaaatgcaaaaaataattctgtgtaatagcgtagaagaaaaaagataattttaacattgggctatcatagtcaaattagtaatgacttctctttatttaaagtgtcacctcaaggccaggtgcaatggctcacgcctataatcccagcattttgggaggccatggcaggtggatcacttgagactaggggttcgagaccagccttggcaacatggcaaaatcccatctctacaaaaaaatataaaaattagttgggcatggttgtgcgtgcctatagtcccagctactcagaaggctgaggtgggaggatcgcatgagtctggggtcacaccactgaattccagcttaggtgacagaaaccctgtctcaaaaaaataaataaaaagtcatctcaaatcttttaaaatgaaaagattttatcatttatgttccatagaagggaaagtttgatcaaaatactattctgactcaaaactgttgaactatttgaagttgacatttaaaatcagaagcagatctgtcatccttatgcaacgaaggtaatttaatgcagattcactcagcagtaccttcactggggattatcgtaattataaggcctccatccctagatatcattctaaactcaagtacattttacatcataaaattggtttcctccaaagcaaactcaccatgaaggatcattttctgattggaaaggcagaaccagtttcattttaaaaatgaattaattgtaaagcacagaaaagtcatttgacaatataattcctgggactctaggcatattctctgtcagggaatattccagtttctagaggggatttgcattcctgtaaataggcaatgcttatctccttgttttgtttttttaacctagtgtgttttatgacctgaagaaatataattcaacattgactagaaaactgtcatcatcagtacccatgtcaagggtagcaattaacataagcctgcatgacagtgctcagcagcagtagagctgttggaggtctaatacgctaaggggagcctctgagtggctgggcttcctggagggattttcaagtaggtgcttgttactcacctctcaggtttatataagatctggcatatgaatgtgtttataaatttggttattaaagcaaagttaacattcgtcacttctcattaggtttctcaatctttaaaacataatgtaattagaattctttaaggaggaatacattctttttggagacacattaaaaacaattgttatctctgtaagaattatatatcctaaagaaagaaaaaatggaagcatccataaaacaatgtaaataatttttaaaccagtcatttaaaaatctagtctcaccaggtgtggtggctcatgcctgtaatcccaacactttgggaggctgaggcgggtggatcacctgacgtcgggagttcgagaccagcttgaccaacctggagaaaccccgtctctactaaaaatacaaaattagccaggtgtggtagcgcatgcctgtaatcccagctactcaggaggctgaggcaggagaatcgcctgaacccgggaggcagaggttgcagtaagccgagatcgcatcattgcagtccaacctgggcaataagagtgaaactccatctcaaaaaaaaaaaaaaaaaagctaatctgaaagtatataatgaacaccataaatatttgtataacttacatgtttgttgttggggctgcttatttttgttttattagtaattgttcatttaaaactcttatgtaaataatcctctatacacaacttcatgcacgtaaagttcctcatgcacatagagttcattgaagtgttatttgtaatagtgggaaaattggaagcaatgtggttgacaaaaactatataaactttggtataaatagcaaggatgcatggcaaacatgtatttgtttgaaaggatgttcatgacaccttttttttttttttgagacggagtcccgctctgttgcccaggctggagtgcagtggtgtgatctcggctcactgcaagctccgcctcccgggttcacgccattctcctgcctcagcctcctgagtagctgggactacaggcgcctgccaccacgcccagctaattttttgtatttttggtagaggcagggtttcactgtgttacccaggatggtctcaatctcctgacttcgtgatccacccatctcggcctcccaaagtgtcatgacaactattttaacatgataaaatatatacagtagtcgctcctaatctgcagtttctcttcctgtggtttcagttgcccagagtatagtaaaataaggtatttttagaaggagagagagatcacattcatataacttttattacagcacattgttataattgttctattttattatcctcttatgtctaatttataaattaaaccttattttatgtttataaattaaaccttatatataggaaaaaacatagtatatatagagttcagcactatccatagtgtcaggcatccactggcggggggtcttagaacatattcccccctataataaagggggactactgtaattagtggggaatataagacagaggattgtatttaccgcatagatgcaactatgtaaaatacaatcttataagttttttaaacaataattatgaggtaattgttggacttatgggtccttttcttcccccatcttttttcattttatttccaaaattttctttttactgggcgtaaatcacttttgtattggaaaaattaacacttttttaaataatcaaaacccttgatatttgaaagagaagtgttacaggtaggtgaaagggtcgcaacattacacagtgaataacgtatggacttgttaaccttacagttatgtaaactgaaaatataaatagtttcaagaagagtttggtaagaaaccccaaaccaaacaaataaaaaaaccaacttatggatattacaagtcaagttttgacctttcagagtatgattcatgatcaacatcttcagaataacacatccctttgtactctcatcactgaataataatatcagtgcccaatatttatattaatcttactccattctagacactgtcataagcattgttcatggtttatttatctcaacaacctataatgatgtacatttttaaaattcagagtaaaagatttattaaggttaaacatccattacagtcacacagctaataaatcacatagtctggatttaatccagtgactccaaaacaggatctcaaacaccttcttgtgctacttcatattagactgtgcggcatttcttgcatgcctatggtttatttgtaaaggggtgcaagaaagattgtcttcagttcatgttttgtgttgatagcagtatttatctaaattttatatcataagtctattcaggcacagtgtagtgatagagaatttacccaattatctaagtacctcttccactgagggcaaaacaagttgctgaggtggtggtagtggtggttttattgtgttcgcttttttttttttttttttttttgaggtggagtctcaagtctcgctctgtcacccaggtggagtgcagtggcatgatcttggctcactgcaagctccgcctcccaggttcacgccattcttctgcctcagcctcctgagtagctgggactacaggcgcctgccaccacgcccagctatttttttgtatttttagtagagacagggtttcaccatgttagccaggatggtcttgatctcctgacctcgtgatccacccgcctcggcctcccaaagtggtgggattacagtcgctttgttttttaaaccctcagttattcagcttgtttgtcctatcaaaattagtgtgtttcatgagataattgctcaattctccatttctttttggtacaagtagtctccatagaaatcatgaggtgataaggtaaacacttggtgttgctgctgctgattatttttattagtttgaatgttttataaaaagccattttccacaagggattggaggtatccttgcttatagaaattccaaaaggaagatgcctttcaaaaaagtcttgaagagtaaaatgtattcctaaagatgattatagcattttatttaaacatttccataaaacaccccccatgcccacccccagtgttccctaggcacagtaaccttggaagttggaagaatcaaagctggtccattccattcagagaggaggccatctcaaagcagccaggtgggtagctgtggagttcatcagggcgatgcaatcggcatgccaagaggacacatagatggccctgactgtgggtctgtgtacaaggtctggtcccctggcagcgtgggatagtgactgaggtgcagagtttgagacagagaagaacaaggaatcagaatagccaggtaaacaaggtgtggctgttgagtagtttgtaagtcattctaaggaaattgatttcaagcattcttttttgacatgattcattttccataatctcaaaaggtaactacctaattgtaaagcctaccaagataacaaattttttattattttatttattttatttatttatttatttattttgagacagagtctcgctctgtcacccaggctggagtgcagtggcacaatctcagctcactgcaaccttcgcctcccgggcgaagtagattcttctgtctctacttcccgagtagctgggactacaggcgtgcaccaccatgcctggctaatttttgtatttttattagagatggggtttcgccatgtcagccaggctggtctcaaacgcctgacctcgtgatccacccgcctcagcctcccaaagtgttgggattacaggcatgagccaccgtacctggccccaagataacatattttaaaaatattttatagcaacatcaatcaatattcaactgaaaagtcccatataagtgaactatagatactcagcaccatgtataaaaatatgatgttaaatatttcaagactcttgacaagacctcttgaccttctcctcagtgttgtctactgatgatggaaacccattttcatcagtctgtccttaaagaccccatactaactttctaaattactaccatgagtttcctattagctggccctaattctacagtttttgtttaagtcctagtcttcctacaacatcagtttaaatttaaagaagattagtttgaatgagattatgactatccactaaaattttaggtagattggaatcaatttcatctacccttttagcttcaatttatttatgtcactagacacattctctgtttaaaagaaaaaaaatcagtaggaactgtgtttaaattgctcatcaaattatcaaatgccactgttgcttaacaggtatctgtctctagattaaattctgaaataagtggtatttagggagtatgttacttgcaaaaccttctgaaataattgttgtatatttgtaggtgagtgaaggcagcctgtcatctttcacttttccactctctggatccagtacatctgagtcactggaaagtagctcaaagaagaatgcatgtaagattggttcagtattttaaacatggtttgaatttggctgtcaacactgatttttttgtcttgtttacctctgagctttcttttcccccaaatcatcccatatccaaatataggtacaaaaacacgtgttagcaaaaagtctgaacaacatgaagttctgcctatggcagcttttcccatttgatgtttaccctacaagatacactaaacattataatcaggattctgtaatttttttttcttactaagcagattggtgtttttgattttattccttttctgtgtttaatgtaacaccagtaaatcagaagatgccattaagtgaagccttctttttccatgaagattgcaaaaatttgagaaaattaatgtgatcctcctgtgttttaattacgtgaaatcatgctgcagagggatttttggcttggtgcattggttgagagttgttcaaattgaagaaactaaccatatggcaatctctgtttgcagtatgactaatattctagaaatttaggcacttaaatttgtgaatttttttaatgcatccatgactttattcctctcagccgtgcacatgtgcctttctatgcaaaacacattctgcccttgactcattcaaagtggattacatagttatataatcaacacttaaaatgagaaggaagaatgggatggtatacacgtttttccaactggaaaaataaatagttctgtgtaagacagatctaatcatgtgtactagcagctttgagcacccccttaaaaaaagaaacctaggttatcatttagtcccatccagctttagatattttaacgaacataaaaagtgaatgaacataaaataaccctattttatcttttttgcctttacagtggcatctgaaatacagggattaagaacagtcgaaatgaaaaaggtaacttggggagagaaaacaatataaaccctggcgttttaagagacatcttcatatgtgttttcttgttaactttcttacggttttaaagtattcatctcaaaaagtatgtattcttacatattacatgtgaaataacataatgtagtccttaatgaatttcctgatcacagcacctcatttgaaaaatcgttgtttgcatgctctgttttgctgaaaatagcataaaattgaccccacacaaaataataccatgcctctcacttcttataagtaaacctttctcttcaacagatacttattagttctgaaacagattcccttgacagccatgcacaagagacaaagtaaaagcagctgtgatttattgagcttttactattgttctgagcactcttatagacacttcatgtcatcatcatgtcatttaatattcactgcagccctctgtgagaggcactgttgtctccattttgtaaatgaagatctaatgatttattgagtggagtggacttattccaagttccagcatttgcaagtatgacttcgtggctttgaacacaggactctgattccaaaagtgtggtcttttcacttcatgagtttacctgcttttcatcagttccacaacatgattttcatttagcatgtcttgatttattttacttcctgaacagatgcttattttcctaagccacgctaagcacctgtgtcaagtaaagtaatgcagttttcttgcacttcttcattttccccctcacacttagaaaatcagagttgactatagatatcatgccaaagaataaacaaaaggtcaatgaaaaatatcactttgaccaaaattttatatctgttccatggcagggccctactgactcactgggaatcagcatcgctggaggagtaggcagcccacttggtgatgtgcctatatttattgcaatgatgcacccaactggagttgcagcacagacccaaaaactcagagtgagtcgtactatcaaccctagaagccctagcaaaatgtgcagaagtgtttttataaacctttgaacctggctacctgttgcaaggcagttttaaatatctatatttacttttaaatcatctaatccaaccacagcaaggcttgcttggaataaaagataaagaatattaaaagaaaggagaaaatgcagatttgcagttaaataggaagatttatagttgtttcctaatacatatttttatatgttgaaattctgtggaacaagctaaaagagaacagaaagtattttcagaacaccagtatgaagtgaaatttttatcttatatatttgattggtttaaacgccgatttaactctgttaaattgaaaagtattacttatttgcattcactgataattttgcagaagtttaatataaatatgacttacaatgttataaaactatatgcaacttgcctcaaagctgagggattatccaaattgtggagcattgcaatggaatttatgccaactgcccagctctaaaaattacatgaatattccattaacgcaactcagtctctctaaagcaaaatctctatggtttcatacctcaaataggtctcagaacataaccacattttagtttaaatagtctttaggctgggaatggttcagcctcatttgatatccaaatttatggctgacacttaaaacctgattgtatacatagcacagggtcagtaaacttctggaaggacagatactgaatattttaggctttgtgggacctgtgagtctctgttgcaactactcaactctgcgctgtgaaagcagccaaataagcatggctgtcttccaaccagactttattaaccaaaacaggcagtgggccaaatttggcctctgggccttagtttgccaacctccgacttagagtcacatctaatgattataatagtaatgtccagagaaatttcagtttccaaatgatagtgaatttttttttcttttaataggaagtaatgtctcacccaagagaaatgaagagcagggaagagtgactttctccttctccctccctctcccctggatatggaactcaaccattatgcactgcttctttttgtggttgctgctttttggacttcttggaattagtggtttccttggttatatttcagtggctggtagcagtatatatgtcatgtggaaggtggagaaggaaatgaatacttaggtctcaaagacccactctccatggctgctttagcagatggctgtttctttctctcccttgcaggttggggataggattgtcaccatctgtggcacatccactgagggcatgactcacacccaagcagttaacctactgaaaaatgcatctggctccattgaaatgcaggtaagatttttatcccaagcataattcagaatataggtagcctgaagacacatgagctttgatgttaaagcagtaaaaatgattaaatcttctgctattattttatttaatatttctcttgaacataaatgattaaattaagagttccaataaagtgcatatgagacatattttgtaacattttactctgatgcattgattgttttatactttaaggggaaaaaaatccaggccttagcagtacatgattatttgctggaattttaagtggtgctagcaagtggcttatattctaaagatctttaaaaagtaattacatatgagaccacattttaaaaacatcaaagaactttgtagaatagaattagaagaatatgtttactgtcaggacagttaagagcctctggaccttgtgaaatttcattctctttggttgtattttatgttaacagaaatgtttaaatgaacaataaaatatacattttaatccaagtgctctttctgaagaaaaattactttccctagccacaggaacatgtgttttttctgtttatcctcctcctgtgcgcaggtggttgctggaggagacgtgagtgtggtcacaggtcatcagcaggagcctgcaagttccagtctttctttcactgggctgacgtcaagcagtatatttcaggatgatttagggtgagttcatacatgatgattagtgtatcatttttcacttatgaatcaagtcttcctgacagttgcgttctctgtcccatgtttctaggaattacgtacaggtaaaatgataggatatatgaagtgtgaattatacatatcaggtgcttctaaacttaaataattgtggcatggatttagctgatcaaagataagtagagatagataactagctagatagatatgcgtgctactacccttcccatggtttcagctctgattttggggcggaggacattttagtcttgatgttaccacttcatgtaatatggagcaagtcaaatctatcattttaaaatttcccgcactgcctattcatctaatatattatcatttggactgaaaaaattcacagtattaagtaacaatacttggatacaaaagcattggaaaacagaggagaagagagaggcgcattagaaattttaaataatttgatgcagcttttccattgcttataattgatttttctctctgagcttgggcgtactgatgtttatgacttattctaatatagtcccctgaactttagccctctcactttaaataaactggaaaaagaatgagcttctctgtacaatgagaacatgccatgaatatgttagtttaagggaactgtaaatgagtaatagaattagggtgttaagtaggatttcattagattatgtaaatttaaaataccaagcacagcatgcactgacaatttaagcatctcaaaaatacccgtaatatactccttgtcagtaacaaagagaattatgctagctctaggtggatgtcagataattcataacatatatatatagttttttttttttaatttaaaacctctttttcctttccttcaccgtagacctcctcaatgtaagtctattacactagagcgaggaccagatggcttaggcttcagtatagttggaggatatggcagccctcatggagacttacccatttatgttaaaacagtgtttgcaaaggtaagcttgcaaattttaaccaccctcttttcccctaaacattcattaatagtggtcagcagctggcttattagtttatggcctgaggtaatgccaaatggttaacagttgatcatttcttttcaaaactccctacaggaacaggtcattaaatatttttgtccaatttgaggtttcattatatttaaaggaaaataggctcaaattgaaactccatggaaactcaacaatatacataaaaatattaatgaactttggttagtaaagcctatttttttttctttgaacacaaattgcacatgatcgtcttttgaaaatgggacattttaaataagtatgctgtagagcactggtatttctgtttgcatttttttgttgtgaaatataaaatagttatagagaagtacataaagtacacatgaaaattaataagcatttattttataaatttaatttcattgaataaaacaaaaataacctactgaaaaaatgtagggagtatccagcagccctatcatctataataagtcagcgatttgcaatcaagggattcaattaaaaagactgtatagttataattatataatacctattctagcttaagaaggtttagaataagaataaagatattgcagtactggtaaagctattaaaataatttaaacccatgtaattattgttaatatgttaagtcgtttttcaggggctacaaaattcgacaagattttctgcagggaaaaatttagaatctcaaaattttacagtgtcaaaagaaacaaaacttagtcaaacgtgtttaaaaatttgatacagggcctttggattagtggtatagttctttatggatattttattttattattttggaaaagatcttttttttagccaatttaaagtgttgtacctacaacaagctagctataggcttaatttataagatttttaaaaaagctatcggtatgtccaaaaatacaaacagcatttgctagtgaatagaagagtcatacagtccttttcctcagcctaggaacaatttatttaaggcatgctagttagaacatattttaagaatttcatcattatggattcctcattaacttttccatatttttaattttatatttaattgcataattgtcttctataagcgtgctttaagatggggttctttttctaacaccaatgtctgtatttaatcttaatcatttagggtccataaggaatatgaagaatctctctacccttgggaagtaagagctaagacagcttgaatagctttttcaaaaccacaaaaagaaatagcagtgggttttaaatttagaacttatgccttatcctgccatagggaatgttcaggtggctttgtgcttttgcagacctttggattttgtcatcccccaagcccttgtcctgtaaaactgtttttgttcctacctaatcctttaccttctttctgtaggtcttatttacaggatagaaaatcctggattctattgaatcattcctactaggcaaattcccaaatattctttattaatttgtgttcccaccaactgctgtgctgaacagccaaaaacccatccaactgatctatcgactgctaaattctctctcaaattggtatctcaatgctaaaaccatttaggagaaagaccttctttgtctatgttcatcattgcttaatggcttagagcacccatggagcactgggagcagtgtgtgtgtacaagcagagcaatttacattcctgttgagatctttttctgttgtgagttgcaaggcagcattttttgagaaataaacaagtctactttataatttgcagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaagttaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataagcagcaagcattttttttgttctttttactgtggaaaagctttgttatatactgttcaagatttgcaacttaaaattggtttttatcatgtctaactgcacatatggtgtccatagttacagctaaaggaactttggacaacatcattatggaaagcttaatattttttacctccacaattttttctagcactaaagattcatagactcctcatagatgagaggaagatgacattgtagaaagagaagtatcctgcctgtatatgtttttctcaaatgctgttaatgcagtaatattgtaagttgctcttttgtgtggtcaagaactattcaagtgtattcagatggacaaaatcataatcaaaattatttgtattaataaacatgacaagtccaacttgaacactgagcaaggaatgaggggaactctgttctactagttttgtaccaaattagctaacaaacgtgcatttccctctcattcatcttatctgtaaaatgatagattattttatcacaaaggttctatttagttctaaaatataagaattccgtgattcttagttacacaaaacgaatagaagaaactgcatattgtaacaactcaaagttgttaaccaatcattgtaaatttaggcgctcaatgtaacaaaactcattttagtatcccagtgacacatctaccttcttagccatcatttagtggctctccataacgaaagatgccattatttcatggtaggctgctggaagatgaactaacctcacatctgagtttgagctagcaaagaatttttatagaggatgctccataccagactgtatgggagaaagccacccaaccccttcaagtttcataatgtctaagtgcccccaacaagaacagcccagtttaaatagtgtcttcccatgattcatgtccatctggaacctcagaacgtgacctttggaaatggggtctttgcagatgtaatgagttaagttcatgctgatttagggtgttctctatcctaggactggtttctgtgtaagtaggtattgtgaaggcacagacatagggaagaaggccccatgaagatggaggcaaaacaaaacaaaacaaacaagccaaggaatacctagggggccctcaaaagctggaagag

SEQ ID NO: 15237 - DNA, 5954 bp, Human
gaaaggggccctggagttgacatttaaaaagcaagcaggggccggcggcggtggctcacgcctgtaatcccagcattttgggaggccgaggcgggcagatattgaggttcaagagatcgagaccatcctggccaacatgatgaaaccccatctctactaaaaatacaaaaattagctgggcgtggtagcacacgcctgtagtcctagctactcgggaggctgaggcaggagaatcacttgaacccaggaggcggaggttgcagtgagccgagatcacaccactgcactccagcctggcgacagagcgagactctgtctcaaaaaaaaaaaaaaaagcaagcagccaggcgcagtggctgacacctgtagtcccagcactttgaaaggctgaggtaggaggatcacttgagcccacgagttcaagatcagcctgtccaacatagtaagaccccatctctacaagaaaatgttttaagaaactagccaggtatggctgggcgcagtggctcatgcctgtaatcccagcactttgggaggccgaggtgggcggatcacgaggtcagaagttcgagaccagcctgaccaacagggtgaaaccccatctctacttaaaaaaaaaaaaaaaaaccattagccgggcatggtggcgagcgcctgtaatcccagctactcaggaggctgagaatcacttgaacccgggaggcggaggttgcagtgagtcgagattgttccactacactccagcctgggcaacagagtgagactcagtctcaaaaaaaaaaaaaaagatgaaactagccaggcatggtggtagcacatgcctatagtcccagctactggggtacaacctgtggtgggaggatcgcttgagcctgggaggtcaaggctgcagtcaaagtcaaggctacagagctgtgattgcgccactgcagtctagcctcaaaaaaaaaaaaaaaaaaagcgggggcacggagcggtctctcacgcctgttaatcccagcattttgggaggacgaggagggtggatcacaaggtcaagagtttgagacctggccaacatggtgaaataccatctctactaagaatacagaaattagccaggtgtggtggcatgtgcctgtaatcccagctactcaggaggctgaggcaggagaattgcttgaacaccagaggcagaggttgcagtgaaccgaaatcacaccactgcactccagcctgggtgacagagcaagactctgtcttgaaaaaaaaattaaaaaggcaagattgccaggcgcggtggctgtaatctcagcactctgggaggccaaggtgggtggatcacttgaggtcaggaggagttcgagaccagcctggccaacatggtgaaacctcgtctctactaaaaatacaaaaaaaaattagccgggcgtggtggtgggtgcctgtaatgcctcaggaggctgaaacagcagaatcccttgaacctgagaggcggaggttgcagtgagccgagatcgcatcactgcactccagcctgggcaacagagcaggagtcagtctcaaaaaaaaaaaaaaaaaaaaaaaaaagccaagattctgcaaagtccctacccccaattaggaagggcaccagcacctaagaaatgaagtccaccaaaaaggaagaccagagaaggctggccccttagaggaaaggcttctagctgaagatccagccccagtgggacagacacacacacacacacacacacacacacagacacatacacgcccattgggctttgcacaaacaagggagctggaggggatgagccagaaaagctgcacaatgacaacaggctttgtcttcccaggaagccaggcaccatttaaaggtacagaagcacacgaggagtccagctgaggcacacaaaacctaccacagggcagccagccgggcgctcttctccacacctccacccagtgccagtggaggcatgagcccaggcaggagggaaggcacaatgaatttctgaagtaaagtttaaatagattttattgttacaagggggaccccaccaagcagggtcagtgacccccaaggaggtcaccatggagacatcaagaggtcatgattgcagaagaggtgactggaattgaatgacatgatccaggggaggccggccacaaatgcagtaacatgaccaggatgggccggtggggctggtcaggtcacagtgtgagggacagaacggaccccttcactctggcctcctgtaggtctccaggtgtgacaggatccagcccgctggcaggaggaaggtcacgaagcaggaggtaagcccaacggccaattcctacacagagcacaagaaagaaggcacctcggagtcagtattcccctaggctctctaagtccttgcagttcccaggcagcagaaagccccgctcagggagccaggactcagaggcaagtgggaggccccgcatcctcacgttaaaggaatccacgctccacggagcagacagagcaggtccaaagctacgctaacccttgaggtaaagggtcagttataaggagggggaagagtgagaggaaggagagacagctggggttagggttcagggagaaatgcaccaccagatggtaaaggaagggacaggaagcaggatttattgaaacctgttttaaagctggtctgggccgggcatggtggctcacacctgtaatcccagcaatttgggaggccaaggcgggcggatcacaaggtcaggagttagagaccagcctgaccaacatggtgaaaccccgtctctactaaaaatacaaaaaattagccgggagtggtggcgggcgcctgtgatcccagctactcgggagactgaggcaggagaatggcttggcttaaacctgggaggcggaggttgcagtaagccgagatcgcaccactgcactccagcctgggtgacagagcaagactccgtctcaaaaaaacaaacaacaaacaaaaaaagcaaagcctgtatgttaagacccaggatccttgcatgggccagtaactccaaaacgatacctatccttccttgcctgaaaaccccctcccaggccgggcgcagtggctcacgcctgtaatcccagcactttgggaggttgaggcaggcggatcacgaggtcaagagatcgagaccatcctggccaacatggtgaaaccccgtctctactaaaaatacaaaatttagttgggcatggtggcacgcgcctgtagtcccagctattcgggaggctgaggcaggagaatcgcttgaacccgggagtcggaggctgcagtgagccgagatcgcgccactgcactccagcctggcgacagagcgagaacccgtctcaaaataaataagtaaaataaaataaaataaaataaatagcagtaacaaccattttcgtcgctgacagcgtcaggcatcccccagtgaaccaacgagaaaatgggctcagagcggctaaagaagtcggcaggaggcggcgcagcgaggaggcgacaggagagggagggcctgacaggaccagacccgagatcctggggctgtggggaaagacctaacgccgacagccccgactgtcgcccgggcactgtccccgtcgttcgcgccctccagacatgcccaaaccggcactgctgctccccgctacgctgcggggcgcgaggcattctcaggaccacctgaggtcagctaggcagaaggggtcagcccacggcgcctcccgcgctcttccaggcccgttcctcaccatgatcccaagcttcccctccggcggcaacgaatggatcttggcgcgcggcactgggagccgccgggccgagcctgtcaagccccgcagcagcagcggcgtcaggacggacatgatggcacggagtacaccacaaaaaacggtcagccgtagcccaaggtcaggaagccaaaatggctgcgctggccggaagttctggagctggggaagcagggaaactgcggcgcggaagtctctcggaaatgacgcaagaacacacctcccacagcccttggcagtttttggcgcgttcctcgaaacagccaattgacaccttcctacgctatgggcggagcacaaaagggctcttcttcgagttatgttccgcctccaaggcttatacttgtgaatgacatctggggccacccaatcatgtacgcgagaagcctaaactgttcttgactcctcccttcattcatactgttaaatctctctctattcaggctgggcgtggtggctcacgcccgtaatctcagaacttttgggaggccgtctgtactaaaaaaaaaaagtacgggctgggcgcgttggctcacgcctctaatcccagcactttgggaggccggggcgggtagatcatctgaggtcaggagtttgacaccagtcttgccagcatggtgaaaccccatctctacgaaaaatacaaaaattggccgggcgcagtggctcacgcatgtaatcccaacactttgggaggccggggccggtagatcatctgaggtcaggagtttgagaccagtcttgccagcatggtgaaaccccatctctacgaaaaatacaaaaattggccgggcgcagtggctcacgcttgtaatcccaacattttgggaggccgaggcgggtggatcacctgaggtcaacagttcgagaccagactggccaacatggtgaaaccccgtctctactaaaaatacaaaaattagctgggcatggtggtgggcgcctgtaattccagctactcgggaggctgagtcaggagaattgctgaacccaggagacggaagttgcagtgagccgagattgagccattgcagtccagactgggccacaagagcgaaactccatctcaaaaataaaaaacaacaataaaaaaagttcgaaagcagcctggccaacatggtgagaccccatctcgactaagaatacaaaaaatagccaggcatggtggtagatgcctgtaatctcagctactagggaggctgaggcaggagaactgcttgaacccggtaggcagaggttgcagtgagctgagatcacgccactgcactccagcctgggcgacacagcaagactccgtctcaaaaaaaaaaaaaaaaaaaatctctctattgagagtcccctcctctccaccaggcctccgtcgtttttgttgagaattcctgacactgacctagtaaccaaacctccctcaattactattacactcttcaattccagttaccatgctggagcagccaacttcccttccttcctaccctatcactctctctccctcccccatcccttccttcttggttttttaaacctaaatctgaccaagtcatatactttcagtggctccccattgcttcctagtcaaaatcccaattcccggatgtcactgtccagcctcaactctcaaaactcttcaatattccacaccttcgaccctgctctctgatttccaccaacaagccttttgttgcattcaaaatgcactctgcattttgttattgatgttgagacaaggtctagctctaagcccaggctggagtggagtgtggtgtgatctcggctcactgcagccttgcaacctccacctcccagactcaagccaacctcccacctcagcctcccaagtagctgggattacaggtgcccaccaccatgcctggcttttttttttttttttttttttgaaaaaaagtcttgcgctgttgcccacgctctggagtgcagtggcactatcttggctctctgcaacctccgcctcccgggttcaagcaattctcctgcctcagcctcctgagtagctgggattacaggcatctgccaccatgcccggctattttttgtatttttagtagagacaaggtttcaccatgttggccaggctggtctcgaactcctgacttcaggcgatccacccaccttggcctcccaaggtgctgggattacaggcatgagc

SEQ ID NO: 15238 - DNA, 143644 bp, Human
  misc_feature (1)...(143644): n = A,T,C or G
ggcaagttgagactcggtgattgcctccgtagctaaataacagctctagtgtgggtgaggaggagccttttgacacgtgtggcagttaactttgttgaagaagtgagcaaggtgacttatctgtaggaagaaaaataaaagtgcttgtgagcaaaatagggcagaaataatgaggtttatgatggcagaaaaatgtgagaatcagaattgcggaaaaccgtgtatcgagcacttactacctgcctgctgggtctctgctagctctttcacacgtaaatatcgcgttcaaatttcggagcaacccttcagggtggtggttattagtctcataaggaaactgagagagggtaagcccaggtcacccagagggaagggtcacattagatgcagacctggatttggccaaaagctaaagcatcccagacccagagaagggagtggaggagcccgagagagaatcccagctcccaggaccaccagcatttgctgaatgcccactaggttctagacactcagctaggctctatataggtgattcccattgattcctcatgactgtcttcgtatttgatgttctgtggttgtaagcaacagaaacacactggagcaagctgaagtagaaaagggaactctttatttcgaggacaaagtggtgtctcctaaacccacgaacaggagacagcaaggctgccagggttgccggaaaggagaactgaagggaagcaaaggggctgggaggctctctcttgcactcctgccttatcttcttgtgtaaagatatgaaaatggccacagcatccaagtccctccaggtctccacctgggccagtcaactctattgaggtcagactatagcagactaaatggctatgaatgaggtggaggcagccaaggagttgtgagtcgggtaggctttagtcctacttaacttttaaaggtaagtacctttatccccattttacacataaggaattgagattcccatgagtcaaatgtccttgtccaaggtcacatggctaatcttggtggaggggtaggaagggtttggaccaaatcgatctgactcaaaacccatgtttgtaatcatcatatagaactgctgtagaggaccattagtcttaaatttaccctttaatcaagctagaaaagaaaccaggatggtttagcctgagaagatcaacctgagggtctgtatgatatccagtccatcttgattttaaaatcctttttggaggatggtgatcaactagcccttctctacagccaagaagcaggcctccgataacaatgtccccatgctcgagcccggacagacgtgaggacaagctggtgctacagcgagggccagcccttcttgaaggccaggggctggggcacagggctgctgttggttccatccggtcctcaagctgaaatctgtcctgacaaactgcccctggcagaaaattgggacacctcgggggtttagatgttctcatctgaccctttcacaatccccaagcagatggatccatgtgttttctttggctgtcctgttgcactggagagtgagtgttcattcttcgatatttcagtttacccatggggtggagaggatggggtttgtttataaatgaatgttttggtgtagacctgacttgacaccaacttagctacttcagggattcttggccctaaacgaacattcatttctgtctaaaaaacttggccatgatagtccaaactttaaatgatgttaatttaccgtgagatgtgatggagtatgtggtccatgggaaatatgacttagtgttatttatctaaaaatgagtgtctgaatccaccttcacgtttataaacactgcacacatgccagagatatgaggagcagggtgatggagggtgtgtttcctctgggagaatgagcccctcagataagggggagattcttgtggggtggaagattttggaagctgttcgtgagactattaattgatggcattctgcttcttgtcttgcagattggaaacctggaagattactaccatttttatcacagcaaaacctttaaaagatcaaccttgagtagcagaggccctcacaccttcctcagaatggacccccaggtacagagtgtccggatgctttcctaagggctggagggtttgggtctgtggtcttaaaaatggcggagtctggattttaatgtgattctggatagacatgagttttccatattcactttaaatacagcaagacaggtgtagctacgaatcagaccatctgaactaaatcatgtgagtgaggatctctcagcattttaaaatcaacaaaacacaatactcacaggagatacatatatgaatcttacccatgaaacaaaaactctaagcaattcaagcaagtattttaataatgaaattagagatcaggcaggtggatgtttttgtggttgtcataacatgtatgttaatggttactatgaatttgaaaactgaggcagtaactatgactttttttcctcaaagattcacatgatcttcaggattaaaacaaatgtgatttgaaaggaggctaacattttaaattttaacataacccgtatttattgggtggttaattatacttcctttctgcatagatttgaaattaatatttgagaaagatcaatcaacagttatgtgtcaagattaaaaatttaagatggccaagtgagcctccagtgagttcattcatttggcaggtatttttggaataccttccatgtggctggctctgtccatagcagggcccgtggagctggcggcagggctgacagaaaacgaagcaggaaatagaaaaatatgtgatatgtcacagggcgatgagtgctgagaaggaaaatgaagttcacgtgagaagcagtagcagccccagcaaggaacggaggtcattggtaaatcatagttttaggtcacagaaatcatcttctcttaaaagttaacgtatatactagatgtttgtttgggccccctggctggtgcacaatattatttcagctatttccagaaaatacttagagtaaagtttttatggaaaaatgggttcttggtgttgccccaacccacctgcttcaatgacaatcagggctctttttgtattgactgagcagggatctgttggagagacgcgttatctctgggctctgtacctgaattatccttctctggggcatcgcatggtgagggttttgatttgaagcatatgaggaagtggtccccatggagctcacccatggacctgggctgtgaaaagacagacttgtcttgaatatatttctggattggttttataggtgggtggatggatggatgaatggatggatagatagatacggataagtcgaacgagatagatatgaaacattgtgctaattccattattccttcatagcaagggaaggagttaagtgtttactaagggatggctgtgcttgggcactttacatgcaccgtctcaccccatcacatgggggtgagattacgtctacttgtgcttacaccatggaacatgaaggaatgtttttcaaaggggccagtatatttaatcctctaggaaaaaagccagattgtagttgctccttcccaaagagtggggcacttggggaagggtggatcagtagaaaactgagcagcagggagcctctgtacagggtgcataggctgatcccggaggaggcgtgagttctgtgcggttgagagaccgtcatctgtcatcttggaggaaattctaagctaggaaagaggtcgacgcagcatccctccacactttcactttaagcaagcacttgatctgccgtgtgaagaaacatcctcattcttcaactgaagtcttttgagttgttgaattgccaccacgcggatagttacaatgaaagcaagctgtttgcatgcaggaagcccatctcataagcatgctctgagaagagacggggaccgtggatttcttggtcttctttccatgaggccttccaagaattaataaagcagattcttaatggttagaactaaggcagagtcgaaataggagacttaatctgtgttttgactacatcctctgttgttggtgactatattttaaaacttttaaaggtactcaggtcgactgctcatcccttccttccaaaaatattaatggtgcacctgctgagtgcaggaccctgtgcctgagtaatgcagagctgcccagcaggtctctgtgttgctgagttctcggtgaagatggggatgggagacctgtgcatgagcaaggcaggctgaggcagcagagacagactctgtggggggcttgagggccaccataccctggacctgcctcctctctgcagcacctgagctgcttgattgacccattttaggtgtgttaaaagtcctatattcagtttgggtctgagggcaaagcattcccaggcattagttgtctcctcgaagtcagcagaaggaaggatagagacttcctaggcaaaggctaacgtagcagttaaattttttcaaataaaaatctccttctcacagagcttcttaataagctcctggcaaggcttctatcaatgcatcctgccagtaaagaagaaaggaagaaaggtaaacagcctgggcatcccaggccttcctggaactttcctaggattggctgattgtttctcatagttctaattaaattgttagccccagggaaagcacacagacatctgaaccgattatgaattcagaatcgcaactgaaatacctctgtttaaatttgtctagctttaatgcaaaccaaatcaattagctgtcagtctgactaatatttactccacccagtcattacaattaaacacttggtgaaattagctgttttatggaagtatttagtgttatcttttattgcagtgcatcagaacgtttccctacgttggcaaagcatttttatgataccttcacatctggagagttgtgtaattaatattattaacaaaaggaaaagatgatttaatattattcagagacttcggaatgcgaggctgccattgtgttcaaatgaccaaactggaaatgaatgttatggggcttaggataaagttccatcaaatgcagacggtatcttattttaattagttccagtccctattgtataggagtgctttgataagtgatggaatgtacagtccaccccatgtcacataaaagcagatagaatgtacatttgggaaagcaaaacaaaactcaagggggtgtcagcagcaggactctgttaagcacgcgtgtgcacgcacacttattaggcatcttcttcgcactgatcctgtaccggaatggtacagtcattttccttgcattcttaattacctttacttgatgtttttcttaccgtctttgaaaagggccattttgctcagattgctttgttactcagccctgtccttggaggaacagcccaagtgttcgcagtgtgcagttatcggtcgctgggtttttccaaggcttgtcatttaagcaaactgaaagcatttgtttttaacttgttcttttgccaaaagtctggagaagggtggatattacagaagcgtcgaccaatcactgaaagggctcacaaatttttttaaaattacttgttctgattatgttccaagctggcttatagttagtcgttgctgcctgtgtcttccagaccttacattttagcatgatgacttgggttcagctcttttccttccctacagatctcagccagattggtgatggaaatggaaggataaagatgttcagagggagccttggtggctccttctagggccgtaggaggcttgggttcaatgcttcatttcagtgctttaaagcttagaagttgcaaaatgattgcaaggaccagaggaggcattctgttttgtaggatgggactttgcccccggagtttaatcaaagctcgggtttccttccagcagtgatgcaatgttgaagcagatctttccattaaccacagatggaattttatctaacagttttgtgtgctagagcaattcaaagtgcaaacaaacagaaagttcctgacaagagcacatagacagtaagtgaccacattggtctcaggggttgatgaactgtgtcatgggctgagggcagggccaggcagctgcccagggcccagaggatttgcccacgtggggacggtggactgctcccccatgagggtgatcgaatgacagtgacaagttggctgttcacattttcagcaccacccagctggttctagtggcatggctgctaggaattggtaaaaagtttgaatgtgtaaatttaccttaaaagacagcattttattctttcacgacatgctctgcccttccgcttagatatctcaaagacaatccaaagtcagtatgtcccaaacccagctcactgtctctgaccctagtctgtctcagagggaagcgctcatccgcattccactgcagtgccagcggcctctccttcccccctacacttgttccacctcccgtacaacctggccctgccatgtcctgtgtctcctgccctaggcccagctcctgtcatctcttgcctgcaccactgcactgccctccttgctggcctcatgtgggcatccttgccccggccagtcacctcccatgctcctgagggatcctctgaaatacggccaccactggcctttaagatcctcctcgggtgactttcgctctttttccctctgcagagcttttgcacagacggctccccaccttcccctgctgttgctctcttccccaccttcccctctgggctccaatatccctgccaccaggaagcctgctcagaggctgcggacttggcctgctcttctagcagtcgtatgtttgtattctagatctggccctagagtaggagcacacagcagtgtttgttgggaacgatgactagttcagtttgtttgggatctgtcagggacagacagagtcggcaggggagctgcaggtggttcctgggggacctggattgtcaggcttgggagggcgttcagtgttccagaaccagaggagaggcgatgggaaggcggactgacgctgctgtgcggatgcctcgggagagaggaacttggagttcaaagcatgcaagcccatctcttgccaatgcaacaggaggttatcgagggtcaaggccacatatcatttgcttttactcccttacaagtccagcagcaacccagagaacagtagacaatgcttcctgaagcatatctcaagttccagagatgtgactcctataagcaagttgtgtgtaacataagcaacttctttctatgtaaatactttagaagtaaattctgacccaccttggctaaattatggaaaaatcctaaatatagttttcagttgacaaagctgtatcctgtattgctgaagctaaaataacagaggtactgacagtgactgcatgtcagacacgttgagcagtgttggacctcatagtttgttagtctgcgggggcagttgtaacaaagtcccacaggatgcggggacttcaaccgcagaaccgtattgtctcacacttaggaaggttggaagactgagattacggcgttggcagggttggtttcttctgaggtctcttgatcctcacgtggttgtccctctctgcgagtggctctgtcctaatctcctcttctcatgggacactggccagattggattagggtcccccgcatcatgacctcatattaacgtaactacctctttaaggcccttatctcccattacagtcacgttctgagctaccccgggttaagatttcaacataagaatttaggggttcacaggtcagcccctaacaataggtgaagctgggctccagctgcctcttctgttgtcagtgagtggaggtgggtggcgggcggtggggagaggggcaccttctgtcccctttcagcaaaataagaactaacttacaaatgagtagctttactttcccaaagagctttcacacgcactgtcccatttccgtcatcggcagagcgaggacttccctctctcatgactgttaagcaggggtcttctggcacctgtagtttaacttcaatggaaagaattcaagaaatggtctctacgctgttgcagttatggctgcaggggaggcagtggggagggagctgggctcgcagctgcctggatgacacgggaggtggtggtgggggtggctttctaggctgagttagaatgtcctttattttctggttcctcctccccctcctctactgcccgggcttactcactgggttcccgctgtgtgtttgccatggcagcctggggtttcccggccccacccctaggtgagccagtgctgcgccggaggtgggcctgggcatctcgccatgatgggctctcacgaaaccatgtaatcgtctctcacttgtcgcgatggccctcttgccctgctggaagatgacagccacaggaccaatccctcactcggagaacttggatctgctttctgcctctgtctagcttggttcagtggttcttagccatttgggggaatcacaggcccctttgaaaagctgttggaagttgtggggcctctcgctctccagaggaaaaaagacatcatgctcatgccggcaccattttgcatacagttctggggtttctgggactcgagcctgtccttccactccttgagggactgtgggatccagggcaagatggctccagtgtgctgcatgaatcgtcgcctgtcagtgagagaagggccacgttgcacattatgcagtgacgggcacttgtcggggagtgggatttttctttctttaaattcaccagtcagctttctcactgagctctttagctggttggatgttggcccagcgaggtgctcagagcagtcaaggttgatgggaatcaagatctaagcgccacagactgttgagtgcacaagctctgagagagggaccggtcccagcccctgctttacagtgtggagggagaggcccaggcagggtgcccacctcccacacagagagaataacaggcttattttctacggtgccctgattgttctctcctggaggaggctttggagcttggtggctcctgggtgccgaggtatggcctccgactccctcccttgatatgccctggtggacagtcaggtctggcttgcagtccccttgttctttcacagttacagaataaagtaaccttcgctttgatgaaaccagggagaaaagagaaaagaaagagctggccgagctgtctcccttgcgttggctacaactgtgcagaacctgtgtgaacctggtgtccgcagccctgccggtgcgtacttcaaagaacctcagcagcttgactcccttgatgctgtgtgggacccctggaccgctgggggagggtgcctgtgtatgcccttcgtggccttccctccatctcagagcaaagactgaagcccctctccttttaggactctccagctcccaagaacttctaggggccttcctgagccacagcagggcccctctgaataggcacaggcttgaagttagggcagaggacatggtggctttgggtggacgtgcaagtgggagggatttcatgctctctttggtgacactggctcatgagtgaaagtttcgaaacaccctcccctgtcgcttgtcacacctgggaatgatatgtcagcaagcttctggcccacctgtggcccacagggaagaagacagggccaaggctgcccatggctgctcgctgaaaggacgcttggacaaggatcacaactcggtggcatggacagcctgcagcatggcaagccatttactggaacgcgggcagggcacccttctgggtctctgcttgtttatgttaccctttaggaacatccttagattttacctcgtcttatcaacagagggacagtcaacggatgcctcattttaacttggcttctcgagaaggaagctggaggaagcacacactacaaaagaaagtgttgctgcgcacctgtcttgagaagacgatgaagccttcttcatgattagaactccctgccccagagcgtagcttatctataactgtgctgcatgtttagcaggaaacatacatttggaaaatagagaaaaggataaaaaggtcagagtgaagttctatcttcaaagtatgacgttaaagaaatcctggcactttctacagatttgcagagaaagacggtttctgtttgggctagaagtggcatttggcaaaccttgcctttgccccaaatcacttatagttgattttccacaaaaaaagtcaacagatgtcatctagcagtcatttagacctaatcacattttctttctttctttctttctttttttttttgagacagagtctcactctgtcgcccaggctggagtgcaatggtgcaatctctgctcactgcaacctgtgagggttgcttccattcgatgggagggctggagttttagtcgcttggtttggggctggtgacacacctctgacctccacagagtgtccaggtggctcctggtttcaccccgagggggcattgaaggcagagctttgcatcccagctggggatgggagggggaggcactttggtcctggccgggaaccaggtatgttcatgctgatcttcccagaacctagcgccagacacacaggaagactcagtgcatttttgttgagtgagccacagaataagtgaccccaggatgcctgctctccggagacactggggaaggtgaacctggaaaatggctttctctttgtggtgggtaggaggtgggatccgggatccccttgtgctgtcctggagctgggtgagaagcaagggagtgactggaacccagaggaagggacacagtgggtgccgggagaatcagcctctgccaccgcgctgtctgcctgcatcccgtctccacggagaagcccccacgcctggtcagtcatctgttgtacagtgttcggttccattggcctgacagcacctcacttgccgtcagagacttacaatgagcaggtgtgttagcagagagagggctgcccctgcgaccacgacagagagagagccccaaactgtgctgcgggccgcaggctatcacagtccccctcagaactgtgtgccagtgttgtggggttttgcccagagcccagcaaggaccaagggccgggatgcccaggctcttccatcctgctgaggaaccctcttatgacttctggctctacgctttcccacatctcccagctgattagtggggtgtcacccacttgggcttggaagggcagagtgtgcctcctcctctgactggaagtgtggtctggtgggcacagcaattggaaggggctggatgttgttagaacagagagttcagggccccttagcacaaacagggctcagcctggcaggagggcgggacatccctgggagctttgggctgtgcgggatctacataccactgtattttgtaatagcgtgctgaacagattatgaaatattgtttgcggcatcttagaccaggtaaaaagccttctagttcaggcagtaatatatggggacattgcaaaatgccatcagccggtgttaggaacaaaatatctcattttatagttttattttctgtggaagtatctgtcagcggccattataaattatctaggacttggtgctgaggattttttaagtgtgtgacgtgaaactggttttgagccctttgcagtgtttctaaggcgtctggtctgctggtgttttatagacgaattacatcggggtgggacgggctgggatgcctctcttccggcattttgccctgtacaccaaggatgtcttggaggccatccccagccctaaatttgagctgtgtatgcaggtgctccgctctccttgctcagggtgatgtggggaggccacggctcagggaggaggaagagaaatcttgtccctttgctcttggggactgttactccctgcccactcagcctcaggtagctctgttctagcttccagcacgaccctgggtcgccagccttgggtcaccttggggccccgcccccttctcttgttcctcccctgcctctagctgcctcctccaggcagcctgccctgtttggaactcacatcatcctctgattggtgggatcccctgaatgtagtgcagactcctcgagagcacggccctggcgcccatccttatcccacccatgtcaggccccagagccaggctgaaccccagctttgagcattattcaatcaggtggagctgccgtggtaagaccaaagaaaacattcccactcagggtccaagaagtctttaccccaagatccttttaaaatgaaaaagtttttccagcttgaaaagaatgtgtacacgggatgataagagcaggaatgctccaggcactggtctgagggctttatatgtgttgtttcttatattaaccctgtggcaacccatgactgtccccactgtgtgggtggacaccaccctgaggccatggatgtccactgtcagctccaagtcacacagctggtgagcacggggctgggttttattgcaggtggcctggtgccttgatccttggtcttaaatatcagtgatacagccttgtgaacttttttccttgatcgtgaaaacaaatcatgctgattgaaagacatttatgacatcctgaaagtaattgtaaaattttaaattagcaataatgtcaccacccaggaactgatgctactactattttgctgtattcctttctagatttttctctgtgcatgttttggtaccatattgctggtggctgccaaatattccaatatatggcttaccatatttacttatgtccttactgtaaagcaaattccaataccagttaaccaaacactttcttcattcactgctttcccatgtgtgtatttcctttttcttcaggacaaggatcaccagataatttattggcaatttcacaaggctggcttccttccttctctccctctctccctcccttccttcttgtctttctgtctctctctctctctgtctttttttttttttgacagggtcttgctgtgttgcccagactggagtgcagtggcaccaatcatggctcactgcagccttgacttcccaggctcaagcaatcctttcacctcagtctcctgaggagctgggactacaggcatgcgccatcatgcccagctagatttttttttttttttttttggagaggtggggtttcaccatgttgcccaggctggtctcaaactcctgggctcaggcgatcttcctgcctcggcctcccaacgtgctgggatgacaggcgtgagcactttctttcttttagtacaacgacttcaaaatctatcagagtggtgttatttcttcctctgtatacacaaacaacttctcatctttcaaatgtagtcactttgaagtgaaaatgtccccaggaacttaccatctaaaatatctgctatgacacagatattcacgcacaaggaaggctgtagcacctgcaaagaggctacataaaatcaagaaatcatttctaatataaacagtaattgcatttcttctggtaggtgaaatggctccagcaacaggaagtgaaacgaagggtgaagagacaggtgcgaagtgacccgcaggccctttacttcaacgaccccatttggtccaacatgtggtacctggtgagtaggacaggacctctgtctgccccaggacacttgcactgccaggtctctgaaatgggttaatttccctcaacaaagctaaattcaaacaacatctccagacagacacacttcaccttgagggtgtaaaaccactaccgcaaggctgtgcagtaccggctttcctgtggattttttctgaaactttgtgcagcacactctgggatgggggctctttgagaagggaagtgatttgatgcaggctgtatgactaaatggcaaagcccagcccatggacagagctcctgctgggaggcgatgccctgggaaaatatagattgcaggtgcagaaaaagcaagggagccgtctgcatgattctcgatccgagtgggaaagaggagctctgctatgtaaggcagggataggtgttccctccttttttacttgcaagcctaagcgcctccctgtggggtgtgcaccgagtgtcagttctgcatctggaatgtccatgtcggggggactttgtgtctttcgtgcttacagcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgtaagtcaatcctcggaactgacatgcaaatatattcaactgtgctggtcattaagtaaatgcaagtttaaaaacagtaaggtcccgatctcccccagcccccattaagttaggcagtaaagaaaactatgctggagagaattaggaagatgaatattctgctacttgctactgtcaggggcaagggttttgcagagggattcatccacatgcttgcacagtcacatacacttttaggaatggagcctaaagaactaagaaatgcatggagggggatcatcagcgtacagatagtagcaacacgaacagtgacagggtgacagtgtgaaaacacgggctctaggcccagagtgcctgggttcctatcctgggtctgcaaatgattagctctgagatcttgagtaagttacttaacttctctgtgcctcatctgtaaacattttaccgtctgtaaaatggttcataagagaacgactctctcacggagttattgtaaggactaaattagttaaatgtaaggacacaagcttggcatatcgtaaatatcatagatgcaagaaatactctaagggacttgggcacctaccggtgattaagtaaaccatattgtatccatctgacagatcgttatgcagcccttagaaatgaattttgcagactacgtgtcaacaacactggaaaccttttatcatatattttaaaaggagaatgtaaaattatgtgaatactgctgttacagtcatataaacaaaagcatacctattgaaaatataaaatgaaggaaatcctgacccacgtggaaacgtggataaaccttggacgttatgcgaagtgaaataagccagtcacaaaaggacaaatactgcctgattccacttacacgagtgactcggagtagccaaactcttagacaaaaaggtggagtgggggttgccagggcctgggagaggggagtggggagttagtgttgagtgggtgtggggttttgcaggttgaaagggttctggagatgggtagcagcgatggcctcacagcactgtgaattaatgccactgagccgcacactcgagaatggttaaggtcgtgtatttcccgtcacatatattttaccacgataaaaacgtatatgagattatagctatagtaagagaggagccccgcgtgtggtttctctatttgccaacggaacataaaatccatttcaaacagagctgtcatatgccatttctcctcactcaccacgattccatttcttaggattcctacgccagctacgacgtgaacggcaatgattatgacccatctccacgatatgatgccagcaatgaaaataagtacgtcacctcgcctcatctccccggcttctcttcccctccctgcagcgtcactattgaatgtgtgtgcgagggagctggagaggcggtggctgccggcgtatcttccctgcctgggcgcgaggcaggcttctccaggagtcacaggccatgccaggcacagcccttcaggcacggccagcttctgtggagtcagcctgttcctctggggtgtcaccgctgccgggcagctagaaatgggtgtttgacagacatcgttcctgtttccaactttcttgaaatattttaaaagagaaacccttaagtctaaccgtctccatgacctgctgtgtgaagacagcagtttggtctgtttgagcacacaggtcacgtgcctgagcttttgtgactctgtgaccttaggaatgaggtggaaggggcatgagtaatgctggatagacccaggttcagatcgcagctctcccacttactggctgcgtgcatgccgggtgagctggttgaaacttcatgtcttagtgtcttagaggctcgtccaggccagtgatgtcccctacctcacagggtcacaggaggggtcagtgagatgatgcatgaggaatgcacccagcagattcttccgaaatggtgggcgtttttgtgtcactgtcattttgcaagtggaggcagtggggtccggagagcccaggtgactttgcagtgtaaacggcagccctggggtcagtcctgggaattcatttgctgtctctttccttctccatcagcatgccccataccctgagctcttatcattcctctaaaaatatttagagggaaataataaaagctttttcttcctccccactgttgacaagactcttgctgaggggcgtctcccgattatagtcttttagtttgtggtcgctttgattctgagattcacaaacgggtgcgcaggcaatgctgtgcaggaagcctcggccactggagttccacacagcaggctgcagagctcccgcgagcctgcagcagcccagcctcatgcacgtcccaaggtgcccttcctgctgccagtgaggatgcctggggcaaaggaggaatgacccacataccacgcagtgacccttgaagggcaggattcaatcccatcccgagccatccatcgagctctgtgaccccgggaacagccctggccttgaagctgtgtggcttccagggaaggacagatgactctcttccagagggctgctgcctggggcgatttttaaaggcagctttaaatttgaatcaatgattcccatcctctgtggactcttctcaaagatgtgctatttcaagttgctcctattttggcccccgctggaggaactgacccgacgtggcacatcagagaatggggtcattactgaggaaaacgcatttgtttttctggtcatttcttcatagtctcccagctgctgagtgtttaatttagagcgttcttcctcagctccagcttaaatggccttagaagcacaggaagggctgcctcagggtaagcatggtgttgtaggtgcataggggatgaggcaggtgacatcagcaccagactgttccttctttcatcctgccaggcagcaggtgtccctgctgccagccacaggagacacgaggccgaggtggcgcagcacccaccctacacagcagtggccatgtgccaattacacgtgctgggaggaggaaggtataggaccacgggcactggggcaggcaccttcctcccacatgggggtcaggggaggcatgctggaagaggtgaccatgcgtgagcacttgccacattcaggatgccaggaagggctgtacccaggctgacttggtgccttctcccagagtggggttggtgatgagaggggatgcaggaaatgggctttaatgacatctctgggcttcggacaactgactctcttgttgcattgaactgagccaggcactgaattcactgaaacttgctgggctgcgtcctcacttggttttttcctttgtttcagacacggcactcgttgtgcgggagaagttgctgcttcagcaaacaattcctactgcatcgtgggcatagcgtacaatgccaaaataggaggtaaggccgggcatggcagcctgcgagccgaggggcctggggcaggggcagctgggagctccctgtccgctggtctcagcagcctcctgttttttggctttggccatgtcagcagacccctgggccagacgcagcagtgccgtctgtatcatggcccaggcagctgacccacagggattggggcctcaagacagaggaactgcttactgttttgcctgaaaagccattgcagttcccatcagaaaggtaccctctctcctctggtcctgctggcctggctgctgactcctagaagtctgcgttgattccccgctgcccatagccctcagtggctccgtcacttcccagacagagtgacagcttttacccgggaccagagctttccctgggttctgactcccactcaagcctgctggcccacttctcctgcccctgctctgaccttagaggacatttttcatagtgccccttagacacatctggtcttcccgattgatgcctgggcttgaaccattcccatccccgcctcccccgtctttccacttggctctgtccacctgtgccttatggcagcctcatgcctgctctgttctgtgaagtgctccctggatccagctgtcccccgtctcattcaccagggaatcagctcttcttggtccctttacggagcagcagccgcccccgccccgcgtgcgtctggtcttgccatttagcttctcacactgctcagtcaagctgcccttgctaggatgaggctttggagtaaagtattgaatgtcttcctattccccacgggagcccggcagtgtgacagctcagtcacccaagtgctctgaaggcccctctaggtgcatgtcactgacccgggaactgagcaagtgggggcagcagagaggagtgccagagggcctccagggactgcggcctcacccaggaggcctgtctgcttctcagtccgaaggtgctcctgctcactcaggtggctgcagtgggaaaccaccttcccgggggggcactgccatcctgccactgagccttggtgagggtgcctgcagccgctttctgccgttctgccaccgagccttggtgagggtggctgcagccgctttggctccacttatgagcagtaccaggcagggaggttgggccacggttccctggatcaccagtccttgggggaatttcttgtgtttcgaaaagagggtccttagcttttacttaattaggactctgcctgccttttcccgtggaaatcttgaaggtggcttggattttcattttatagcagaattaacccccaagggcgcgttctgcagaacaaatcaggagactctgtcaactggcctggctcctttgtggatagttcttgcaaactgagatatataagttctccctggagcctttgatgatgggtgcagagccctgagacgtctctccaggatctgtagaatcgggccaacctgggtgccagttccattcccaccactcactgtctgtgtgtccttgaacaacttacataacctctctgagccaaggtttctttacctgtggggtgaaatgaccaccaggcagctgcctccccagttttgttatgaggatgaagtcagataccatgtgtgaaaccatcggcttgggctaagtctgcaggggatagctgagctcctccttccctcttgctgagactctcagtgggagaataaaaaccatttgtgttgctttgagtgaggggtggaccccacctttggagttgcttgagccttgctcccccaagtccctagactttgagcatggcatcctctgggagccgttagaaatgcagaatccccaccccaggcctacggagtcagggtttgcattataacaagatcgcaggggatttgtctccacgtcacaatgtgagaagcgctggtttagaggactccctggggtctcacaggtaggtaacacctgcatcatggattgcggggaggagtcagtggaagtaacatgcataaagatcctcccagatgaggtgcacagtaaatacagcattaccgttagatagctctacactcatcgccaaactctttccctacgtttcccgagtcctgcaagtgaaggtgctccctccagatctggaaaatgtagggatagaatttggcatgtgtttaaaacaagaataatagcaatgcactgtgggtttataacgtatgaagcaatatatatatatatgtatataaacaacagcaggaatggtaacagtcatggtgaatggaaacgctctatcttagatttatacattatacagaaaatagtatactattaattccagatagactgggataagttaggatatgcattatagtctcttgagtgacaactaacaataaagacatgaaaaggaagagctctatggtcagctccagggacatcccagggaaattccctgttgtgtgccagcacacacagagagggagctgtgttagagcacctcacccagaggtgggcttggagggagaaccaggaggaagcgggttggctgcctgtgtggagaggctaaagctgtttgcagcagctttggagccagtggctatcactggatccttgggtcaaggccagcctcaaccccacacctaccttccagagaggtgtgagctccacctcatgtcctcgatctttatgtggcctgctcaccccagccccacgccgcagacgtaattgtctcctcagcactctcacgggtagtcaagtcctgccgtgtcaagctcagccacaccctcatgccctgctctcatggggtgcctgctctgccacccctggggctcctacctgcccctttaacttcaataggtggttctgtgccatcttccttgttggttccctccaaagacatgctgagctcctagaggcccagaactgtgaccctcatctctttcgtctctctgtcagcggcatatccagtattatacatgcagcatgtgctcaaccatattcaatgcgttaattaaaaaatatccctgttatcatgcatatcccaacttatcccagtctatctggaattaatagtgtactttctatataatgtgtaaatctaagattgtttccattcaccatcactgtcattgtttgtgctgttgtttttatagattctacttcacatgttataaacccacagtgcatttcttgttttaaacatgtagttgaccgcaaactacttatgacaagaaatacatttacctgcctgtgtaccattccactgactggtcttccttactttttctagcttcagatttccatctttccatttatcttcagcctgtcgccaggctctttggtatttattgaggttatctctcacctcttttggtatttgttgaggttcaggtatgctagtgaaaaattctctccaattttatctgaaagtggcttctcttcatttttcttaaaagaaattatgctgaacacgaccttctaactttttttttgtctttcaacactttaaaggtgttattctgttgtcttctggtatccattgtttccgacgatgagtcgattgttaattgccatccttattgttgttcccttttaagaaacgtgatttgttcctatggctcctttttttttttttgaagagatggggtcttgctctgtcacccaggttggagtgcagtggcataatcatagctcactgcagccttaaactcctggcctcaagtgatcctcccacccgagcctcccaagtatctgggactgcaggtgaacacaacctttcccagctaattaaaaaaaacacacacctttttccttgtaggatgagatactgctgtgttgcccaggctggactcaaactcctggcctcaagcgatcctcccacctcagcctcccaaagtgctgggattacaggcatgagccaccatggcccttccctgtagctgctttcataatgttatttttaaaaatatctgtgctttgcctgtggctctaacattcttttatgtagttttcttcgtattaattccatcttgggttttctgtgcttcttagtgggttattctttttaaagaaaatttggaaaaaaaattgtcaatatttcttcaaatttttttaagttccattttctttctactctctgtgggcacagttatagttgttagattgcttaatacgcctcacaggttactgaggcactgttcatttttttaacccttttttctctgcttcgaatggaatgatttttattgaacttcaagttaactaatccttccttttgttgtgttcagtctggtctttaaaaaaaatttcagggctgggcatggtggctcacacctgtaatctcagcagtttgggtggctgaggtgagtggatcacctgagatcaggagttcaagaccagactggccaacatgctaaaaccccgtctctactaaaaatacaaaaaatcagccaggtgtggtggcacatgcctgtaatcccagctactcaggaggctgaggcaagagaattggcttagacctgggaggcggaggttgcagtgagctgagatcataccactgcattccagcctgggtgacagagcaagactccatctcaaaaaaaaaaaaaaaaaattcagatatttacttttctgtcttatgatttccatttgactctttttttactgtttccgaatccctcatgtgtctccatctcttcagtcatgatatctatcttttattctagactctttaacatgtttgtaagaaatactttaaagtcttttgcacttaattccaacatctaggccattttaggagtatgtttataatgactgatttttctctttacagtgggtcatgtatttctctttctttgcatatgtctagtaattttttattgtatggtagatattgttacattgtagagactctggattctgttgtctttgaatatcattaagtttctttcttggccaggcgcggtggctcacgcctgtaatcccagcactgtgggaggctgaggcgggtggatcccgagatcaggagattgagaccatcctggctaacacagtgaaaccccatctctactaaaaatgcaaaaaattagccgggcgcggtggcgggcgcctgcagtcccagctacttgggaggctgaggcaggagaatggcgtgaacccgggaggcagagcttgcagtgagctgagatcgcgccaactgcactccagcctgggcgacagagcgagactccgtctcaaaaaaaaaaaaaagtttcgttctagcagttggttaaatgtgagcttgtggagacctgattattcttttttttaatgtttgctatctttctgattttcgcatagccttagggaaaatccattagccctagcatatggtctttactcctagaccatgacccttttggtatttcagtggaaagcctgcaatgtttaaacccagacctctaacttagcaagtctgaaactccagatggactgccctgtagtgggcagcagctgaaatacctgctcagctcctccagcctctcagctgctgttttcctactggacttcttagtgggttgcccatgtatacttcagggttcagccaagtggttgtgaggagtttatatgttctcttctgtagatctctcctttctgaaatttctcctctcaatttccagcagctctgacagtcccaactctatcccctgactcctctggagaataagatgacattttactgtacttcagtatttgagttctagcctctctgcaccaaaagaaatggaaagttccctcaagaggaaaagtcatgtcaacttggagcatacccagtatggtttgtcaagaattgaaccccctgcctacctctgcccttttctggttgttcttcagtggtcttaaaaagttaattttttctaagtaaatattttttcagagtttataattattatctttaataagaagagttagtctgatataagcaactctgtcattgttgaacttaaaacttgtggtttatagttatcaattagattgtgtattagttatctattgctgagtggcagtcattctaaaaatgcagctgcttaaaacaacaaacacttgttttccagcacagatagtggctttgctgaatgtttctgattcagggtcactggtgaagttccagtcaagctgttggctgtgattgtagtctgaagacttgactgagtctggaggattcacttccaagatgggttacttatggggctgttggctggagtccctgattcctcactgtgtgtacctttccagagggttgcttgagtgtccccataacatggtagctggctttctttataacaagtgattcaagagaaaaagcaaaaccaaaccagcaatgtcttttatgacctcatctcagaagtcatgtaccatctcttcagccatactctgtgcattagaaatggatcactaagtttaacaatacactcaaggggaaagaaatttggtcgcaccttttgagtagaaaggtgtcaaaaaacctgtggacatagtttaaccaattttctttgtaaaactgcacattccttataaatgttgtcacataaaaataattaaatcaactgaaagaaacaggaactgtccaaattatatcttaagaaatagccaggcgtggtggctcatgcctgtaatcccagcactttgagaggcggaggtgagcagatcacctgaggtcaggagttcccgaacagcctgccaacatggtgaaaccctgtctctactaaaaatataaaaatcagctggatgtggtggtaggggcctgtagtcccagctacttgggaggctgaggcaggagaattgcttgaacctgtaaggtggaggtttcagtgagccaagatcgtgccactgcactccagcctgggcaacagagcgagactccatctcaaaaataataaaaaagaaacaaaactccttcaacccccagtttccctaggtgtgttgccttcaggtgcattagcacctaccctggggagaaattttacactgtcaggaatccacagaggcatgtgccatcttcattgtttccagagaggagagtggggtacccctgtgcggtcactggtccctgatgtctttcattttagagagactttaattttatattaagttgtcaagctgtacattgatgatttgtgcccccttttcatatataattttttaataaaaatctgtttaaagtttttatgggctgggcatagtggttcacacttgtaatcccagcactttgggggttgaggcaggaagaccttttgagcccagaaatttgagaccaacctggtcaacatagtgataccctgtctctacaaaaaattttgaaaaatttagccgggcatggtggcatgtgcttgtagtcccagctacttgggaggctgaggtgagaggaccacataagcctaggaggtcgaggccgcagtgagccatgattgcgtcattatactccagctgggtgacagagtgagaccctgtctcaaaaaaacaaagtaaagttcttatgatgtcacatttgttcatcttccttcatgactcttgagtttgggatcttgcccaagatagtaaacctgttttgtatttcctctaaaaacttagttttaggacaataattggtcttaaaatttttatggttttctctttcctgtttagctttttttttttttttttgagacagaatctcactctgtcacccaggctggagtgcagtagcatgatctcagctcactgcaacctccacctcctgggttcaagcaattctcctgcctcagcctcccgagtacctgggattacaggtgcccaccaccatgcctggctaatttttttgtattttttatgtaaagacggtgtttcactatgttggccaggctgatctcggactcctgacctcaggtgatccacctgcctcagctgcccaaagtactgggattacaggtgtgagccactacaaccagcctttctgttcagctttttgatccatatggaatttatttctgtgagtagtgtgaaagagagatccccccaaatcaatatttggtgattgccacacgtggccctcatcacatcctagatccccatatggacactgggtctgcccttacgtttccttagtcagttccttcataagccctaacaataccacgctttgaattattacagtttaggagagttttggggttttgtttttgtttttttggtaactgatagggcaaattttctcttatggttccttttcaaaaattacttggctattcttgcacattttctctttcagatgaacttgagaatctgcttgtcaagttccattaaaaaaaaaaaaagccctgttgggattttgattgggattgcttggaaattatagattaattgggggagaatgacatctttacaatattgagtcttcccacccaggagcatggtatgtttttatttattcaggtcttcttttacattgttttttaaagttttatcactttctccatatcgattttatacatttcttattagatttatatctagattttttaaaaatttgtatttctaattggtcattattgaaacggatataggaaagctattgatttttgtatgttgggttttgtttctggtcaccttattgatctctgtgggtgctgttgtttttccgttggattctcttggcttttctggagagatgttaaataatagctatctgtaaatataatggtggttttatctctttaatattaataactctctttttcttgccttatttgaatatgtagcagttcctgatgaatattgaatagtggtggtttataggttctgtttgatttctgacttatacaggaatacttctaattttatgccatttgtaaatgtcttccctgtagttaccctttatcaagttgagaaaattttattatattcctagatttctaagagatttaatcaggaatggatgttgaatatttaaaagtatctattgagattattatattgtttttcaactttattgtttaatctgtgtagtgtaataagttacattaatagatttcctaaactgggctaggcacagtggctcacgcctgtaatcccagcactttgggaggtcaaagtgggtggatcacctgatgtcgggagctcgagaccggcctggccaaaatgttgaaaccctgtttgtactaaaaatacaaaaattagctgggcatggtggcaggcacctgtaatcccagctactcgggaggctgaggcaggagaatcgcttgaacctgggagacaaaggctgcagtgagtcgagatgacaccactgcactgcagccctgtaagactttgcctcaaaaaaaaaaaaaaaaaaatcctaaattggaaactttttctttcatttttgaaataagttccatttgctcatgagtattgttgttttgatacatctgcattcaactgctgatgtcttcttatagttttacaacttcatttataaaatggatagaatcacagtttctgtgttttgtgatgtttctctctaacttgtttatcagagtcaggccagtctcgtagaaagagttaggaaactttcttttcctgtgctctgaaatagttaatatattgtggatagtgcatgatttctgaagtgttggtagagctgattaactagtctgattggatatggtgactttcaaaaggactagacctattcaggttttctgtttcttcttgaggagatttttgtaattaaatcttcctagaaaatcatcaatttttcaagattttcaaatatatgacataaattcaatatcatatgctcgtaatttaaaagtacatcctccatgtttatagttataattgtttctaatcttatttgtgacatctcctcttttttccttgattgatgaaaaatttctatttttaataaaataggttttttcacctcagtgtcatacaatatacccatgtaataaatttgcacatataacccctgaatctaaagtaaaagttaaaattataaaaaatagtgtacgtaaaaataaaaaaaaacaggcttttgcagagaactaggttttttttaattgagttcctttattttctgcatcataaatttctgcttttacttatttattaattccttcagcttttaaatttgttgttgctgtgttctaattccttgaatggaatgtgtatttagttctttattttcaggattttatgtgttctaataaataaataaataatcatacattctcctttcatcacctcttactagtttaattatatggtgcttttcttgctatatatttctgaataattgtacgtttcagcttagatttttctctttaacccaggagttatttagaagagatttataaaatttttcaactgcgtagattttctgatgctccttttgttgttaatttttaagtttcttatattgggttcacagaatgttctgtatattttctgccttttggaatttctggagaatatctttgtgtcctaatacacgttcagtttttgtgaatatgccaatgggtgtttgcattagtccgttttcacactgctgataaagacatacccaagactgggaacaaaaagaaatttaattgaacttatagttccacatggctggggaggcgtcagaatcatggtgggaggtgaaaggcacttcttaacatggcggtggcaagagaaaaatgaggaggaagcaaaagcagaaacccctgataaacccatcagatctcataagacttattcactatcacgagaatagcacaggatataatataatatagtagcttttccaggcacatggtacaagctgccagtggatctactattctggggtctggaggatggtggccctcttctcacaggtccactaggcagtaccccagtagggactctttgtgggggttctgaccccacaattcccttctgcactgccctagcagaggttcttcatgagggccccacccctgcagcaaagttctgcctgggcatccaggtgtttccctacagcttctgaaatctaggtggaggttcccaaacctcagttcttgacttctgtgcacctgcaggctcaacacacaagtggaagttgccaaagcttggggctcccaccctctgaagccacagcccaagctgtacgttggctcctttcagccacgactgacgtggctaggacacagtgcaccaagtccttaggctgcatacagtacgaggaccctgggcgtggcccatgaaaccactttttcctcctgggcctctgggcctctgatgggaggggctgctgtgaaggtctctgacatggcctggagacattttcccatggtcttggggattaatgttagattccttgttacttatgcagatttctgcagccggcttgaatttctcctcagaaaatgggattttcttttctactgcatcatcaggctgcagattttctgaacttttatgctctgcttcccttttaaaacagaatggctttaacagcacccaagtcaccttttaaatgctttgctacttagaaatttcttctgccagatactctaaatcatctttctcaagttcaaagttccacagatctctggggcaggggcaaaattctgccagtctctttgctaaaacataacaagagtcacctttgctccagttcccaatgagttcctcatctccatctgagaccacctgaccatggaccttactgttcatatcactatcagcatttttgtcaaagccattcaacaaatctctaggaggttccaaactttcccacattttcctgtcttcttctgagccctccaaactgttccagcctctgcctgttacccagttccaaagttgcttccacattttggggtatcttttcagcaatgcccactctatgggcaccaatttactgtattagtccattttcatgctgctgatgaagacattcccgagactgggaagaaaaagagatttaattggacttacagttccacgtggctgggaaggcctcagaatcatggtgggaggcgaaagccacttcttatatggtggtggcaagagaaaaatgaggaggaagcaaaagcagaaacccgtgataaacctgtcagatctcatgagacttactctctatcacaaaaatagcacaggaaagactggcacccatgattcaattacctccccctgagtccctcccacaacatgtgggaattctgggagattcaattctagttgagatttgggtggggacacagccaaaccatatcagtgtttgaagagtatttttattctatgctcattgagtaaaaaaaatctgtatcagattagggattgcaactggtagcccataagctgcctttggcctgcagacatgttttgtttgactcacacaagtgtatttttgaaaacttgagtaaacatttacaaatcacagtattttatgtaaaaatatggatttggggctttctatgaaagcttagaagctctggctgtgctgggccctcattccttaatggcaacagtcggctacgattgctcctaactcaaagggcagtctacccgtccccgggtggccttcacagacctggctgcttcagccatttaccctgcctgcctgatacctttaggcatcagcctctatcacctgtgtgttctatcaagttcattcagaagttctggagtctttcttactttttgtctacctgatctgtttctgagaaggaatgctggtttccatgatgattatggatgtgtcagtttctttccgttttcgctgtacacattttatagctatttacaaggtacattacaaggtataatgaatcttcatcaatataaaatcctctctatctcatttttgccctttaattgtactttggctgatataacacctgtactttgattgataaaagtagcacacttgcgaatttattttatcatccttcttctcatatattctttatttctaatgttggttttataagcagcatgtatctggatttatattttaacacaattgaagagtctctttaaagaaggactttgttatattcatacatgtgctgatttcagatatctttggatttatttctattgtatttgtttttatctattcatccatccatccatccatccatctgtccgtccatctgtctaccaatctgtctttaccttccttttgctggttagatgtagtttcttctcttttctttcattctaatgggttgaaatttttacattctaaatctgtttttctgttactctttaaacacagttattgggacttatgtttctctacagtgtttagcgctaatcagtacttaactctttcacctgagcaacataagaaacttaccatagctccactcctctgccatcttctgtctgtcgtcacctccttgaattgggataattcaaaaatttaactccatattatttttaacaagtttacatcatgcatcaacaattgtgtgagcttaagtataaagtctaattaatttctttggtcaccattgtttcttttttcttacatctttgtatgtgatttttttattttactagattttctcatctattaaattattcattctcttaaaagatattttgagtgcttgctataggtatgaatggttatatagatagtaaattttctgagtccttgaagtctaaaaatgtcattattttctccctacaaatttggctaggttttgactttaagttcaagataattttcactcataatttaaaaggtattaccccatggtctttggtattcagtgttgctgacaaggggcgtctctttgtctcaggtgaatttttttgctctgaagtctactttatctgatattaatatagctacttctactttcctttgattaatggttgtacagtatacgtttttccatccttttactttcaacttgcctatattgttatatttgaattgagtctcctgtagataacatatatttgggccattttttaaaatttatttttcttttataaaaatttttattaatttgaagagtacaatacagtagaaattgcctcttttttcttttattgataaatgacatttcacatatttaagaggtacctgtgaatgttttctacatgcatggaatgcagaatgatcaagtcaaggcatttggggtatccgtcatcttgggtatttatcatgtctatgtgttggtaacatttcaagtcctctcttctacactgaaatatttaacatattgttgctaactgtagccccccggtctgctgtcaaacgtgggccatgtttttagattcacttgccaatctcttttagttactatatttagatggttaatatttaatgtaattattgatacattaggggttaagtctgccattttaacttctctattattttcctctgtatttagtttctctgttttttttttcctgccttcctgtgggttacttgaacactttttaaaatctcacttggtttataatgtttttgagtatgtcttcttgtatagcttttttagtggctacccttggtattacattatgcacatgtaacttctcacaatcaattttatgggtgttgtcactttaccagcgtgaggtacagaaaccttaccttcctttatatcccattattctctcccatttatatttgtaatatacatacatattaaacatacattcatttagaaccacatcagacagtgttgtaatttttgcttcaaccatcaaatgtaatttagaaaacttgaaagtaaacttggtgaatctgtaggtttatatctcttgccaaatttggagagcgtttagccattatttcttcgagaacttttccagcccccactactttttttcctcctcctcctcctcctcctcctcctcctcctcctcactcctcctccattattagagacagggtctcgctgtgttgctcaggctggagtgcagtggggcagtcatagctcactgtaacctcgaactcctgggcacaagcaatcctccggccttggcctcccaaagggctgggattacaggtgtgagccaccactcctggccctttttcctctcctcctgtccactctagtgacatgaagtttaggtctttgttatagtctcacaagtccctaatgctctgttcatatttttaaatttttttctttatgttgttcagattgggtaattttatatatatatatatatatataattttccagttcactctttcttctgtcctgtgggttctattactgagcccatcactgagctttttgattattgtatttccagttctaataattctacttggttcctctttatatcgtgtatttctttgctgagactttcagtttctttattgagactttctattttttcatttgttttaggcatatttgtaattgctcacctaggtgtttttttcatggcctctttaaaatctttattaatatacaactagtatatccttaaaaattaaaaataattttaaaaggtaaacctaaaaagaggaagaaaatgaataaaatgtctgtcagatggttccagcatccgtttcctccatgttggcatcggtgattgtctgtctttatgcatttgagatcttcctattcgttcttggaatgacatgtgatattcctttgaaacctgtacatttttgcattatgttatgaggctatacctgacttcagccttctgtttcagctggcttctctggccctgttgctgcagaggacaaggggtaccatttcattattgtcaggggtaggttgtccagggcccccattcagcctccgctgatacccaagcgtgggaagtctccttatcagtgctgagaaggggcagtggttcccactccctgtgtgcctcccatgaccccacagtgcaggtcccctcattactgtgagcagcagtgagcctcctgactctccaccaggcatcctgacacaactccaggggatggaggggacacgttgttactgctgggtgtggttggaagaccaggctcatggcatggtatctgctggcacaatgcaagtgggccccttttgaggttgctggaggtaaaagcgctgcttcctacctgctgtttcctgacatgccccagcagtgaggtcgggcacctcatttcgtcctcgcatgggtggaggtctaggctcgccactcaggctgtgctgccacaggtcggggtggtgccacggttccttgctgtggtatttggcctacttattgtgtatggttttttccatttgttctactggccctgtctcgtcgggtccctctggtcttgttcatgttgctttttaattgggtgcccctctttcttgggatgggttttcctcaaacatgggctgcttcttggtcgtccacccctgcatgtgctcacagattcccatgtggctgtgggtggttgtctggtctgacggcaggggtctttctgtgatgtggagtggagggagctgttgcttgatagcatttcttctgagaagggtgcgaggcggactccccgctcccagggcattgtcctggtgctctggccttaggaccctgtctcactgcaccagcctcaagatgactctgctgctgtccccactcagcctggaggctgagacctgccaccctagctccttactccgaggcctgtttggggctcctcctgtccttgcatgcccagcctggcaccttcctcagctctggaattgttccccactcagaagtcctcgcgccaggaccccgcctcctgctgctacctgatgccctctgcttcccgtctttcctcagtgcctcaagacagctcgtctgtgctgatcttgtttcccaaggctggttcagatttgttcgttctaagttttattcctagggatccaggccctggggagaggtaggctgcgtgctcagtcttcctcctgggttgggtctcttgagtcttttcactgtggtgcagatggtgacacctcttgccgattgctgttggttgccaagcacttgtagtcatctttgcatccagttcttagtgtgcctctgtgcgctggacatgatcatggccgtttcccaccaggggagactaacagagagatgaattgccacatctgggttcacacagctgccaagaggcagcgcagaggcttgagctcaggcctgttgccctgaagcctggattccacctttgcaatcatagccttctgatgctaggacatcgcggtgaccagatgagaacagctgccaccaagcccagtggccagaaacagaagcagaaggggaagccttcgcagtgtataactgtatacttcttgactgaattctgattccttccaagcatattttggcctcgcctcttcctcctggcctaaaaaggtatgataatgggaacagcacaggagggagcgagagagggcagcaggcatttcctagcccctcttcttattcatcctttctttgctctcttgctctgttcacctttttgtctttttaattttgacctggcacatagttctccttctctctctctctaatgctccttccctcccagcccttctgcttcagggtggcattggtggtggggggctccagacttggctgcctccactgccatcagctcacctccaaggtgagtgcaggctgagcttcatggcaagcccttcctgctggggcctgcagaattctaaaggccctggccaagcacagtggctcacacaaaatccctgcagtttgggaggccaaggcaggaggatcacttgaggccaggagtttgaaaccagcctcaacaacatagtgagaccctgtgtctacaaacaatttaaaaattagccaggcatggtggcttatgcctgtaatcccagccactcaggaggctgaggcaggaagatctcttaagcctagatgtttgaagctgcagtgagcaatgattgtggcactgcactccagcctgggcaacagagcaagactcaaactcaaaaaaacaaacaaacaaaaaagtgtgaaggcccctcccagaatgcaggctgaggatgtgatcccatccactgcaccaggtcctcctggcttcgtgccccatgcggcatcctttgagaaaagcttgctggggagccaggtgtgctggcttggccggagtggaacctgctctctcagggaggcttgcaatatgcaggggaggtgagtggagccctcacccctttaactttaccaggcttctaccctttagcaagttcctcacgtgtgctgatacttaaccagattcagacactttcctaaggcaggaggggtgtcatgagggacactgcattatggtacactttccctgcattttttttttttttttgagacggagtcttactctgtcgcccaggctggagtgcagtggcacgatctcggctcactgcaagctccgcctcccgggttcacgccattctcctgcctcagcctcccgagtagctgggactacaggcgcccgccaccgcgcccggctaattttctgcctttttagtagagacggggtttcactgtgttagccaggatggtctcgatctcctgacctcgtgatccgcccgcctcggccgcccaaagtgctgggattacaggcgtgagccactgcgcctggccttgtatttttaatagagacagggtttcaccatgttggccaggatggtctcgatctcctgacctcgtgatccgcccgcctcggccgcccaaagtgctgggattacaggcatgagcccccgcgctcagcctccctgcttttcagaagcatcgccagtccacagggcaggatccctgaggctggtctggagtaggctgcatttggggcctgcagcaagggcagctggagaccgcagggagccctcccacctgacaaacagaaaagctcccctgctccggcccccggatataggtgcatcttttcagaccatgtttgccctgtttctgggaaggaaaagtaaacggcagcgaccagattcctgttggtgtttttgctccatattttgattggggaactgaatcatgtttttcctttcataaacacgaaaatgttaagtacataacagctaaattaatccatgcccataaattggttaattatgttaattctgagtcacagaattcagtctcgttagtgtttccattaagcagtttaggcctgtgagcattttaagagaacagtttaagctgtagattaatcttcaaaggttcccagcgcattttcaactgcaagaggattttaaatgcactggggggcttggggggatttggtgaatgttaggagctgctgctgtcagggagcgggtgttccccacttcctcgtccctcacctcccccaacacatccaaggcccctgcctgctagatctgagcatcgccaggctaagcaggagccataggaaggaggagatgggcaagaactggcatagccccttctgccctgtgtctccctggtggccatgccctcctcaggccgccctgctgcagacacccgcagagaatgggtgaggctagctctcgaatgctgtgggctgcatagccctgggttcctgagagggctgctgaggggctttcttcctgggtgtacataagaaagaagcagagagacaggaagagagcacgctgagtcttagaaacaagctcctgggtggcctttgttcatggcggcatgaacgtctccttttcgccgtccgtgtccccttcagaggtccgttcaggatatgggtttgctttcttggcacgtgcgcctcctctagggttccttgccgtacttgcgtgtggtgcagatgtacgggtgctccatctggctcagaagcctgctgtcctgtcctgcatcccaagctgccggctctcactggcttcctgtgtgtgcctgggccatgcacttctgttctccagccctcattccctagcggggagaccgtgaaagggtcagcctcgatgtcaaacctctagaccatggctaaggcttttccaggttttgtattgttctttgaagaatcaacaggacccgattatcaaagagagacctgtttaaatatgtacaatcattttcggtattatttaggtttggcaaggccagcagatgaggagaccactgccatgcattgaaaaggtggtttgttccagttcccaagaggatgcgtcccagtaccgtatgtggggccacacagagaagcagcgggttctgtcaggaggcaggagagaggggaagacacgggccagaggccttgtggtggtttctgtgggaaggagtgggtgaggcagagaaggcaagttcagaatcagctaggctgaataatttcagcagactcaggggaataggggctgtccctagctgcctgacacctggccttgggtggttaggttaagggagtagtgacctggtgtgtgagagcccatgatggaggtggctggggtgtagactctggattggttggcttgcatgtgaaaagcacactcctgatgggtagtttactatcccgagaccctgggtagcgcctgaaggaacagtctccccagggtcagcaagccccagatgtcaaagcatcagatactgaaaatacaagaggaaggggagaagatggatgataccaaagttatcccagacgcagtaccagggccagggcctcaacttagcttttcattaatcttctcaactgccttggcagataaatattgtagaaaacatgatttagagaggctgagactatggcccaaggtcatgcagagccgacattccgctccaggactctctgaccccagctgtcttccccctaccatgagctgctctgtatcttgccaggggccatacccttgccacaccacactgccagcctcccacgctggtcacggcccttctcttggaggtcgctggctgagagagctgcgcacctgtgtccgtgacacagctgtggagatgggacgccagacacatggaccacagactggggaaccagtctcagttatcacgggacctgacctgggacagacctcatctcctggatccagggctgcatgcaggacatgcccataaggagcgtcgctggctacagctgtgtttccactgtagaaggaggtggagtggctccatcagggcatcaggaacagaacaggaagcaggaagagatttggcttggtgatcccccgcgcgtccccacacacttcatgtcacgatggcgaacgtaggtctgccttgacaactcggcagaccacagctccctggagctcctagaacaaggctgtcctgtgggggcatagttagcaatttgaaagccgtgtctattgtcttaggtgataatgagggttgacagaaaccttttaggattgtagcatttctaagtaactgttgaaaccttacttggcccggaatggctgctcatagaacagaatgtgctatagttttactgaaaaaaacaaaacaaaaacaaaacataattctctgtggacttactaaaataaacccagggctaatgagcaaaatgtgttggggaggcctatttgtcacactcaggaagcgacagtctaattttatttgctcctgttcattgcttctgcattgccattcattcgctgaaggcaaaatacattacttctcaataaacaaaagtgggcccagcgtgtcccgctccctgccttcctccagccgttatccccccgggcaggagggctgacttgtattgatgtgcatgtgcgcgtgtgtgtgtgggtgtgtgggcttgtgggtgtgttcttcccattgctcttaatgttgagcttcctagaaagttttcaggggaaatgctgtgtctcgtgctgactggggccggctgcatgttgataggttcaccttgccttatacaaacctgctatttggaaagtcgagatataaattagaagcaggcggccgggtacggtggttcatacctgtaatcccagcactttgggaggccgaggtgggcagatcacttgaggtcaggggtttgagaccagcctggccagcatggcgaagccccatctctactaaaaatataaaaattagccaggcgtggtggtgtgtgcctgtaatcccagctactccagtggctgaggcaggagaatcgctcgaacctgggaggcgaggttgcagtgagctgagatcacgccactgcactccagcctgggcgacagagggagactctgtctgaaaaaaaaaattagaagcaggggaaatggaggaaagacaggtcactacggaaaaaaagtggctttgtttttttttttagcttcactaagtgagttgtaaaatcattcatttcatcaagttctcccagggcatttaaaatattattgggtttaggagattttataggaatgcacgtattatttaaagcaaggcaaactggtgtgattccttcctggatggagcttctgtgggcagctgcaattgtcagtggggggattggttcccatagcaccccgagttcttccctcaaacacaaaggcaccaggttctccaaagcaaccatcttccttccactcaacactcctcccgcctcacacccacagactcgtccttagagtggactgggcaggcgggttcattgtgccacgctgtgctctgaacccagcatgcccaaaagcagtccgttagcaagctgaccatggggagttcattgccatcaatgccatcaaaacaatttgcccaaatcaaatttatacctgacattttatagtaaatgggcctttcttttctcattagagaaatcattactgtttttcttctccttggcatttccagagagccattcacatttaaagctcatgttggaacagcaggcttctactgaaaatatttaccttttctttgttggcaacttgtcagtgttggggaaaatagatgcttcattaagatctaagcgcgtgatgcttgctttcccacacatcagtcagtctttttccaagatgaaaagcatggtgagaggtgttgggaaatcattctggtcatatgtttttatgtatttttggatgtcttctggcatcccgttcttcttgttcaaaaataggcatttcaacacctataacttgtagagagaatcctagaacaggatcagcttcaccacttagagcatcagaattggtcttgacccccgggtggccagtgaggtctcctgccctggagatccatggctgaaagtaagggcaaagagaaccctgctgccatttatccagcagttccggggccagggcctcaacttagcttttcgttaatcttcttaactgccccggtagataaaaattgtaagaaacatgatttagagaggttgagaccatggcccaaggtcatgtggaagcgagattacaccccaggactctctgaccccactctcttcccctaccgtgagctgctctgtatcttgccggcggccacgatcttgccagcctcttgcactgggcctggccctgacccttctcttggaggttcctggctgagagagctggacacttgggcccagtgtccctgacacagccatggagatgggatggcaggcacatggaccacagatttgggaaagaccccacttcatgtccacccgacccctcctctccacccagaaaggacaaaatacagtgagctgatgccacagcccatgtgagctgggcctagaggtggctctgccctgcctataaaagggggaaaggaacttacaatagatgccagcaaacccagaaacccagagaaggttggcccctgttacgactcctttgatcttcacagggaggtgagctcttgctctattaaaattaagaacctctgtttgtctagagctaccataaacacagtgagaagaccaggcatacactgggagaagatttttataacctgcattaccaacaaaggattaattctcagtacaagcaaaattaaacaatgtatcacttaagcatatatacaattgtattaaactagtagtatttaaaaagcaatggcctgcgaggtgggcggatcacctgaagtcaggagttcaagaccagcctggccaacgtggtgaaaccccgtttctactaaaaagcacaaaaattagccgtgtgtggtggcgggcgcctgtaatcccagctacttggttggctgaggcaggagaatcacttgaacccgggaggcggaggttgcagtgagccgaaatggcgccactgtcctccaacctgggcaacagagcgagacgccatctcaaaataaataaataaataaataaataaaggcaatggcatgaataatccaaaaattctgatcattttcctctgagaagctgggggtgacagggaggacacagaagtagaggcccccagtgggtcacgttcttgttcttgcattgggctgcagggttcatgggtatccgtttttttattaggctttataactaacgtgtatgtgacatacaatcttttgtgcttatcaagtcatgtgtttttagaaaacaaaaagaaaaaccaatcagttattgttactacctccatttttttttctctctcttttttttaattattattatactttaagttttagggtacatgtgcacaatgtgcaggttagttacatatgtgtacatgtgccatgctggtgtgctgcacccattaactggtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccagtttcatccatgtccctacaaaggacatgaactcatcattttttatggctgcatagtattccatggcgtatatgtgccacacttttcttaatccagtctatcattgttggacatttgggttggttccaagtctttgctattgtgaatagtgccacaataaacatatgtgtgcgtgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgttttggatttctctgatgaccagtgatgatgagcattttttcatgtgtcttttggctgcataaatgtcttcttttgagaagtgtctgttcatatcctttgcccactttttgatggggttgtttgtttctttcttgtaaatttgtttgagttcattgtagattctggatactagccctttgtcagatgagtaggttgcgaaaattttctcccgttttgtaggttgcctgttcactctgatggtagtttcttttgctgtgcagaagctctttagtttaattagatcccatttgtcaattttgtcttttggtgccattgcttttggtgttttagacatgaagtccttgcccatgcctatgtcctgaatggtaatgcctaggttttcttctagggtttttatggttttaggtctaacgtttaagtctttaatccatcttgaattaacttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtcgtatagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgatactacctccatttttacagatgggaaaactgaggctcagtggggtcaaactagcagcaaacacacacgttgaatgcttactgtgtgccagaccctttacacggatcatccgatttcatttgtttgacatccctctacatatgataagtgtcatcattgcagtgtgcagaagactgaggctcagcgagacgggagaacttcagagtcactacctggtcacagttgatggtgaaggcaaggtcttcacctgtggcatgccccacgtccctcctgctggctccgaggctcactgtgagtgacagctccactctgtggacctccccttgggagcaggcgtcgaggcatctaagtccacttgccttgtgccatctcagtgcctggacactggtggctaccctgggccgtcctgcagccagctcgctgaggtaggaaagagaggaagggaaacaggtggagtgagaagagaagatagataacactgaagttacatttattcctactgctcatagtaggctttcaagctatgaagagatggctcttcccgtgacttcagccccatcctccatcgctgcccatgcccacgtggctgacactgccgaatgtctctagcactgttgttgaacttctgatgtctcctatgcctcaaccttgctattgccttggtgtaaatttctctgacattgattttgaatacaattccaggcttttggagcagaagtttccagttaagcttggtgtcccacctaagtgttaaggtcaacatgccgagccctagagtggtcctccctctcccaccaccaactatcctacctggcctcccaagaactgcctttggtgactcttgtattctctgtcttgcttcatgcctgggaaatttcagggcatatattaaggggaaaaccttagggaaacctgaaccttcaaaactgggtagaatgaatggatggaatggaagaatttactgcagcgaaatcatcttcaaattccttttaggttggaagcttcttaccctggcaagtgaagaagtacatttggttatatgtttataatccatgtgctactgggtgaaagatgataggacaagaacatttgaaatgtatgtgttagggatctctgcccagcagtttccatcaaaagagcacacccatgattatcgtacaaatggatgggacagcaggattctactcacgtaaaatgtttgtccctgagcacctagggagggtgtcacctccagggtctccttcctgttgctcttctgcatgagtcctgcaccacctcttttaacctcagggaaaacttcactattttgttttttaaagtcagtcatatttaaagttgctgcttttgagtatgcactacgtgttgatgtagattctggaatgtagaacaaacaggcgcagactagtatgggtaaggtggggaacccctacttcagaaggtgaaccccagaaggaagctgcctgggccaggggtgtgtgcatgatggcagggagctgcagccactaagccttggaagagtctttaatggcacagggaaatgccctgtataaagctcagtgggggaaaaaaaggatttagaaagaaagtatatgctagaggcaaagaaaaagactagaagaaaataaccagccaggtgcagtggtgtgcacctgtgatcctagctactcgggaggctgaggtgggatgattgcttgagcccaggtgtttgaggctgcagtgagctatgatctgtgtcactgcattccagcctgggtgacagagtgagaccccatctgtaaagcaaaaaaagaaaagaaaatagccaaaatattattggttatttctctttttcccaaagtttgggcaagagcatatactattcttacaatcagaagaagtcctcttttccattacgtcttaaatagctctaagatttagaattcgtcttgatgaaggcatggtcatcgcacacacagagctgggccccgtgggtgaggggctcccgggggcctctgagtggggagctgtgggtgtcaagtggccatgaagagagttgacccagggtcgggtggcaagattctctgagccccagagaagtcgactttctgtatctactagaatccaggaagagtgtgtccatggccgtcattaccccctgcttccccgtttcatgccaggtttttctcagatgccttctctgggggaggcactgttgctggggcaactttctggctgcagagggcacccagtaataaaggcaaatgccaagtatgaggcaagaagggacgcccctggctgggatggcaggcattgggagaggcttatgggagcccctcacccctctctttttggggtgctctcgaggaagctggactctccacctctaaagacccctccagggaacatagaacccaaacccaaatggagatgagctggccagcgaagtccaagaccccagtcccctccattgcaacctggggtgcgggcttctgtcttccaggttgaaagctcatcatttggttcatcataagttatacgtcggagtggaattataaaggagagagaaacagatgtgaactctcaacagctgggagaggtggaaagcctctggagttccattatagaaatgtgccttttggccaggagtggtggctcacgcctgtaagcccagcactttgggaggctgaggcaggtggatcacttgaggtcaggagttcgagaccagcctggccaacatggccaaaccctgtctctattaaaaataaaagttagccaggcatggtggtatgtgcctgtagtcccagctactcgggaggctgaggcaggagaatcacttgaacccgggaggtggagcttgcagtgagccgagattgcaccactgccctccagcctgggtgacagagtgagactctgtctcaaaataataataataaataataataataataataataggtcttgttttttaaaataaaaaacagaaatatgcatttttagataccagcaggacatcatagcactgagggaagctgaaccctctctttgggacgtagcttgctttcttttgttgccctggcctgagttctttcacatcagccagcatggagaagaggagccagttttgcagaatgactgggaacagcccctgctggggagggactctgtgatgcggtgtcctcatccgagcctcctgggcccgggttcccgtcgctgtgtgcccggagcctgggcgccgacaccgagcctcctctgtgctttcaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaaggtgtgagtaaccagggctacaggggagcgctctgggacaagggtgacagtaaacattttaacaagtatcagagtgacactggccacagccctgaaacaagacagggaagactctgctgtgacaggtgccagggccagtgtggaggagtcactcggggagtctgagaagtggctcttgaccggcgagagcagaagtgtttttgcctcgttccagaacagctgttccagtgacagccaggtggccactgctagcacgaccctctctgccttggagtttgcccatccctggctgaagggggtacacaggtgggtgacgggggtctaaggcagctcacctggcctgttacttggactctgcaggggcctcggcccacctgcgcttagaaacacccagctgtggaactctgtgcattcatcgcggggtatgtgctcacccaggccccgctgcagcaggaagcagtggtcggggtgtcccccaccagcgcacagcccagcccactttgaacttctccaggggaacctcacaaggggctaagcagggcaaagatgcttctctgccgatgggccaaggggaggctggcaggctcctgcgaggccacccgccagccactctgtggtctttggttccggatccttgtgtgtcaggaaggctgaggaagggggaggaggtggctgcagatgagccagttcttacaaacagggtggcaaggcagatttctgggtgaggacagcttcttggagcaggcagacagagctgtggtcagcgtccaggaggccctgggtggccgaacaggtcccagcccaacgtacaatgtgtggtcagtgactgctgtagggagtggggaccgggggagttccagcaggaagtccaggcttctctgactcctcctgtgggggatgggagaatgggagggggtggcaggagtcaagcccattaaatttatatcgtttaaaatatttttacagttctcatcgtattataacccatgcatagtgattgcagtgtggctcataaacagctagtaagtcagtcggatagtaggaagagattatactgcaaacagcctctctctgtctctgtctgcccacccccgagtcctgccccacggaggaggaatctgttttcaaaccgtgttcatgatttcctttctctaagtaatatcatttgatggctttcctgggtgcgttgagtttggtcaccatctgttaatttcctcttatcagaatgagcgtttttctctcaggagacccctagccctgctgccctgccgaaaccctggagtttcctccacttcttacctttcccgggcgtcaggcctacactgcatcctctgcctcctgccagctgcacctgcctgcacctcctccgaaggacttggtgtcactctgcaagtgtgaggcggaagcttcctcctctactgcccccaccccccaaccactcaggtcttgaatgcctgagaaaccaatgaccaaatacagggtatctacccgcctgtccctccgagtttagtactcacccagacactaaatgtgagaaggaaaattaaggaagaggggcggtgtagacacacacacgcacgcacacagcatggggtcttgcgggcatccttgggacactggacagcttcctttatctccattcccccaagaaaacaccgaggcagcttcaatgaggctgctgagcacctaagccaggcccaaggctgggctgagtgagtgctggcacactcgggtatgaccaagtcagctgctgcccaccaagaactgccgaatacataaatcacccttccattacttagctcccagctccaacccactagatcgcttggatctcagtcttgatgacaagcgagacatcctaaaaattaagctgaatttaagcttcggagagggtgggtaagctggagggcgggtttcctgcatagaacatattgctttggatggtgttcctgctgagcgtctgtcatttctacgggatgatttccaaagatggagctcctaggatgaggcaccctccgtccaggaggggtcctggttgtttggcagtgatcgttcgggctctctggttcactgagcctatgggaggcttggggaggttggagctgcagagagggatctttgcattcggaattctgagcagtgttggtttcatccagctgtcaggggagtggggaagttgcagaggggaccacgtggtttcccctcattcttgtcacagttttgtgaaatactgaggtcatttgattttttttcgtcatttggaagtaaaatatgtcatacagagaaccttaaatcgcaactgtctcgatctgtcactgaaaatcctcctagaaatttgatgatctcaaaccaaaccacattcccccatctgcttttcctccttgtggccctatttgtcgcctacagtcttctgtaaaatctgactttatctttggtagatgatgtggcccggcggtgagagactgtagaagctgtaacttggcacaaagatctgtttaacgttggtccttaggaagcctggctcctctcacacctagctattcagaagggaccattagacattgctgtggctaaagacactggccgcgtccaggtggccggtgtttgctggccctcagtcgcggtgcttctgagctcatgaaatgaactctccctccccagggaagacatcgaaatacgatttgattgggttgaagttgtgagtttactgaaaagaagtgcaagttcatggctagggttgaaatgtcccctacagcttctgtcccatggcttccatgaagccactggaagatctgggaagtgaaaataaagtcgtcagagacagttaaaacatctctacactcctcagacctggctgtttcctcgcctcatttccacgtctccttcccagaaaccgttttaaggaggggaaaggttgttggtaccttgatgcctatgaggatgggttggtctcatagtaaatgcatgctgcatgctgtaaatgcaaaccttgagcatttcagcctcttggtattcaaagtggggtccagagccagcagcactggcgtcccctgggagctcattagggatgcacactctcaggcccaccctggactttggggcacaagtctgcattgtaacaggttcccaggtgactccagggtgtgcacattcaagtttggggagcgctgtttttggccattctctgctcctggagcagtaaggttgcatgctccaccttgcaaaaggacaacattttataagtcatttcaagtggggtggggagttaggagtggcagtgtctaggactaattctcacctggaataaggacaggctctgatgggttaaataccttttgatttgcattgtagttgctttaaaccggcttcagctgaatctcttcctgcaggtaatcacgtgcacacacacaccaccttcctgagctctttgtgcctttctctcagaaggttagcttttctgggagggacctttctgttgagctcttggccaccccgacaggttcaccttgcagatgcagaaagcagagtggacgcggcagccttaagcagcggggctgcgtgagctccaagaactttcctgtgggctttcttgggagcctcaagttggagctggagtctccttggtttacaaacccccgtggtgtgagcgtacagagcaggcgggtccactcattgtgctccaaaagtgagtgtgacatgtttggtcagcagcaggcttcaatttggctctacggggattgcagaattggtgtgtaagttatctttaaattggccgattgttgagcataagtataaatttcctctgtttgtttgggaaggacggtccttagtaaggatgtgatggccagccagtggctccagtttcccgtggaggtggatgctggcccttctctcgggccagctgtgcaccaccagcccatccagccatctggactatatccgtcagttcagtcttccactcgctaatctttagctggtacttgtggctggaatgattctcagtgtggtcagaaatcatccatcctgtgggtatgggatagagcggagctgcaggaatctgccctgactggctgctgtctttcaaagacttgctttcatgtgtacgttcttaacaatgaacaccggtgcacagctgggcatggcggcacacttctataggcacagctactctgaaggctaaggcaggaggatcacctgagcccgggagttccagaccagcctgggtaacgtagcaagacccctgtctcaaaaaaaaaaaaaacaaaaaacaaaaaaaaggaaagaaaacctacacacaaatgaggccctggccttggctagtgatgtaaatcagaccaccctgatacttacccactgcagagaccacagggagctctgacaggacacccacaagctgctaccagcttcctggacgtaaccctttccacctattctgtcttcacgcagagttcatggtcctatccctctttgcaaatttagctcgctctgcaagaagggtacctcttcaagtatgttttccagaaaaatcattcttttccccaccagaccagctctttcaacccagaaaaattaaagttgtaaattcctccatcatctgtaatctcagtgtcatttgcagcactgctagctctctttgatcctaggccattgcgatggaaatgacaggcatggctctggaatagagcagcttgtgttgggacccttgattttcctgtgaagaacagaggagtctttctggcccctttccctcgtatgatcctgtgattctgcaattttaaggctgcttccacaggcaaaggcacaccattaaaatccaaacagagcccccaaaaccatgctctcagcagcatccagatggtctgaatgcaaccttcttatccctttgaaggaacatttgggagatgggactctaggttcggggggagacccaccctacgaggttctgctgcggggctaagccttgttcctcttgtccctccagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtaagttctcttggcaagttggagtgcttacagtgagtgcctcagccctctgggaatgagtttcttctccctttctcagaaagatggcttagattgaggccagattgttccggatcccagggtcccagcctcacccatcggcgaacaatttgagcctgaaggtaaaccccagtcccttggcagccttccttggacactggctttctaatctttgcacagaaatagcagttaaacccctctctggctttagagatctaaaaatattatttaagaacgaggttccttctcatgatgtcttgttttaactctgaaattctgtggtcacatgtcttggaatccaatgaacccatccagttccagcgtgtacaacagagtaagagaaagacttggttttatactgagacattctagaaatccaggagttcttctaggcattctgttgctacagaagcactttttctggacactttaagtcgagcagtggtttctgtctgttccgcttacttaagtgaacataagcatgatttgtcttttaaaaggtaactgttttagtactcaggtagaatttgtgctttttccttccctacatactttcctacttaaaaaaaaaaaaaaaaaaaaaagaggaagggagggtttccagttcaaattaatgcagaattgaagtgcaaagtcattacgttgacttgtagacattttaaaaatgagactgtggagctggccagacatggttaaattttaaagctcactagcatcttttcatttctgcggctgctcagccacatctttcgaagttatttgcaaatttatttttacacttttctgtgggagcatacaggcttcctgttctcggctttgctccgcaccagtgaaaggtcagctgccatcgttctgtcgccagcctggtagcagctcggcctggttaactaaggtattaatttgttattttccttttctgctggagtacgcacccctgggacgggcagctgagatgctgaatggtgtcctgtttatgtagaaatccagctcatttgagcacggacctgctagggtcttattagacagacagttggccaaaacccaacatagtcttgctggccgaatggatgcaggttcgaatttgctaagttatgggacagtttataacatggactgcgtgcaggcaggatggtgtctctcaaccctggaagtaggacttgcagctttatttgcattacgaatcacgtcagcgtgtgatctgtatgccatgcatgtgtgtgtgccttggctataaaatgctttttctttcttattttaaaattctcttccctgagcaataatatgtgggtaagaagggtatagtttggagaacggtaaaagagaaaatatactttgtcttggtcactgcccgggaagtctgctctgacagtaggaggggtgttattttcagctctactagagcccagcttttgttctgagtcctcttagacgtcctccagggagacgagtgctgctcaggatagtcgacatatcacagtcccagcattcaggcaggcctgtgatggcgatcacaaccctgtccgcctgcattctctgtccctctgagtctgaggaatgtgagcaggtgtgtccacctggagcgagggatgtcctgtggtgacacatgactctttatagaggagtaaaacctaaagaaagcatctctcaccagaacaagagggtatgttcgttcactgaacacgagctgtgtcccaggcgtggcactaggactcaggaggggctgtccaccttgattcagccatccctcccagggtaggcccctctgctcgctccccaggacccccttctctgaagctggagaaccagctgtgagcctcacatgctcttgggagcgtggcctcctgcccagccacccctagtttctcctcctggccaccatttaccaagcccaagtacattcaggtgcctggctgtgatctgccgagaacccctgaaatctatatcatggtgtccatttgcatatgaagatgctggagtcagagagggagcatttttgtcccttttcccatgccctcagctgccctccccatgttgaggtaccccagccccactgaaacgaacaaggaggaaactggtctctgttggccttcccgtcacatcttcctgtgtgtgacacagaccagacccccaccttccctagacagttggcccagctcaaacgtgtgcaaggaaggtgctgagttcggaagaggatctggattgctctcactgtgaaattgattctcaaaggttaggcaaatcggctactggagtcctgtggtgggtgggtgggtgtgactttactattcctgccataacaaattatcacaaacttagcagcttaaaacagcacaaattgatatctcatggtcctgtaggccagaagtccaggagcctcagccgagtctctgctttgagtctcacaaggccaagaccaaggtgctggcagggccgtggttccttccggaggctcccgggagaatctgtttccttgcccactcgggctgttggcaaaactcaggtccctgtggttctgggactgagtttcccatttccttgtgggctgtcagctggggcccgttctcagcctctggaggccacccacattcattggcttactcctcagctccctcttcaatgccagcagcggtgggtccagtccttctaatgcttcctctctcaaacagccttgctgccttcctcttccaaggtggagggccctgtggtggcagcaggtctactcagataatccaggataatcttcctgctttaaggtcggctggctaccgaccttaactccatctgcaaagctcattggaataacaccaggggacaaagatgatgggggcgacaatcccacctagcacacctgaacccacacaggctgaacccccagcacccacttcccgtttgagtccaacgggagatacacgtcagcctgagtggtagtgaggtccagaatccatcccacacccagcctgggccagtgcctccgaggagggcaggcagagccccagctagcggtacctgccttgttgccctgtgcagtaggccttgggcggtcaagaacatgccaggttgatctgcttcttcaggaggacgtcctggtggagaacccagcttatgacctactggctaaaggcagaaactctctctgagccacctgggtacctctagctgctctgaagtcagggggtgacttaggggtagctagtgtggactctgatggttttgccgtgggtactcttggctgttggtgataggccacaaagtccagcagacccagggatgagggcttgtggggtgcgtcttggtttcatgttgttttaccattttttccacatgcgcttctgcagtagagagggaaccagctgatctattattatcaaagcgtacggtctgtgctcccagctggccttcttgcccctgcctgtcttcctacaaagtgatttagcagggagcaccagatgttgtggaaacctgtggttgccgagatgcatttgcctaacaccttatttgttcccgagacccagggtcacgcttgccagttagtggcacctgaagtagcccagccttctccagagagtgagttagcctgtctgccatcactgcctcactgtgcttctctctcccccaggtcaccacggatctgcgtcagcgctgtaccgatggccacactgggacctcagtctctgcccccatggtggcgggcatcatcgccttggctctagaagcaaagtaagttcccacttacctttttctaaaaaaaaaaatgtttagattgtggtaaaatacacatgacattggccattttcaccctattgaagtggacagctcagcggcattaagcacattcagtgagtcgtgcacctgcaccaccatccctctcccagagcttcgtcttcttcccaggctggaaccctctgcccgttaaacagcagctgcccaggttagtcagctcaggctgccgtaacagagtcccacggactgggcagctcaaacaacagaaatttagtttctcaaagttctggagcctggaattcctggatcaaggtgtcagcagggttggtgtcttcttggcttgcagaaagctgacttctccccttctgctgtgtcctctttttataaggacactggtcatattggattagagcccaccctaataatctcattttatgttaattacctttttaaaggccttatctccaaatataatcatattctgaggtactggggcctaagacttcgatgaatacattttggaggggacatagttcagcctataacactccccattgaccccccgccctagcctctggcaaccaccattctactttctgtctctatgaatttcattgctttaggtgcctcatgtaagtggaatcacacaggatttgtccttttgtgcctggcttatttcacttcacataacgtctttaaggttcacccgtttgtagaacgtatcaaaatttccttcctttttttaggccatcctgatgggcgtgaagtggtttcttcctttcttaaagcccaagtctcctgccctttgtaggacacgggggctggctgggccagagtccaaggcctgcctctgattctgcacctcacagcaaatccacactttaggttgcgctggcttccttttaggaactttcatttataaattaacagtcaagaaaaactcttgagttgcgtatgtgttgttggttcagaaagaaaagcaagttaaccgcacatggagtcatagagtcaaaaccaaattgtactttagtcaccaaaactggcagagaacaaaccagccctctgcagtagtcatctgttgtagatgagttttcaaataactcaaaaagaatggttgggatgcctcaatgcttgtaattacgtgtgtttgcatgtggatttgcacaagacaaactgagcgtaacactcaaatgctaccaatgtaacaaaggaacagtttgatatttttgatttccaggccaaaatgttagcttctgtgtcctgaggctctttttaaaaattcttcataatgagttgcttgtgtggaaactcacattcgcatactttacccttccttgcgctgtattttcctccattccttattggaaacatgcaaagagctaaatggaaaacaaaccctgctccggggcgcattgtccccttaaacttggtcagtgggcacgtgaaagctcagacggtcatcttcctcatcatgttagctcctcctcagacacatacaggggacggatcaggcaaacatcatttggaacaatgtcagtctagagcgctcgacacttacaggattggtcaaggaaggaacggttgatgtctgggaatttgaaaacctgtgttgagcagacctgtagcctgggatagctctcgcctgtgcaggttggccccaggccgccttctctctctgttcactactgctgtggaaggaactggggcaaagccagatggttctgggtggagatgctccctgagagtctggggagggcccccagacagcgtggggccagaatgaaggaaaacccatacgtgttggaattctctaaagggagtcccatggttttgggacagtcttggtacttttcaaacatccgttcttcatcaaaaaacattttcaacatcctctcttagacatattttccatgcggttatatttgtgattttattgctagagtcaaaaataaaatagattttttcataagaaaatggttcctaactttctcactccctggacccattctgtcctccactccaaaggtcatcccggcacctaaattcaagatttccaggaggactggctgtagccgtcttcgagtacgccctgctgacacacagcagtaacttgccaggttgcacgggcagcatggggtgtggccatgtcagcacttgtctaaactccaaagcctgcacctgtgacctctctaccagggtgcacggccatgggctactcgaggcctcagaatctcccctaacagtgaggttggcgtgtgggccgcaggaaggccagtggatgcaggaggagaacaggtgtgcctggcagggaaagtcctggagactgagccactggacacagacggggagagacggtgaggaagccagtgaccagccaggagcagcaagaacacattggagaagtcaggggaggccagggctggagcctggagagtgtgagcccagggaaggagtatacccaagacttaacgccatgggtgagcttctcgtaggaaaacaggcaaagagggggccgagggtgggagtgtgcagagcagccgccatacaaaacagtgtagcgcgtccttgaaaaaattaaacagactccccagacgatcagcaatcccacttgtgggtgatatccaggattgaaagcagggactcgggtagataccggcccagccatgttcatggcagcatggttcacaacagctgaacggcgggagcaacccgagtgtccatgatggacgaagagatcagcgaagtgtgctctgtacacacgtggaacattcagccttgaaaggaaggagattcggatacagattatgatgaggtccctcaaggacgttgtgctaagggaaataagacaaatcctgtgtggttccacttacacgaagacctggagccatcaaactcatagagacagaaagtagcgtggtgcctgccaggggctgcagaaggagcgatggggactgagtgtcccgtgggacagagtttcagtctggaggtggtgaaaagttctggaggtgggtgtggtggtaccagagcaatgtgaacgtccttaatgctactgagctgtacctttacaaatggttgaaatgggaaagtttgtgttctgtacgtcttcgcacacccacacacagagtgggccactggagagacgcctgtgacatcccagcaggtgccactggggaggccggggcagctgggtacttcagctctctctcttctgcgtctccaggccccctcagctgcagcagctcccccgattttacttagtccgtgttcctagggtcacattccctgaggcagcacctgtggcgcggcgtgcgttcctagtaaacacgcaccgagagcacggtgtgcgttcctagtaaacgtgcaccgagacaaggctggggcttgtgcttctggtcacctgcatcccaacgagccctgggaagatggtctggaaggaaagagtatgtgtttgtgatattagggagtgagagtcttggactcgagagatgttcgtttattcttggttaattttctgattgaatagaaagtcctaggtaggcatcaatttaaccgactaaaaaaggaataaaagatctataaatatttatctgtcaaatggcggccggaaccatgagcccatacatctttcttttcactcagctgtttgatagggcaaaaatatattcctttcattactgattcacatgtaggtgttatctttaccatgttttaaagcagccttgcagaaagcttgtatgttcaaatatccaggttgcatagcatttaatactgattagaagaaaggaacaatgctcttattttatactattctctgtgtacagatagtatgaaaaatactatatttcatcgaatccaagatgccataaagttgtaagatgcacctttttatgtaccacagaaaccagaagtgctgccattatacaatgcatccatatctcttagaatttttgtaactattgaagagttcttttaggctgagagttatttagacctggaaatgacgctgtgaatagacaggaccaagttcagcacctccaggcaatgtaacccgttcctggttgctgtgggcagaggggcttataagaggtatcagatcataagatggatctggatttcagaggtgttaaaaaaaagaaaaaggtgggccaggtgtggtggctcacacctgtaatcctaacactttgggaagccaatgcaggaggattgcttgaacccaggaattcaagaccagcctgggcaatatagcaagacctcgtctctacaaaaaatgtaaaaattagccgggtgtggtggtgcacacctgtagtcttagccacttgggaggctgaggtaggaagactgcttgagcccaggaggtcggggttgcagtgagccaagatcacaccaccgcactccagcctgggcaacagggcgagaccctgtcttacacacaaaaagcaggggtgagcaaatgtgtcttagaaattttaaaaaatcatctgtgtatttagttacattagtggcatgttgtattcttttgatgaaatgtttctacttccccaaaaagaatattttgcaaatttagaatcatatataaaatcttgaattataatctacagccagtgggtccacacaggatggaatctcggccaatcgtggtttgaatgtactcttatgcactgttgtatttgcttaggatgaagaataaccccaagtatttaataaacatttactattatgttaagtgtcttgtattttcagaatttcccatatggctctgggcaaactcaggcagagcttggcagcaaggctaggctttaatgcttatgaattttgggtcacccattgaacctttttttccctcaggatttagttgccggaaacttgtttacaaagaggtggtgaaataaacccttgccaaggaatgcagtccttagcctgaggggcttgctgaagttcagacgtgggttggctgccgaccccctgcctctgagtggcctgtgtggctgccgttgttgagctgtgtggactctagggtgtgttgtgtcattgcagcagccagttaacctggagggacgtccagcacctgctagtgaagacatcccggccggcccacctgaaagcgagcgactggaaagtgaacggcgcgggtcataaaggtgcggcagtggcgttctggtggaccattgggtggccctggaatgtgtaggaaggggtgtcatgaattccttaaaaggactctccaaatagcattagttgttattattaattgtgtgtcacaagaatttaaaacgcatgtgcagctatttaagaaaagtatcccggaagctcacagtgacattacggaagaaccctcaggtcacaagagtctggggtctcctatactctataactttggccacaccgagacaccacctataccaatatttactcatagttctctttaagccaggagcaatgacgtgtgcctatagtcgcagctactagggaagttgaggcaggaggattgcttgagcccaggaatttgagtctagcctggacaacacagcaggactccatctcttaaaaaaaaaattacttcccccactacttttttttgacataaaaaatatattttaaaaggaaactgtactacatctagttaatcataggtttgatatgtagttacgtattttttctaatgtgcattaaaacaaatccataattattaaaataaatgttgtttgtgtgccacctgagggcagcttgcatccttagccctgagtagctctgtgattttgaaacttgccttcagtttcctcatctgtacaatgaggacattgagatagttttgtaagttactttctaactgtaaaacttcttttggccagtccctgtgttataaaagtaaatcataggacagtggggcctctaccctcagcccagcctggtacagacctaggtaccatgaaatcaacccagggtcagggcttcgttaggctggctgtctgcggcctttgaagcaggtaattttaggacagtgctactggctttgtttgcctgacttcttttttttttttttttttttttttgagacagagtctcgtcttgttgcccaagctggagtgcaatggcacgatctcggctcactgcaacctttgcctcctgcgttcaaacgattttccttcaaataatccctcccgagtagctgggattacaggtgcctgctaccacgcccagctaatttttgtatttttagtggagacggggtttcaccgtgttgcccaggctggtctcgaactcctgaccttgtgatccacctgccttggcctcccaaagtgctgggattacaggtgtgagccactgtgcccgacctgtttgcctgacttcttatcaggtatactgaaaaatatttcatttggccgtagtatttatgttagggaggaatttttttttaaccttttctgaagctcaggtctaactaatttgacactaagtctgatactactatctgtaaaatataggtcaagcatagttaccctaagtgccgagggacattccttttaataaggaggccatcgattgggctagttcatctttgttttgcaggaatgtcggtggtagtggtgtactgtaacaagagctgacccacattttaattctggcctaattaaataggagaatagattgtatgcagttcttgaccttgcctcttaaattaaactttgaaagtctcctgccctggccaaattaaatactggaccgggccagttcgcaagcctgtctctgtgctgtgctgttttcccggaatgctctgggaactcagcagggaaagaaaatggcaaaaaagatgagtacagccttgtgttattgcatttcgggcacgtggtaattgtgtgaactgagaggtctcagattttgtttctcttgtctggtcttagattcagggagcatagatgctgacaagcccttttaatgtaaaggaacctgtctttgtctcaaaaaaagaaactcctagaccttctcagcacttctactctgtaccaaagcgggacgtgtttcctgacccacactcctaaatttagcagaaggagttgggttcagagagagagaggcagctgggacctttgagcagccctcagggggacccgtcctgcagcctggggcccccaggagacctcgagtcttacggtccctctgtcctccatggggcccggcagatgcaagagccagccttgctcccttcctgggagaggcaggagagcctggctctgaagggcctgtcttttcagttagccatttctatggatttggtttggtggacgcagaagctctcgttgtggaggcaaagaagtggacagcagtgccatcgcagcacatgtgtgtggccgcctcggacaagagacccaggtaaggctctgctgtggcatcggtgacttctcaggcacgtgggtttggagctgactctgttgtaaggtgtggctgggggaggtgttcacacatgcattctgtgcacatgtgcgtgtgcacgatgcatgcctgcacacgtctgcgttttctcttgtggattgtacagctgggaaaggaatcacttcttaagccaccactgttttgaggcctcttccccttttgtagcagattgctccatgataggggatcagttcctcagcctgaaccactcagcctagtattggaaattcttacccgtgtttagcatgtcagcccaagtcaggaatctgctcctcccagaaagtgaaatggggagtagctgcaggtgtcctttctgtcaccaccggctagagattggagctgtagccccagcccagcctaactggccctgggagtctgcagtgtgaatccaccaggcctgagcaggagcagctgggtcagcctcttctctgttgcaggttgtggggtactgcttattattcacagagcatagcagctttgtgtggcttttatctggctccgtacaaccttcttaaggcttaagcgctgggatttttttaacaaggctcgagcagaagggccctggcttcatctctctcccgtgagcagggcacacccggaactgctctttggagtaagtgtttctaaatctgttatatttgttcattgattgattgattgattgattgagaccgagttttgctcttgttgcccaggctggagtgcagtggcatgatcccggctcactgcaacctctgcctcctgagttcaagccatcttcctgcctcagcctcccgagtagctgggattataggcacccaccaccatgcccagctaggttttttgtatttttagtagagacggggtttcaccatgttggccaggctggtctcaaactcttgacctcaggtgatccacccgccttggcctcccaaagtgcttggattacagatgtgagctaccgtgcctggccaaaatttttatttaaaaaaaaaaaagcagccataaagtaaatcagaaagcaagaaccctagcccactaggagaggaaatcagattattccaattctgccatcgcagctgtttttaaggagaacggtgtttctctgggccttgtatctgatacagaacggagtgtgtttttcccataactacttgttccctttggaaaacgtgtttgaaaaagaaacagtgtgatgactgaaagtgatatatttctttatcaacaaatacaggtcactctctttagatgctcttccttgaatatgcctctactcttgtaatacactcttgccacaaatagttgagaaaaatgtgtctggtggagggctcgcatatggtaggagtgcagagagtgtgtgttggctgagcagctggatgaatagccacagaaggatcttttgaaaaatcacctttttctcccgtggctaattgcacactgaccgctgagtggtcactgcaggccccgacaggtcggccagacacctgacaagcctcagtcttgacttcttaaggcgtcggtttctctgaggagccttagactgtcaaatttgaaacaacgtgggagagtctctgagataaaggaggttttgccttctctgtctttgctggaaaacgcctgcagcctggaccctcagaggctaggtgagggaggtgggctcctgggtctggttcctgacctgggggctgccctctgccccggcgcctccgctcgtgtccccgtcagggcggctcctgaatgaagcattcttctcctgccagaaatcgttttaagatggcagagtggtgcctaggtggcgagtggttgtttttatttttattttattttgttttttaagtgaaagcacacggagtctagacagcacaggttgagggagcccgccgtcacatacagtgtaacattgttcctgtcctttgaggaaagtaaggaccctccaaactccaagaggagaagaatcagacttctgtttctaaagaaaagtcatctttacctttagcagtttcagactctttctgggatattcagccagcctaccgtctcacaccacttgcttatcagatcacttgcttaactctgtaacgtggttgttgcagaggacatacgggcctccagagagaggggtgttaccaagcagagttccatgcctcacgtccacctgtgggtctcccctcctggcagggagctccagccagctctgccactgagcctgcctgcaggtcggggtcatctgcacctgagccgcgagtatccccacagctatgcgagttttccccatcggggttcccagctgctaggatcacgtggccgaaaatgaaaaggaagcgttcccacacagccattttcccgtcttcttctaactgccccctctccgtgcacgtttgtgggtccagctgtctactctcttggcctcattctgatttcttcctctcatggtggaatcctaggacttcctgaatgtcctgaacctgccctaagctgcttcccatggtgaagagcagagcaagagggaagacagagtgtgtgtatgcctctttatacacccctctcgtgtgcatccgtgtgcactgcgtgggatatggtgactgtcttttctcttgaacaggagaggatgctaccctggtgtgaccaaaggtcagacagctgtgttcactggatgttaagcacgggagtcctctagctggggcatgtgtccacacctgtcaggtctatggtgacgtcacacatggtcctgagggagaggggctggggtgttcatacatccacccctctggtcacgggcaggggcaggaaacctctgtctacccccagccgtgggctggaatatggccatggttcagggagactgtcctcatggcggtgactgacaggaagagtcaaatgggctaccccttctgcatgtccctcctgtgcacccagcctgtgctcccaaactagcattgcatccagggccccgaatgactgcacagagctggtgccccgtcacccatggtgtccccctgcggagctgctgtctccaacgctgccccagtggctggcatcacagccccgcctgcccgagtcatgctcgggcccaaaggcgcggaaaggccaccagcacagcacaatgcgggctgcagaggaaggagctggggcggtgatgccagacccaccagacgcagtccccttcaggaggcagctccgtcatttgaaaaaaggccatccatggtgtgaaaaggactagccaagaggggaccccaagtgatacgttggcatttctcacctggacactgcacatctggggactggggggtttgagcctgtctgtgtatggatccacccgaaagataagaagaagtccctggaagggtagagaacatcagggaagaggggacctcaggtagggctgggcctgggtgagaatcaaggagccaggccccctgctccaaggcaccacgggatcgtgctgggcagtctctttactgcctggtgtttaccctgccctagagcagtctgagccccagaactgaggtattgatgtctgagccacctctccaggagcccacacggggtagggcccatcataggctttcaggaaatgctaaagctaaatgcagaggcgagaggaaatcacttaaactgaatggcagctgctgttagcaaaagagagtgacttgctagagtcctccaggatagcactggatgaaagtgccagctgtgcctgggcctctgttgtgatcgtcagaccgtagaccagaggcacgtcgacctactcctgggcacaaatggtttccatctgtttagaacctttgtcaattaaacgaaggtacataggatcatgaccaggggcatctgcctgtgcaaaatgattttaaaatctgtgtgtattaaatagaaagataaagttgatatttttatatcttttcttcaaatgaaaaagaaaattaagcttagtattattccaacgaatgaaatagaggcccagctattaaatattctatttgactcttgatttttctagccagtgcttctgtcgctgctttgaaaatccaggcttctgggaaacagtgtatgatatgcatgactcccacctcagtgctggggacactcacaacaacagggtcttttaaaccaacacaaagcgataacttacctgcacgtctttagtttctgctggtttggaaggttactgtccagacagagcttacagtttaccttggcctgtcttttaatgaactcttcacacacccacaacccacacaagacacttcagacccaaaagccaatgtgttgctttgactatcaaggcttatctgtagagcagataatctttttatagatgttcaggaattaactctggattagccgcatatcacctgcttttctggaatttcgtgaaactagactgcgtatggcggtcattttaaaacaactctatttatgaagacatatggctgtggatgagagataatggattgtgattataaaggcacttactgtgtgccaggcattgctctaagcactttatataaaaatccccaataaacatgtgaggttggagttctatctttatcctcattttatggaggaagaaatggaggcagaaaggagttaggaacttaggcccagaggtggggtgctgtggggctgagctgctcccgcaggctgcttgtctccagagtccaccttgcccccctaggtaggagctcaggcggtactgagccaatgagagcgacctgcccacccgttagaagacctcacctctgtgacctctgtgccaggagctagctgggcgcaccacctccagggatgataaagtacctgaccctggctgcccagagcttcctccggccttggccagacgccagctgctggcgtctcatctgcggcaggtcagctgggcaagctggtgaggccaggagcccagcggcctggtggagtgccgtgcggatcagacacaggtcaacccagctctactgtgctcaagcacacagcctgatgtgacgtctttttaggaagccaagagccctcgttttctttgggctgtctcagaactatgcaggtgtctgccaccctcccatcccctcctcaccttacccagcctctccctccagggcatctgacctctgtgtatacctgggtaccacaggaggcccttacttctggtttctcctcttgggctgttgttatacagagcatgcctgggtgtcctcagaagatctgtggggtgctgtgcagtcccgccctgggggtaaccacagtggacccacaacacttttcctgcctgctgctaccccttgtagctgcgagcaaacttaaccagctggttatgttcttgcaaccctttcccttcctggcttagttttgaagcaaacttcttttccccaaattgtaaaggctacttatttctaaaattaggatttggaatttgaatacagttgattctccctatttgtggtactgttccacaaagtcaccacgaacactgaagcgttattcctaggagagatacagggttaagttcctgtgagcctccggtcacatttttgccagcctgtccatatagaccgagctttatgtgtatgggtttaaagacagcttatttaacatagatcattggttcattcactttagactcacagcggacagcactagtgctcgttgctggaaccaagcttgtcttacccgtgtgttttctccttaaggcaggtctctgctttctcatgctgtttgacactagacagtgtttcagcactgcacttggggccatttcaaacagtgaattcaccaacagaaaagcacagagccaggcatggtggtttgcacctacagtcctagctactcgggaggctgaggtgggaggatcgcttgagcccaggaggtcaaggctccagtgagctaggattgcaccactgcacctcagcctgggtgacagagtgagaccctgtctctaaaaaacaaaaaacagcacaaaaatgtgaaaaatgtggcactaaatacactgtgaaacagacacttgtttttatttgagatggagtctcactctgttacccaggctggagtgcagtggcgcgatctcggctcactgcaacctccacctcccaggttcaagcagtggtcttgcctcagcctcctgagtagttgggatgataggcacatgccatcacacctggctaattttgtatttttagtagagacgggctttcaccatgttggccaggctggtctcgaactcctgacctcaagtgattcacccacctcagcctctcaaagtgctgggattgcagccgtgagccaccacacctggccagaaatggacacttatttatggcatgagagctgcaccaacaggcggtgttgccttgtttgacctcagctgggagtgtgctcgttgggggactcattatgttaccactctgcacacatctacacatgacaccaaagtgccgcaggtgttagtttgggggatacaaataaatgtcagccactaggtgaatatgcagatacagcatatgtgaataatgaggattgactgtatattttattttctcttttactccccttcaggttgaattgtagactgttagaattggaaggcatctttaaagccagctaattcagtcccctcatttaacgtagaggaaaaagtgtgctataaatttaagcatgacatattaaagcaccttctgacccaattaactgtggacggcattgtgtaagttaatgtactggattagctttttttttgaggttaaattttatttctcacctaagtgatgtgctatggtttgatcatcaaaagtaattttggccgggcgccgtggctcacgcctgtaatctcaacagtttgggaggccgaggcgggcggatcacctgaggtcaggagtttgagaccagcgtggccaacatggggaaaccccatctctactaaaaatacaaacattggccgggcgtggtggcgcatgcctgtagtcccagctactcaggagtctgaggcgggagaattgcttgaacccgggaggcagaggttaccgtaagctgagatagcaccactgcactccagcctgcggacagagtgagactccatctcaaaaaaaaaaaaaaagtaatttcatgtgaggaaaattctcagtctgaactcatatgaataaggaagcccacagatgaatgaagcagcttacctcagagcctaacgacagtcttgttgagagcgtgcatcctggaacacaggtctgagaagtgacctagaagcctcttgccaccttcacacgggcactgtgtgccctccgacctgctgttttcctattgcttaatttagcaagtctgtcccaattaactcttgccattccattcactcccgttagcgggtctgtgaaagggtttcctggatgaccttctgctgtaatgggcctcagttctttagcctctcctccccaagccaggtgccagcacagcagctggcaggatgctgctggctcctgattctggagggtctctcaacatggccctagaacattcatgggcccagtgaggaacaaagcaagtgcgttgtgcaaggatccaggttggtccaggaagccaacctggggagagggcttcaaggagggagtgagaaatactgacatggagtagcttcccaggtagaacaggaaaagtggagagcttgaggcggagggtttcagcctgtggcccgtcttcctgcttcccctggcactcggttacttgaaaatatttatttttgctattagatagtattatgcattggaaaaaaaaataggaggaggccaacatatctgtggtctggagttcctagggagtcagcagggtggctactgttggtgggccttcgcctcctcaggagaagggagcgggtggagagcatttgggatgaatggagaacatctgaagtaccagagtaattaacgttgaaatgtggctgcgtggcacgtggcatttgctgtcattagagatcttttccaagtctggccgtctccctggcttcaacaacgcacggtctccaggcaggttttgcgggatcatttaactccgtggactcccttagcgtcctcggaagatggctttatgtacatagaccacagtttcagaagttaatagcagaagacacttttcagttactttggggactttaagatctttctaaatcagttttcatcattaaagtacaatgtaggtgtattcacgtgacagtgataatctctgcacattgtttaacttgaaagataaattacttggcagtcgacttgcattttcagtgttaccttagaaataactgtagggtggagaaccacttctgtttttttcattgactgttctactttctgtcttggagttaattttttaaagtgatgacttttgatagatggcttccttattttcttcctggagtttctatctgaaatacagaaaaatttgagcacaatgatcatgaaacattttgaagcctcctcttttatttctcttcttaataaaagcactctaattggggatgttaggttaatggtttcaatagcaaccacagaagtaaaatgtgtggggagctaactgcatgtcaggaaggtggcagcgtgccctcctatagtagctgtcctgggctcccgcgctgccccagaacttacaggaatgaggagtcctggtggcctgtaactgagtgatttagcagttaagagctttcacataaaaactaattgttacagttagccttgttccaggaggctgctgggctcctagcccccaggtgaaggtaagggcatggctttgaaaaccaaacgaagtgaggccattaactcctgcaggagctgggtgctcccgcccccagccagcctccctgcaggcagcagcagcggggctggcggaggatcacacccaacccagccttctttatgcagcggctggagtcccttagcaggaataaaaaagtcagatgcaagagactttcatactctgaaatgattttttttttctaggtgttcgctctgtgggtggggctcagagtggcggggcaggtgagaggtggggcttggttgtctttcacttgtaattaccctgctcccgttctctcatccctgtgccttatcaatgggattaaagcttcttcacaaggattccaggtctatttctagagcagattgatcacttcccctaccgatgagcaattggttggagtgtggggaccgtgtcttcaacttggttaaggcttttgtgtctgtttccccttgatcttgctattcagcactggaaaggtgttgaagtgtgagagtgtagggttattcctggtttttggggttgactgggagctacattttgaagccccaggggagcactgagtaagtctgccggcatagacgtttctccgtctccacaccttgcttctccctaacgtacccaccttacattcttagtgtggggtgaaggtgggggatgggggacactcacctggagagacacatgggccctgcaggtcctggaactccccagagccttctcttgtgttcggcatctaccgcagcgggggctgctggccagtaaacactagcagtaaagcttgggagaaggcaatgaaggaagtcagcatctctagatcaatttatggtgcatgcaaagcgtgttttcaaatacttacagagtctccgagggaattacatcactgtttataactgttttgattgttttttatgactcagggcccagtagagccaagcagtgtaactcctgagaggctctgagcagaacgcctcatgcctcccgggaggagagtccaggcataatgggaaaagcgctccccgtaataagccaagcaccggtcgtgtggtggggagttattaatgtgctgctgggcggcggtgggtctgcactgaagaatgccatgtttcttcagctgcagatcactggggtgggtcgggggctgagttcaaagaggcatgaaccctaatggcctggaattggcaggatggtccagcctggacacagaaacagccttggggtacagattttggatctgcttggtctggggagtctgcttggtctggggagtgtgtcagaaaattctagcaggaaggagtcttgaatgattgaggctttgtttttaccctcagactccatcccatatggtaaagctgccctgagtttgtaaagggaaccatcgtccatttccatgacagggcaggaaagtgaggggaccctgctttctgcaggagatttgggagcacacaagcttggcaccctcgatcagcatgagagggcagcctccgaactccgagctgtgtccttgactgtgggtccacgcgagcttccattcgaggcagcgaggcctggaggcggaggcagtgaggcctggaggcggaggcgtgggctctggggccccaaatcccagctcctccccgcattagctacaccttgggtacagtccttaatttccctctggattaaatgggttaatccttggaaattctcaggccagtgccttatgctcagtgcacagtcagcttgggaaatgtttgctgattgctgttatttagcattgtgacttctattttcaatgctagtcttcggaacaaagtagtgggattttttatttgtttgtttgttaaaacatttaattatttttatatatttagggggtccaaggacaggtttcttacatgcacatattgcagtgtggtgaggtctggccttttagtgtacctgtcaccatggaggtcatactagggcaactgagaaacgagctggccaaatgccaccgaggagaagccgccttctggtcaccaaagggagcccatccctggggacattcacccaagtctgcccaagaacccatcttttattttattttatttttgagttggagccttgctctgtctcccaggctggagtgcagtggtgcgacctcggctcgctgcaacctccacctcctgggttcaagagattctcctgcctcaggctcccgagtagctgggattacagacacccgccaccatgcccagctaatttttgtatttttagtagacagggtttcaccgtattggccaggctggtctcaaactcctgaccttgtgatctgccctccccctccccccactttgtataagacaaaataattgactcagcagcaatgcaaggcagacagggccatcgtccagaggaatggggcctgtgctgtgcaccccacagcactgcccagcagcctggtctctccactgtaggcaagttggagcggtggcagcaggcggtgcctcggcctcccaaagagctgggatcagaggcgtgagccacagtgcccagccgaaccgtctttcaaatctctgtaagcaaattccagaggcataaacgtcttcaggacaggtgataaagttcacagtggagcatccacgtgaggcagtcagaggctgctgcggctccccggggcccgcagggccctgaggctgcagtggggatagagtggacgggcgctggagctcctggctgtgtgggtgagacttcatgcttccggtgccaagtgctgagccctcccttctcccccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggtaaggcgaggcaggcgtggggatgggggctgggctcactgagattgaccctgcacaagagcttctgtccagtcttgggcccacagtgtctctgcaaggccctctggcgttggggactcccactggttctgctggcagcttcctttctcttggagacccttgcatgtaggccccaaaaaccttaaaagttgctccctgaaaccttgccttccaaaaggtcctggaaaactttccttttcagagagaagtgacaaaagagttgttgtttcgttttttgttgtttagcggagggatttgtggaattctggctatgccttctttgcttagaagtgcattaaaggtcatttaatcctattcagttggcttttgaatcgagcatgtgtaccacagggagcactgtttgtccccccaccagctctcccacccagtcgtgggctgccctgcagaacctgcaccagcaggggcctgtcccgggaatacagacaggctcgggtggtatgtggggaaggtgctcccaggctgctctctgccaacttctcttgcgctcaggggctgggaattaattccaaagcttcgcacatggtttttgggaggctatggagtcatttctttaacaaacttagaaacaaggggaaatacattgatgcaaatatatgacttacaggtaattagaatgaaggtgtttatgggaacttaagaggggccagggtattctggtaccttctgtctctttctagctaagaggtagagagagtaaagagatttcatggacaaatcagcatttccagcttctctcaaaaaccaggactggcactgtgcccacatcatctgcaggaagccccccaggaccaggcctgctctgtcttctggggtgtggtccccttgcccactctgggcccacttgactcctttggtgacctgcctgaggctgtggcccttgtgtaggctatagggagctgcagagattcagaaacaggggctagcgaaggctctcagatggaaccaggcagaagttgggggttgccctttgcttaacccttcccctccccaccactttgtatgagacagggtaattgactcagcagcaatgcaaggtagacagggccattgtccagaggattggggcctgtgctgtgccccccacagcactgcccagcagcctggtctctctgcagcaggcaagctggagcggtggcagcaggtggcgggcccggcaccagctttgtcctcggtgcactggaatcaaccctgaggcagaccctggcaccaagctcagcccatcccacattctcctttcatagcacgagtgtcacaggggcacctctccctcctgccgggaggcccggccgtgctgtgcctctgcctgtgggaggtctcacacgggcacgagcagttcggtgtcagcggacgagctgcagcttttgatgctatgttgctccccgtggtgttttttattttatttttttaaccttaaagattttaaaagtcctcatttctggcatttcttggaaagttggaagctgtctgacaccagccccgtgttcctgcgtgcactgggccggagctgagcaggtgggcgagtgtgtgtccatgtgctccatgttttccgtgctggcagccctgaggccagcaacgggctctccgttcactccagccgcacacctagtggcacccaggtttgtgacccctgactcagagccagagctgggtgcaggcccaggtgatggcccaggttgacggagagcctgtggtgaggctgagaggctggggcagcaggtagcaggcaggcgggtggcagtgaccctggagagtcggcccacaccctgctcttccactcctggctgggctcccaggagccagtccctttgcctctctttattcctcatctctgaaaatgccacttcacttatctgtaaacattaggactgttataagacttgagtgtgataatatatgtatccctggcacaggggcctggttgccctacgtgtcctgcttacgtccggctacctgacccacaagaaccttccgctgccccagcctcccctctcccgctcccctggggccctgtttcccttccctggaaactttcctcctcctgctgctgcccagtgttgtgcccttgggataatagagggcaggtcctgccaggcctattgggagccaccccttggctgggtagtgctgtccttgcgccatcaggcattttaaaaactaccctagcccaggaagggtggctcacacctgtagtcccagcactttgaggggccaaggtgggtggatcacctgaggtcaggagttcgagaccaacctggccaactcttgtctctactaaaaatacaaaaattagctgggcgtggtggcacgcacctgtgatcccagctacttgggaggctgaggcaagagaatcacttgaacccaggaggcggaggttgcagtgagctgaggtcacgcctctgcactccagcctgggtgacagaaagagagtctgtctcaaaaacaaaaaacaaacaaaaaaaaactaccctgaggctactccagctgtcatctgagtcttgggactttggtttttttccaaggcagattttgtgattgtatcaagaatttgtgttttaggatcagtgacctcctatcctactgcacatcttacttaatttagcagctttatcagtttgccaggttcttcactaagaagccattgatgtgcctcagcacctcagcccttaaaagacagtttgtccttgttctgtccccagtgtgttgggttcagcttggcatcgagtgtgaaaatcagccttgacctttgccatttcttagaagaaagcacaggatgcttccccctcactcttctccattgcaaagaatgttccctagataaacattttcctacattgagtgttcagagaacccccagattggaaattgaatcttacatcattcaaaacttatgtatttcaatttctgatgaacaataaagatgcctatgttaaaaaaaatgtttattccaaaatcgagatagaaaattagactgtgaagaaagaataagaggaaaaaacctggaattgattccagtacagaaagagtcacttctgaggatggcactgggtgcaggaagagattggatgttgattagttgcttcctgtttctgcctgaaccaagtgtgaggcagaaggcccaggggctcaagggtacagttgggaaagaccttcgagttgggaagggtaaagggaggctcatcaggacttgcaaggagggtactgctgggggtgggggagctgtctcctccccccgctctccacgggcccctcccattcccactgaaaagcaaccaaccctgccattgtcatctccctcaaatgcccctgttgagactggatcagccctgcaggtgaagggacagaactttccccacaagcttgagtagctgctcctctttccttatttgtgtctcccagagaacagtgcacacagctggcttgaaatcaaacatggaagtttcattcttgcacaaacaagcactttcaaaaggcgtccttagtgagcactctctgggcttcggtgaaggtaccccagggggacccccgcccctgtctgctttcgtgcatccgggcactggagttatggtctctgtaagattgttgctgggtgggaaggagccagccaccttctgcaggaaattgtcgggactgggggcttctgttggtgagagcttgtaaacatctttcactgggttatatgaaacctgcctgcctgcctgccttcctctcagaatgttaaggaggttcaaggaggtgatggaggagagagtctgtgtaagagcttaaagacgatcacatttcactgtgccctttgccctcgggttggctggggccagacccccgctaccctgggggtacggtccagccaggtcatacagtcccccgagagccctgcttgtgccagcccctccgcccagccactcagtaccagcaccttcatttctgacaccacacctccaattgcaggttgctggatctttccaatgaagggtttacaaactgggaattcatgactgtccactgctggggagaaaaggctgaagggcagtggaccttggaaatccaagatctgccatcccaggtccgcaacccggagaagcaaggtcagtggctcttgggaatctcatgacagcttttgtatctcaagcctctttttacctctgggccttatttaactacggagtctctgataattctttgttttgtgttttagaggtagaattcccataacagaaaattcaccattttaattatttttaagtggacagttcagtggcttttagtacatccacgatgtcatgtaaacgtcagcactatctaattccagaatgttttcatccccacaaaaagaaaccccatacccatgaagcagccactccccattccctcctcccctcccagctcctggcaacctctaatccacttaccatttctttggatttgcctctcctggacatttcatatagatgaaataatacaacacctggccttttgtgtctggcttctttcacttagcatgatgttttcaaagtttttcaatattgtcgtatgcatcaaaacgtcattactcgtatggctaaacgatattccattgtacggattgatcacattttgtttattcattcacctgtgatggacatttgggttgtttctaccttttagctgttacaaatagtacagctatgaggattcatgtacaagtttttatgtggacctatgtttttgtttctcgtgggcgtatacctaagattggaattgtcaggtcatatggtaactctatgttgaacgttttgaggaacagccaaactgtcttccacattggctgcacccttttacattccggccagcaatatatgagaggtccagctccttcacattctcgttaacacttaatattctctgctttttaaaaaattataagcgttctagtaggtgtgaagtggtatctgtggttcttcaattgcctgatggtgcaccttgatgcacaaaagttttaaattatgatgaaattcaatttattttttcttctgttgcttgtgctcttggtgtcatacctgagaaaccattgcctaacccaaagtcacagagatttactcctgtgtttccttttaagagtgttatagctcttacatgtaggactttgatccattttgaattatttttgtatatggtgtgaagtaggggtccaaactcattcttttgtacccatttgttccagcaccacttgctgaaaaatgcattctttacccattaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaacttggtggttctttctcaagattgttttggctattttgggtcccgtgtaattccatgtgaatttgaagataagcttgtacatttcttttttaaaaggtagttggaattctggtagagattggatatgtagatcattttggggaatatttccacattaacaatattaagtcttccagtccataaacttgggatagttttctgtttatttagctcttctttaattttgtttagcagtgttttttgtagtgttgagtatataagtctttcgcctccttggtgaaagttgttcctaagtattttattatttttatgctattgcaaatggaatggttttcttaatttttcttttggattgtttatttctctggtaattcttgtacctttttaatcccttttacttaatgatcaatcatttatttaactagtctttattaagtaccaaactctgatctaggtaatggggttacaaccaggaaagaaaactggaataatcagcacatcttattttgtagttacccacaaaggtctataaacgcctgtctttgttctctgggtcgaatgcatagtaacgtttacagaatgtgctgggatcttgcttttctatgggcgagtttcctcaaggtttgctttcactgttccgtcgttccctgtgcccttttctgtgaagatgcagtctgcttcttggtcaccctgggagtgcgtgagaaccttcccctgccctggttcttttccagttctccataaacaatccaaaagcaaaattaaaaaaaccattccatttggaatagcacagttttaggagaaaagaagagtgttgacttgccttacgtggaaaattgactttaagtcatcaagtcatctacagggatctgggacctcccccagttgtattctttctggttttaaaatagtaaataactattttaagaaagcgttggctgggcgcggtggctcatgcctgtaatcccagcactttgggaggccgaggcgggtggatcacgaagtcaggagatcgagaccatcctggctaacacggtgaaaccccatctctactaaaaatccaaaaaaaaaaaaaaattagccaggcaaggtggcaggcacctgtagtcccagctcttagggaggctgaggcaggagaatggcttgaacccgggaggcggagcttacagtgagccgagatcgcaccactgcactccagcctgggtgacagagcgagactccgtctcaaaaaaaaaaaaagtgttataacaaatcctaaaagtacaaaaatgtaaaattttaaatgacctgaaatttacacattttaatagtggaagctcctaaattctttcttttaaaagccccaaagtgtattggccgagtattaaaagtcaaggtttactcctcatgccagctgcatcctcaagcattcactgcttcgtgggcacaaggcagagttctcatgccagcctgcatggcctgcttgcctgggaggctggtgctgtatgcaggagagcacatggaggctggggctactgctcttgtgtcctcatggcatagccctggaaaccgggcacaccattcaacactctagacctgtgatctttactctgtatcatgagccgaatacaacgagccctacccatgtcccagggcagctttgaggggacagtcaatcccccatggaactgtgcctctgcaggcagcctttctcatgcatctcacgcattcttctctttccccttcctattaggccaacatgcgtgcactgatgcctctcccctgagtccacatcccctccagccaccacccacttctctgctcccctttatggcaaagccggcagaacaagctgcctgccatggccatcactggctcactcccagcccactcccatccactgcacaaaataccggggctcgtcagggtcccccaccgtttccacattgcccaagcctatggtcccatctctgtcctccccaggttgttaaagccagggtctatggttctaacaaactaagcaccctctctggggaccacagggtgcagtggttaagactgggggctcaggagcccttctacctgggggtagatgctggctctaactcttacaaatacctgtgaccttggcaagtcacttagcttttctaggccttggtcttcttatctagaaaatggggatagtacgcaagttactgggttgcggtgggatgaaatcaggtaagacaggctggataccgagagcagggcccggcacacagcgacgttggcagctcaccccctctagaagtgccctcttgcacagctgcagtgatgccacacctgggggccctctccacctcacaggctgccccttgtgcatctcgttggctgatcctctcgcacatacccctgcacgcactcctgggtcctctgctctttgttcccatccagggatctcatccagccccgtgacactgagcaccttgtacctgctggtggtgcccaaagctgcctctccctgccctcttgcacccagacctgctctgcagcagcctcctgcttctgggcatgggtctaactggctctgagcttgtgcaccttagacaaactcccaaactgcctctttcttgctttccacattaatgtaaatagctttgggctgggcatggtggctcatgcctgtaattccagcactttgggaggccgaggcgggtgaatcacaaggtcaggagatcgagaccatcctggccaacatggtgaaaccccatctctactaacaatacaaaaagttaaccaggcatggtggcgggcgcctgtagtcccagctacttgggaggctgagggaagagaatggtgtgaacctgggaggtggagcttgcagtgagctgagattgcgccactgcactccagcctggatgatagagcaagactccaactcaaaaaaaaaaaaaaaaaaaagcttcaccttgcactccattgcttggccaaatcccaggagtgaacctttaattcttctttgtctccttcaccatctgcttccagaatatatctcagtctgcccactgcctcagttcagtcccctatagtgtcttacctcctcattccactggcccccctgcctcaacccctactggctagagccactctccacccagcatccaatgatccttttaaaatataattcagaaaatgatgcacccctgctaactttaatgacctcccacagctcttagagcaaaacccaaatctcttagcctgacctgcacatcctgctagcacctctccaccgtgaatcatttcctgcgcctcatcattgacctccgttctgttcccctaacatgcctggtcttacctccatggggccttggcacgtgctgctccctccttggggacagctgtccctagggcttcccatggctgcagctcagacctggcctcatggaggggtcttatctgaatgcctgtggtggatgtcctacccactctcccaccttacactcctacagaaacataaaggcaggggatgagaatggggaggaataaaaatttgctgagattctgattccacatttagtgggaggggtgatggattatgtcttactcttagcactgatagagacatataaactcaaatatcttcctataatagagagataatcaagatttaaaacaggatgccaaccttccagatcactagagggaaataagagtgaagagaaattgatcaatatgccaaaaaaaaaaaaaaaagagagagaaagaactataggcaaatttgaatagggatacggaagtcttaaataaaacattaggaagtggaattcatcagtttattcaaagaatactcccctccaagaacacagccttcactcaacagatacttattgagcatttaccaagttctaagcactggggatgcactggtgaacaaaacagatgctaagcttacattctggaaggcagaggaggccgtgaaacaagattaccaggcaggaagctgttgtccattagatgatgagaagctctaaggagaaaaatgaagcagggcagggtgacaagggcatttcagggtgtaccgggaaggcctcagggaagggacatttgagtaaagctcaaagaagatgagggggtgagctctgcagacatctgggaaaagggcattccaagcaaagcgttcaggggatgctgaggcccccgggcaggagtgtgcctggtgtgttccaggggatgctaaggcccccgggcaggagtgtgcctggtgtgttccaggggatgctaaggcccctgggcaggagtgtgcctggtgtgttccaggggatgctaaggcccccgggcaggagtgtgcctggtgtgttccaggggatgctaaggcccccgggcaggagtgtgtctggtgtgttccaggggatgctaaggcccccgggcaggagtgtgtctggtgtgttccaggcacagcagagaggcccccgaggctgcagggggcagtgggaagaggagcagaataggacaggaccaggcattgagagcatagggaccagatcgcactgggctttgtcagccctcacagggacttggttggaagtcactgagagattttaggcagaggacagaggtgatctgaacttctgtgttaataggctgacagctggtcagaatagacggaagtgagggtgggagaggaacaaaggcggggaagccagttagaaggtcattgcaatatcaggtgaaggtgactccgacggggcagcatcagtggagtgtatgaagcagtcagattctgaaagcagggtcgagagatgtgtagatggatcagatgtgggctgtgagaggagagagggggcatggatgacttcagagtttttgtcctgcacagtagaagaatggagtcctagtttcctagatctggaacattgcagggggggaagatgctggagagaagatcaggagcttggatttgggtgggttaaatcaaagatacttacacaagtccaggcagagatatgtacctggaggtgagagggaagactgagctagaaatccaaattcggattaggtatattaagtatcgtcagcctttcaagctgtatgagcaatggaaggagatctgtttatataacagtgattcacacgtttggagcctgttgcgtgtgggtgctgagcgagctttaggcttgcagtggtgcacagcacggaaccgcgtgccctgcacacctgtgcacctgccacactgcttcctgcccagccagatgctgccatatcagctccctgcttgctgcctgcatggcactcagcagctctggccttggccttagcactgatgggcttgccatctgcagccttccttccttccggtcctgctgtgccctgagagcctcctgctgcatggtgtatgataggtgcacaataggtgttggcggattaattagtccagttggaaccctctgtaaccaccacatgaccagatgctctgtgtgctacagaggacacaggattagtggatacaagaaatacttcctgagggtagccccaaatgaagtcttgacacaggtcgatctccacccctcagcgtgggtagaaactggatctttgctttcagaaggttgagacgggtgcagaataaacaccttgtggtaccttccagctctgaccttctagggcctactggaatttggggggcggggacacattctccagtgtcatcacagagagtatgcacattcctgcaagggcgtctggagtcagttcattccatgcaagctttaccctgtagacagctgccactcctgaatgtggtccagaaacagcaagtacaggcatgcgtcctgccacagctgacgcacggcaagccctccctgctgtgtgtggggaggacgggcgccttcctgtcacccacaggctctgtgcatcctccccaagcacagtgagagctagcctgggagcctgggtcccaccagcatctctccacagtggaaatccatgtggccctcacatgggacactgcagttgcaactgagtctccccaacctgccctgctcacttcattccagggccagcctctgagcttgttgttcagcatggcggctggatcctcccagggtgagggaagggagtgatggagtgaagccaaaaggggtcagaggggctcaaacaaaggccaagcggccctttccaggttggcgtatgggcccagtgcttttgaggttgatccaggataagccctcttcagcctccagatgaatggtacctcttccggctgttcctgaaatgtcaaaatgggaggtctgcgtatcctaacagacatgtctccgatgcattttgcagaggtcctgccatgtgccagatgctatgccagtgctcgggcacagagaggctccaagacacagttcctgcccctgaggagcccacaggctagttgggaacatttcggatttcaggaaccaatagtaccatgcacaagggcccaagggccaccagtgacccagaggagtgccccaagttcagtggagcaaacagggatttccggctgaaagaaacaaggaagggcttgtgaggaagggtctgcctaaggccagattctcaggagttccccagtgtcactttgtttttttttatcttagtagcatagaaaatacaggccattaggagatggcgactgccccaagggtacggctgtccttttgtagaatgaagtgccaggcattgcccacatatgacctgccttactccgcctacccccaggggtgagacttctcagggctggccttgctccccaggccctgggagggaccacagaggggctcagcagtgacgagccaggcttccccacccgatccactgggcaagcgacggggatgtcaggccgagacagtcctcagcgatgacctgccctaactcccctccttccaggggcaggtctgggcccttccatgagtgcagagcagaggtgggagcttcctggccaggccgacataaggaaagggcctgctgcctctgggaggatgctctggtgcccacagaaggcgtcagtgtggatgggggcctgcagtggacgggcattgaggtgtggaggagagtctgagaagatctctatcaaccaccagagagccaggaagcaccccctaggaggaagggtgaaaatccgtgtctacccagagctcaccaaggcactggttatgctgtgcccaaagacccgggacccaacgtaggcattgttcgcaataagacctacccccagagcatgcctgtgaggccacgccaggtgggcaggacggccgctggccgaggcttctcatcagtgcatgggtggagagggaagcccagcctgcctgcacgctatgacgctattgtgtacacagggaggcaggaccagccccagcactgaatgttcaggtcaagctgatagtgcctgttggggacctcagcctgggaaggtgacagagaagacctaggttgccctctagctccaggattcagagctctagaggccgggaaaatgcagggctggtcagccaggaaaatgcaggtctggtcagcatcgtcagcatcgagtcagctgcctgtcagcctcgtcgatgccgaggtatgaactgatctcaaatgggcaggatcttccactccctggttgtctggtgagggtggcctgtgagtgcacagtcaccaccagcctcagtgccaggcacagtgcagcacacacacacgcgtagaccagaaaagcaggcagtcctcacttctctacaggcattccaagaacctgtgcttggggcagggtgcttcgtttctgtggtgttcatttcaatctcctgcaaatctctgcaagttaattgctttaaaagaaaatgaaaagaaaaaaactgctccaatggtgttctgtgtaaaagtgctttaaaatctatgctaagacccaggatttatgaagtaattaagtgatctgactgatgcgctagctccaataatacctcctgtcagattgaacgtggcttaggtaattagttttaaagccatttttaaaggttgagtagcacatcagtcatccattttcctcttcagttcccaggccaaggatctgggtcctcccaggatcactctcttccaggaggcaatttaggaatggaatcgagtgtgaatcctgctttgcagtcttgcagcatttgcagatactaacagctcttcatttattcctgcacacctatattatttatttatttatttatttatttatttatttatttattttgagacagtctcgctctgttgcccaggctggagtgcaacggcgcaatctcggctcactgcaacctctgcctcccaggtttaagcgattcttctgcctcagcctcccaagtagctgggattacaggcatctgccaccacatctggctaatttttttttttttttttttttttttgtagttttagtagagacagggttttgccatgttggccgggctggtcttgaactcctgacctcaggtgatctgcccacctcggcctccgaaagtgctgcaattacagggtgagccactgcacccagcccagcacacctttattgaactctacttagctccagatttgggaacactaggaccttgcccctgcagtgcacagtgtgggtgtggaagagggggcagcttccaccgtgggtgagcttgctactccagccgttacgcacagagcctgcaaggctacgaacggagctggcaacggtgcaggcagagctggggcgatggctcgtcctgcagaacatctgtcggagaagtttggctgcatttaagagagttgccatccaaaatgcccgagattttaagtttggacccagaatgcagaaagtgtctattctctgagaaacatgtatgcttcattctcccacgtcagacatcagacaggcctggggttggatcctcctgcctccgcttttcctgtctctctggcctctgcgctgggtctcctctcctgtaagatagggctgtgcagaagtgagacccagaccaagtcactgaagagaggagccttcccagcccgcccttcttgcctcggagcctacgttggtggttgcacctgaacgacaaggcagagcctgtgcacctgccaaggtcaggccagcctccccacccagggccacatcccgctcggcaccctcaggtgcaggaaggtccctgcacctcctcatgacctggggcccccatgggcacgccggatgcatgcaaagtgctctgcaggaatcgagcttggctttgtcagcactaaggggcatctgcatggtgttctcctgttcatgcagcacacacttaccttgtctgcacacctgccccatgccgggtctgctgggtaggcatgggtgtgaggggtgtttccttgttcttcacttcttccaccccaagagcccagctgagtgtgccctgcaggcagtttgaccagggctatgtacagggcccaaactttactgagttggcctagccctccctttgtaaccaggagcctacctaaggtgctggggcacctcccacagtcttcccctgccagggagaattgtgagacatcaatgtctaaatagaaaaaataatcaggcatgctttccaatcttctctctataattgacaccatgtatcttatttcatggttccaaagggttttacgtacttggtattcacatagtaataaatagactgtctgagacaattgatggcactttaaaaaatcctgtgtcactcttgaactctgagaattcactttctccctgattaaaatttcttttttctctgatctttcatctgtttccaaaagagcagcaacccacatgtgctgtgtttttccagattatttcaacagcattatttccagattcccaccaatctaggaaagaagtccaatttatcaaaagaacgagagaggaataggatgatgattagcacctacgtgttctccagcaggcactgggtgctattttatctcgctgttacaaatcagtatagaatcagggtagatgataataaggaattaaagtttcaggaaaagttattcttgctagtgatgcatatcatggtatttacaaatgaagacatgaccacgatgcctatgatttgtgctttaaactattccagagggtgggggtgaggagtgggagagtaggaagagggtgggcgaaaccagattgagaaaaggttggggattcttgggactgtgtgatggggcacggggactcattgtactgttttctccattttatgtttatttgagaatttccattacgtgaagagtttttaaaagcacatgtatgggaaacatttcttccgaagaggtcagaatgcaagactgtctgagagatttacatggcacaagtaaatttaacgatgtaaagatttcattgctttacagcaaatacacttcagttcttcacttgtgaggagtaaatgctcaatgtgccgtgggacacgtagagacagggattttacactttgtttaaagtgtaaaaagacacgtagtttcttttacgtttgactgaaggtgctctagacagttactggacgtgtgtatgggagtgtgtgcttgggtgtatatatgtgtgcatgtgtgagggagagtattgtgtataagtatgtatgtgtgtatgtgggcttgtatgtatctgtgtgtccatgtgcatgtctatgtggatatgtatgtgtgtatatgtgggcattaggtatatgtgtatacttgtacatgtatctgtgtgtgtgtgcatgtggatatgtgggtgtgtgtatgtgtgtggtgcatattggcttatgcttccttttcaagacccagtgtaacacaaggctgagctctagagcggcctgcttctcagatccatcttccaccactggtcattgcggacctcggcaggccatttccatgctccgagcctccaacctgtcctctgcccagggatggtgggaggattaaacgaaacagtgcccgagaagtgctgagccttaccagcatgaacatgattctcttattgtgagtgtttagattctccttttgtggaagagggagctgagtccaagctcctccacccagagcctgactgagctcacctgcctggaaggggcagagcctggcgtcagggccgtcttccaagctcagggccaccctcacctcaacccaacctggtgaggtctccaagcctctccaaggcagtacaggcagcccatagttgatctgatctctttagccctgtggccagtggttttcatgtgtctggcttcaggatatttctggttggatttttttgtttaaagtgttgtaattagaagataaaaattaaatgaaatattaaaagctgggagcctctgctgggtgccagccagggtcggggtgttgaggaatgttgctgctgagaggctgcctcacttggctgaaatccaagagagcagcaggccttctgagaacttgctttgaccagtccacaagagcaggggtccccatcccacctaccggtccatggtccatggactgttagggactagactacacagcaggaggtgagcggccagcaaacacttcatgtgtgtttacagctgctccctgtcactcccacttctgcctgaactctacctcctgtcacatcggcaaaggcactagattctcataggagtgcgaaccccattgtgaactgcacgtgccagggatctaggttgcacgctccttatgagaatctaatgcctgatgatctgtcactgtctcccatcacccccagacgggaccgtctagtcgcagggaaagaagctcagggctcccactgattctacattatgatgagttgtatagttatttccttatgttttacaatgtaataatgatagaaataaagtacacaatgattgtcatgtgcttgaatcaccccgaaaccatccccactgctccccaccggatccccagctgtggaagaattgtcttccaataaactgattccttgtgccaaaaaggttgggaaccactgcagtagaacatttgaaatgcaataggtacttggaatagatgcttggttttaagggtttttcctatagactatgttcctgaatgggaggattcagtatcactgagatatctcttcttcacaaagaagggttagccgtcactttaacacagtcctcatcaacatcgcaacaaaattaaaggaatgcaaggaaaacctattctgaaagaatgggcacagataatagctagagaaattctgaaaaaatgaatgcaggtgtttaactgtgttttttaactataataaaatgatctggcactggtgctggaatagaccgatcaagggaacagtacggatagtccgttaataaagccacagagatatgctaaggatagcgttttaaactggtgggaaaagactgaagtgttgaataagagttattgataattggccaaccatttggaaagaaaataattatcttgatgcatacacataaaattagaaatttctgtctggcagaaaacatcataaaattagaaaaatattcctgtaatctcagcactttgggaggccaaggcaggtggatcacgaggtcaggagatccaagaccatcctggctaacacggtgaaaccccgtctctactaaaaatacaaaaaattagccgggcgcagtggcggccacctgtagtcccagctactcaggaggctgaggcaggagaatggcatgaacccgggaggcagagcttgcagtgagctgagattgcaccactgcactccagcctgggcgacagagtgagaccccgtctgtaaaaaaaaaaaaaaaaaaaaaaaaaaattagaaaaatatttataaaatattttggacaaactcaagtgattcacagatggccttttcacttctgtctagcccatgggttggaaaactttttctgtaaagggtcagatagtaaatgtttgaggttttctggtctctgagacaactactcaactctcccattatagtgtaaaacagccatggaaattatgtaaatgagaggccgtgctgtgttctgacctcactttataaaataggcggtaggtcctggccttagtttgctgtccccactctgccctgtttacatgttcagttgaattgagtcttctgtttcatggtagttaagagggctgtttatttggctgttatatgaggcatcccatcctgtccccattttcccaccacccatgaagttatattgtcctgcttgctggtaaatatttaacaactagtgctctgggggaaattatttatagatattgacatatcacataagttcattataaattttactgatataaaggatgttagccaacaatttacaaataataaaatatacattgcttgtattataaattccatttagccagttgattctcagagactgctttcattgatttttgccgaattctggttccataaccagccgatggctgccatgcatgaacagttgtctttccagcgtaaatattgggtaatatttttgccacagaaacaacaaagacatatgtcagaacttcattcactcaccagggatgggaacaacttccttgctaaattggaaaataattttcaaatactgaaagaatatctcttcagttttgtaagctgttcacagtgtaatacctacagacacgaaacatttttaagttatacctgcagtattaatgctttctccatcactttcttaagcccagaaaatcaacagtaaacccagcccttgtttgtagcatttgtcgatttccatatgggaatatcccgccatggccaatttcaagctgctcacgtgacgtcactgaagacgggttggtaaaagaggggtccagtagccaccatgagatagtgcttcccctgtgtagatagaacagatgtgagtaaccctgaagcacagataatgacaaaatatagtgagatcatgaggaaggggcaatttgtgaatattcattacctttgtttttagtataatttattcaattgtaagcttctataatttaatgtttaataaagactgtgtttaacaaccagctcacaaaggttctgaaaatgttcacaatcagttccgttaagccagtgctggtcggctgcagcgcaccactgcatattgggaattgaacgggtagagggttgtctttctcttgggacaagcacactttaaggggagcgtattcattgcaggaccaaggctcaacgtgcactgctccccacccgtcccagctcctctttatgcttgcgggggccagccactctccagtcctccccaggaatatacgtcgcaaccaggcattcttttttcattggcctcattcttcccagggccggctcagaggccccccggtctaattgccattggtttaactgctgtttaataaatcaaactatttttctgactaaatcttgctaatcagtaaatagtgatcatctgaattctccatatgctaaaaagtcatttttccaaggggtaaaattaaagtaatatttggcataaaaaaattctaatacacaggcagacacctttatgtctaatatctcaactgtagaggttagataatcacagagtgctatactgtgttatagccttaaaatgtagagtgcttacagatcactaagaaatatttaaataatatcactaaataggccaaaatcctgaaaagcaattcgtaaagaaaacatacaaataaccagtaaacacaagatagtcaacatttgtagtatccaaataaaatataaactaaaggccaggtgcgttgtctcacgcctataatcccagcactttgagaggccaaggcaggtggatcacgaggtcaggagttggagaccagtctggccaacgtggtgaaaccctatctctataaaaatacaaaaattagccgggcatggtggcgtgcacctgtagtctcagctactcgggaggctgaggcaggagaattgcttgaaccagggaggtggaggttgcagtgagccgagattgtgccactgcactccagcctgggcaacagagactccgtctcagaaaaaataaaaataaaaaaaataaacgaaaacacaagaaggcaaaatcatgatagaaagccaacaagcagcagttgcagagatggtagaacaaatgtgtgaaacgaatctgtatggcactctgcactcggggccacagagtgatgtgatttaaagaacgggaatgcaggggcagaggagcctgggtcccacgctggctgcaccggtgacgggctgggagacctgggactgatgactccctcatcagcgtcttaccagcacctggtggacatgaaatttctcacgcagcctgtgtaggttgtcacagaagcccaggctcctctcccctctccctacctgccactgcaagtgtgtgttttaccacagcctttaggaattggtccatttgctctctgggaaaattccagcctggagaagctggtagagacctgcctccatgcctctgaggaaaatcaaattggctgcgacctctacagaacccaggaatttggaattcactgaatccagggttgctgcgctggaggcaaagctgggctgctattgggttggctggccctaagggaaaactcttctgacttttgaactcagcaggtacatttctattcttcctttcttcttcttaagcaacacttttcccgagaaaaacaaacaaaactttgctaaccaaaagctttgtgttgaaactgccaggaggagatgataagccaagcattgccttggctcctcaggacttttgcaggcccccggggcagagccattcaggaagttcccacagggcttggctttctttggagctcagcccagtgcacctgactctaccctgtgcttctgtggaatcccagctttggttctgtccttcccagaaacctgaaagttgaagccaagacaggatcaaggaaggtctagtcagaactgtggtgcttttgccaaaacttgcagaataagctatcggggcacagatcagttacgaaaaccaaatctgacccgttatccaggcgacttgagtgagaggagcaggagggtggcgggaggagaccaggctgccgcagacactggagcccctgaacgggatttggacctcagggtggtgtttagggagagcccagagcagagcagctggcaggcgtggtctgagttcagctggccgcttcctggcctggtcacggaatctctcagtctctgtttctgcacgtgtgtgatgggaataatagtgtctacttcaacgggcctggggagattcaaatggaggaaggtttcatatgaacaaatcctttatgaggagtttcaaaggtttcaggattacaatctttgtccatagtgcctataacatcagaaacaccaagaagtgtttcttgatattgagcttccttgaagccaattacacatgtcagttacatatcgaattctgtgttctgccttgtgctgtgacggtgtctcacgaaggtgctgctatacctttggaagactccagaaagcccagggaagcaggttcttttcaaacatgatagttcacacttcatacctcgaagcatgtattttgatgacgttttactccgcaaatgtcacactggccccactgcgtgtctccccagactggcccagccctgctgtcgtcaggccttgcctgttgcccagtaaagagatctagccctcacttccttgcctcggctcccccagcctcccccacggtgaagcctgggcgttggaatggctgctgacgttcccaccggggaggagcagcggaggcgtaggggcgggccggtccgacccagcgggaccccgggggggcgggggttgtggcttttccctccacttccaggtgaggcttggtatcaggcctccccagcatctggctgcctggagggggcaggtaacacaacccagaaggaaggtttacccaaggaaagacaggacataaagtgtatgcccttcctgtctgagggcacattggtctcacaaggcctgtttggaagacttcccccagctaagcaaccaccccgtttctttgtggagctgcagccagcttgaaacacagctccttccatttgtcaaccccgagcgcttcctcctgctgccctccactcctgttgccctgggattgcacctcccaataaagcttcagcccatgggcttcacttcagtcccttgttttccagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaagcagttgttgattgactgcatgaatgcatgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattgatgaaaatgaaaatgacagatctgaggaagagggagagctctcttgaaacccctttcccagatttgccctcagttttaggaatgaggtacgcttgggcattcctgttgcctgcatggttcggcattctggcagccaggttcgccccagaatagataagtgtgtttgattttcgaacatttgactttattacttatttccagaaacacttcgtgttcaaactacgtctctacaggcatttctacttggtctttttctcccctgacatttcacagagtcctaactgtgctgcatgtataacttgttctttctttttgttacttgcatagcaagcatgtttctatgtcattaaatatcctttgtaagcagcattttatagatttttataatacttcaccaacagaagcaccataatttatttaagcatctctctattgttggacatgtagattgctttccattttttcctattatgagcggacagcttagtacaaaaagccttctcctgaatttaaaattatttctttgggattattcaccagaagtaaaattactgggataaataagaggtggaaaccacaaatatgcctgcctttgatacatattgccaatttgcttttcgaaatagttgaactgatttgtagtcttaccaggagtgggcagttctggaggaggtagatgatacccttccttaacttacattgtgatcattactaacaaaggtgaaccttttttcaaatgtttgtgcactgtgttttttcttttgaaaattgccctttctggcgtggtggctcacgcttgtaatcccagcactttgggaggccgaggcaggcggatcacctgaggtcaggagtttgagaccagcctggccaacagggtgaaaccccgcctctaccaaaaatacaaaaattagccggtcatggtggtgggtgcctataatcccagctactcaggaggctgaggcaggagaatcacttgaacccgggaggcggaggttgcagtgagccgagattttgccacctcactccagcctggatgacagaacgagactccgtctcaaaaaaaagaaaaaagaaaattcccttttgtctttcgcgagagcgctcagtgttgctatcaagctgataagtatgtagtctgtgtaaaatattggtaaaatattggtgtaataaccctgtgtgtgtcgtaattcatataaattttttttctggcctgctgtttcacttttgactttttaaaaataattttaaatttcccctccagagttttgataattatttccttttttaaaaaagtcccaatttgtttgattttattttcttcataatctgtttgcctttttttcagtctaaatattagtgtctctaaaaaataaataaaagatatataaaactttttctaagttgctaacaaattactccaaaacaaagtcaagatcaaaatgttaaaagatgtcgtggacttttatttccaacaacagagaagacaagtgtcttgaaatctccctcccacagaaaagaattttaaatgttggttgaaatgttcacagccaaagaggtgaacagaatcatggtccggcttttgcttgaaggcatctgcttcatctgtggagcccacctagtagaccacataacactgggacctcaggggcacccaaggaaaggagacacagacaaagctgtgtaactagaacccacaaaacaagtgcttacaaacaagtccaataacttcagtagtttcactaaaggcatacagactcgttgctccccttgagagacaaaaattgtcatattggatttttttaaaaaatgtatttaaaaatgtatttgggaggctgaggtgggcggatcacttgaagtcaggcattcaagagcagcctggcctacatggtgaaacctcgtctctactaaaaatacaaaaattagccgcatgtggtggtgtgtgcctaatagtagtcccagctactcaagaggctgaggcaggaggatcactggaacctagaaggcagaggttggaatgagccagttcatgccagtgccctccagcctgggcgacagtgagactccatctcaaaaaatacaaattaaaaaaaagtattttctgtagtgccaggtatatttcatttacccaccagatccattctccactcctccaccccacagactcccttgcctgtggcttatagttgagttcagccaaggggaaactccagcaggagaggagggagggaggagatatttatttatgagttagtgattctccagtccttcatcagccaaacagaaatgttatggcaaaaagcgttattggagcttcatatgtagctctgtgtatgtatcaatatgtagagggtctatacatattggtaaaaggtttagttcagttctaaaagttccacctctaatcttttatgcaatttataacacagccttaaaatacatatagagcaaaaacttgttaaaactacaaagagaaaatgacaaactcacacaggagggagagatttagcatacctcggatatatttgatagataaaacagcaaaaattcataataatagaagatgcaaatatctcaattgacaatttaggtcaaatggacatattggaacactgtgccaaacaacagaataatacaccaaattttttatttatttatttttttttttgagacagaatcttgttctgtcgcacaggctggagtgcagtgacgcaatctcggctcactgcaacctccgcctcccacatacaagtgattctcctgcctcagcctcctgagtagctgggactacaggtgtgtgcctatattttgtatttttagtagagacagggtttcaccgtgttggccaggctggtctcgaactcctgatccgtgatctgcccgccttggcctcccaaagtgctgggattacaggcatgagccaccgcgcccggccaatacacccacttttcaaacacgaatggaagatttatgaaaattggccacatgtcgagccatttggcaagcttcgatggatttccaaggattggtagcatataaaccctattctctgacattacacttaagttagaaatcaaaatcaaaaagataattagaaagtttccatacatttgaaaattgaaaaatacttctaaataatttatgtgttaaaagaaaaaaacataatttatattagaaaatacttaaaactggatgataataaaaatactacatattcaaataaggaagatacagctaaagctgtagttagacaactttatggctgtaattgcatatatcagaaaagagaaaatcctgaaaattaatgtgctaagcatccaacttaagatgatagaaaaaaactaacaacataaagaatgaagaaagaaggaatttttaaaatagcagaaattaacaaaatagaaaacaaacatatgtagagaaaattaaaatgccataagctggttcttgaaagaaactaataaaattgataaacttgtaagtagaccaaggaaaaagctgaaactatatgatttcaggaatgaaaaacgcatgattatagatcctatatacattaaaattatgtgacaaaggaattctaagtgaaatgaacaaattccaagaaaaaatacaacttaacaaaattgacacgtttacataaaattaaaattgtcctattaaagaaattgattctataatttaaaagaaaactcaaggccagagcaatttaccagcaaattctgccaaacatttaaatggaagaaataatgtcagtgttctgtaaattcttctagatagtagaaaaatagggaaacagtccccactttgttgaatgaagccagagtttggttttttttttttttgagacggagtctcactctgttgcccaggctggagtgcagtggtgcaatctcagcccactgtaacttctgcctcccagattcaaacgattctcctgccttagtctcccaagtagctgggattacaggcatgcgccaccacacccagctaatttgtgtacttttagcagagacagggttttgccatgttggccaggctggtctccaactcccaacctcagatgatccacccgcctcagcctcccaaagtgctgggattacaggcgtgagccaccgtgcccagctgaagccagtgtattcttgataccaaatcccaagagcacatatgagaatggagaattttcagccaatctcactcaagaacataaatacaaaaattctaagcccaatatcaagaaaactaaatccaacagtattaaaaagatgaaatactctgttcctcttttcctgccttgttttagattaatcaaatatttgtcagcattccactttatctcctctattggctttttagctgtactttgagtggtgctctagggattacaatatgcatccttaatttattacactttacttagaattaatattgaacagctttacacttctcagataaaaggatctaataacagtgtaattccatccccctccacttcctcatttgtgctgtaatggtgttgtatattttacttctgtatttgttacaaactccttcttaaaacagtgatattactttttgctttaagcaatcttcttttttttttttttttttttttttttttgagacagggtcttactctgtttcccaggctggagtacagtggcacaatgtcagctcactgcaacctccacctcccaggttcaagcaattctcctgcttcagcctcccaagtagctgggattacaggcatgcaccaccgcgcccggctaatttttgtattttcagtagagacaggttttcgccatgttggccggactggtcttgaactcctgacctcaagtgacccatacaccttggcctcccaaaatgctgggattataagggtgttgtcttttaaataaattaagggaaacagctactcttcagtgtgtttactgacatgtttaccatttctagtgctctttattctttcctgtagatctgaattttcatctgctatcatttcccttagcctgaaacacatcctttaccatttcttatcaaactgggcttctggcaaggactttgctcagctttgttttctttgaaaatgtctttacttcaacccatttttgaatggtattttcactggatatagaattctgggttgggagtatttattccagcactttaaaaataccaaatttttaggccgggcatggggactcatgcctgtaatcccagcactttgggaggccaaggtggccagatcacctgaggtgaggagttcaagaccagtgtggccaacatggtaaaacctcatctctactaaaaatacaaaaattagccaggcgtggtggcaggcgcctgtaatcccaactactaatcctaactacttgggaggctgaggcaggaggatcacttgaatccaggaggcagaggttgcagtgagccgagattgcaccactgcactccagcctggataacagagcaagactttgtcaagaaaaaaaaaaaaaaaaaccccacacttttggccaggcgcggtgcggctcacacctgtaatcctagcactttgggaggctgagacaggtggatcacctgaggttcggagttcaagaccagcctggccaacatggtgaaaccctgtctctactaaaaatacaaaatttagctgggtgtggtggtggcatctgtaatcccagctactcgggaggctgaggcaggagaatcgcttgatcctgggaggcggaggttgcagtgagctgagattgcaccactacactccagcctgggtgactctgtctcaaaaaaaaaaaaaaaaaatttgggagaagcacataaatgccttaaaattaaaaatataagtcaaaaattcaaaattcaatagatatgttagaagataaacttgaggaaatctcccagaaaatgaaagggtggtgggggaaagacaataaatattggacccagtaagaaattttgttagaacattgggaggtgggggcgggagagggatcatgtgagtatgtggaagatagtgtaagagaactgaattctcagcttcctaggtgagacatcactggacaatgtctaacatcaagaaaccaggacatagcatatgagtatttttgtctagcaatgtaagggcaaatgccagaaaaataactcaaagtgttaaaaagaggtggggagtcagggggactccaagaggtagaatggagtgaaggaggactgctttctttgttataaaccttgtaagagtttttgactttccagacatttaatttattactttggaaaagctggagcatcttaaaagatagaatgaccttatagatgccattaagaaaagtgctgtgttgtccattgtacacacaggtgatcattctttcccgaaaggatatttgtttaggattcttcgatccttttcctggcatttaaaataccatctttcagggtttttgtggctataggagcacagggaagccttgtatctcccctttcttagcctgggtctgagagttcatgtgtgtatgtgtgtgtgctcaggtaagtacgtgagtgtgggtgtgcatgttatgggtgccttgtgcacacatgtccatgtgcatccatggacgtgtgtgtacatggggagcacacatatatgtactctttttcttatcctcctttccaagccattcctaaattcctttttacctttctcttacttgccataatgtgaacttaaagtgtattttaataatgtgtttattgagtaaaggttgatatttctgtttgtgtgtgtatacatatacatacaatatacacaaaaaattactgtgtgtatgtgtaattttatatatatatatatatatatattgagaaagggtcttgctctgtcacccaggctggaatgtagtgtgcaatcacggctcactgcagcctccaactcttgggctctagcaatcctcccaactcagcctcctgaatggataggactacaaggacacaccaccacgcctggctaatttttctattttattttttgtagaaacggagtctcactatgttgccaggctggtctcgaactcctggcctcaagagatcctcccacatcagcctcccaaagctctgcgatcacaagcgtgagctactgtgcctggcccctacacggtatttttaataatagctttattgagatataattcacatactgtgaaattcaccccttttaaggagtaaattataggagtattcagtatgtgaattataggggtgtttttgtatatttttataaatggatggaagtaagcttttttattccttccgcccaaacctctgcattaacctttgtaacttgaacatagccatgggtggctggttcaccaaatctcagaaggaagaaacttccactggtgttttaaactgaaacatatttacgtgatttttctagggctctcttacttcactgtgtttcaattaaggaatttcttcctgcatattttaagtatggggacatagggggagaattaattaaactctatattgttaataacttctcctatagccaggaaaacccaggaatccaaaagtattagctcagagtccttaatctaatagaactttcccccacccctacttgctttgtctccaattgtaaatttccttcacaaggattttaatgcttaactcaaaatgccaggcataggaaagcttcattattgctggtactttcctgttggcaaattcaaccatagtctccccttaattctggttctttctttgcataatgggaataatcctgtttgttcattatgaatttaattcattgaggggaaatactgcattgaagatagtgaatgatgataaatccatttactggcagcctcagttggcactagctgtggattatcctctgcctctcacaatgacattccctggccttcattgttgacatctggaggcagcctgctggcagtgctggcccaagtgtttaaacaggtggatttgtgattcttctacaggctcaggaatctgatggcaaaaaatttgattgggcatcttttaagaccccctccttttagaaactaaggaactcatggtgctagttgggtatgtacaacagtaaacttgaacaggcttgtagagtatcttgaatagtaaataacacattcttgctaagtggtttgccgaaagcagggtcaacattctaaaatctgactgcctctgggtggcagttctgttgagtgtagaccctggtctggcctggggtgtccctggacacatctgcctgttcttcctccttgcttctcctgcacccatgtggcttaccttcccaaagagaatgtggcctcttgggggtgactgagtgtggaggggccggcctggggagcctgtcctggcacaagtgctgctgctgtggggggccgacactgtggacgcaatgagaggaggtggatgcctcctgaaaactaaagcctccaagaagctcattcctgtgtgtctctgccttagtctgttatcctaagtcacccataagcatctgactctcctgcctcagttaagcttgggctgtggtttggagaagggactgtgtagagggggtgattcttatcaagtaactgatttgcccaggtggcctgtggtccctcgcctgggtattttgcagtcaagcctcatgggacaccaaacactgtggcgggatcatgtggcattgccgttcatgatagacataagtttacagttcaagataagacattaacgtgttgtatcacctgacccagtggttccactttcgggactctattgggaaaaagtaatccagactgcatcaagtaatatttctgtcagatttatgtatttcaaaaaagggaactggactaaacgttctgtcataacctatcataagaggttgttaaacaaatggtcacgttcacagggtgaagtattttgctgtaaaaaaaaatgttttaacagattcattcattcagcaaacatttattgagtacctactgtgtgcccaaaagttgctacacactgaagctaatgcaccaaacaagagagacatgttccctgcccccgtgatgcctctaggctgaaggaagagaaaacagtgaacaagaaaataaataacgtcgaatgcgattaacatgatataatgctaagtggaaaaagaaagagaaaacagggtgctgtgtgttttcaactatgcaagaaatacacatgcataggaaagagcccaggaggaaatatgccaaaagagttataggtgatttatttttatttttctttaaatatctcaacatttaataatttttattctaactagggaaaaagtaattttaaaaaagaatcactcttcaaatttatgccatacactttatgccataggtatggaattctcatttttacgtcttccaaaggcaggaaaaccaaagtgactcccttggttgagaaagtgaaaaaagcatttaagtactagaaaggggagataggccaggtgcagtggctcatgcctgtaatcccagcactttgggaggcacgcggatcacaaggtcaagagaccaagaccatcctggcaaacattctgaaaccccatctctactaaaaatacaaaaattagccgggcatggtggcgggcgcctgtagtcccagctactcaggaggctgaggcaggagaatggcgtgaacccaggaggcggagcttgcagtgagctgagatggtgccactgcactccagccgggcaacagagcgagacaccatctaaaaaaaaaaaaagagagagagagataaatgtctcccaaattaccattgtctaaacctaaccttaggtcaagtgtcacaaatcgcacctattagaaaaggaaaggtctcttttggaggcacatgcaggaaggggttgctttggtcccactgcttcttccctgctggcgtttttggagctcccagctctcagctccgcaggttgttagctcagtgcctggcccctcataggctgtcatgagtatcttgcagatcgagagaaagaacaaaaatacaaaccatgtgtgagcaaaacaccatttcattccactggcccttgttacaaatgcagctaagatctgcttctatgcatcttagacgtctcatcccttgttcctagcaaatatctttggtaaatttacaagtttataaattgcttttaattttatcaaatcagaaatttgtcttgctcttaattatatgaaaaggatgctccgtttctcatataatgagagaaatgcgacgttaacctttctgagttatcggattggcaatgtaagccatagctgcaggctgcaagggagcccgttccttttgacgtgtgacatgtgacgtgtgacgagttttacgtctagtaatgtagcctacaggtacacatgcacacagctgaaatgacgtgtgcagtaggtttcccttaatggacagctcctgcgtgccagtctctattctaagtgctttaccatcatgaagtcatttaatctccaaagcaaccctgtgaggtagacattcggagacgttattattatccccacgttacaaatgaggaaactaaagaacagagatgaagtaatttgctagcaggggcaaagccaggttccagaccctgttgttccagggcccttgctctgctcacctcaagtagttgctccctatgtgaccaaggatagagcactatttgtgtagtcgtgtgctgcaaaatgacatttccatcagtagcagaccccatattcaatagtcattgcataagattctaatgtcgtattttgactgtaccctttttatgtttaggtgtgtttaggtacacaaacacttatcattgtgttacagttgcctacagtattccatacagcaccatcctgcacaggtttgtggcctgggagccgcaggctgtaccctatagcctaggtgtggagtaggggtaccatctaggtttgtgtaagcacactctatggtattcacaaaacaacaaaatcacctgcatttctcaggaggtatccccatagttaagctacacatgactataattgccaaagtttataaacaacctaaacgtccatgagtaggggattgtttaagtaaacaacactacatctctcctgtgcagccatggaaggatcataaggatacactgttaatggaaaactcaaggtgcagaaagtgctagcaggtgtgttaccaaaaaggatggggaaacatatgttcatatttgcttgaataagaataaaatgcttcagaaatgatacacaagaaacggggaaccaacattgcccatggggagggagacttcgtcatatgcacttttatacttttgcatttctgagccatccttgtatattacttattcagagacaaaaatcaaaaccccgagtactactgctttttaatggggttttttgaccatacaaccactttattcatagattttaaacattaaacttttaaaaagttttaatgtttatatatgaacaggtaacatatgttgtggttttaacaaaaagtcaaacaggctgggcgcgtggctcacaccagtaaatcctacactttgggaggccaacgtgggaggatcgcttgagctcaggagtttgagaccagcctgagaaacatagtgaaactctatctctaccaaaaatacaaaaagtagccgggcgtggtggtgcacacctgtagtcctagccacttgggatgctgaggtgggaggatggcttgagcctgggaagttggggctgcagtgagccatgatcgtaccactgtactccagcctaggcaacagagtgagaccctgtctaaatacacacatacacacatacacacacacacacataaagtcaaacagagagtgtaataaaaatgaagtctctcttccattccagtccagcctcctcccatgaggctgcctgtctgctgggtccctgggaattcttcctgctctctttttccacacagtgcacaccactgaccctgagtgtggagcagcccctcttgtttgtcccaccaaaactatatctgaaaataaaaatccagttttggtgaccaggccttttgtgggtgtttttggagacatcctctataattgaaataaacttcaactcaaatgatagcctctagagcccttggtccctgtcctaccgtcatcacaaccccagccaatctcagtgcaccacttggtggttaaagtgctcggattcctttgtggtcggaatgtggccgtaactggaccctaaggagctgaggagagtcagaggttcctcaccaggcttgttttctgcacctgcagtggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcgctgtcaccacacacgtaggctgggttaggaactgtgtcagggagggggagctgctgtggggcttaatgaaccgagccctgtggaagaccgtgtgctagaaatgctatgctggggatgctgtttcatgtaggagggccttgcttacctcttccggccctgtccaggctaagggaggcttgggcagtacagaatctgacttgggacagtgtgcaggctccagccttttgcaacctagtacttagccagttgaggctgtggttaaaatgaaacagggctgccacatgccacattgtgtaaatgggtcagtgtcgaatgccatttcgaatcgcaccagtggggccagtcccgcctgtctttcacctgcccgcccacccacccaggatggtgtggattacagcctatgggcttatggtatgaggatgagcaggagctcctgttctggaatttagaaacgctaagagatttccagaattggaacaaaaagtaaagttgtactggcagaggggcctgcattgcagaaacagtgcataggcaggtatgtaaagacagacaggctgccatttagagccagcgggtggagtagcgagcatgggcagaggtaagtgttgagaaaacacagtcaacagcaaagaatcagagcagtattcttcctccccgaaaccattctgattgccaagaaaccccatggcaggaaaggaagaggaagcagggatttttcagccaacagagacattgagccagcaatggccctgtccccagcttgggtcgcaggagacagtcatgagggcccactgagggggttcacagctgaacatgtgtgtgcatgtgtttcctattgagccaatccaattagaaacaaacattgaaaggctggggcgtccgggagccccgtcagcatgagcagctgtccttgggcaggtcacactggcccctggccccctcaactatgtggggtgatgaccttctaaacagtaaccctgctctgaattctggggatgccgtggttaaaaaaaagaagaagaagaagcttaaaccagtggccagcagcagagtcggcctgcagataggcgttaattaattgcatagatgctctttgacttacaaattgcaagttgacttatttcgatgatattttcaacttatggtggattcatcccaacatagccccatcattaagtctaggagtgtactgaatgcatctggcttccacaccattgtaaagtcaaaaaattgtaagtcaaactgtcataaattggggactgtttataatgtgttttataacatcaggaattcacctggaaattgctaccaggattttcactttgcttgatacctgagaacagacagctgcatgggccatcgctccctgtggagctgtcggtggggcgggaccccagctgcccccatgttggctgggagctctcccatcagcactgtctttcctgtgtctgtctgtctctgatgtcccccatggagcctggtgtctgtctactcatccccctgctttcaaagatgttcttcctccacccagcttctgcagacatttgggtttttaccagcactgctatcccccagaacatccctcactgtcctgggctagctgtggaggagagagcccaagactgagtcttcccatgatctaggatcaaggatccaaacagcaggactcctccatgcaacccagttatcacacttggatgctgtagggcaagactcacagccaggcctggcaccagatttacccaccggatatcccaagacgggaaggtggctgctgctaggcatcggggaggcagcatcgagggaggctgcagtgagatcagcagggcagaggacagcctccaggacagtggagagtccagcccggctgacctccatcccagcagggacaggaagcggagggcagctcgatagaacaggaataaaagggcactggcttgcaggaatgagacactgggggaaagcagcatgtggcctgggcaataggtgcacagctggccagcaggtaaccaggaagtgaaggtagcaggccagagcccagctatcaggggaggagccaggcagcatctggcttatttctgtgagtgacagaggtcttggcacaggcaggtaactctgtgggtttggtgccttccagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtaatgagcctgaagtaagaggagacggccagcttccacgagctttgattgtccagagtagctcttaaaatgtagggctgctcctggcaaaggtggggctgatggttgtgtgtcttctcttgcctgggagtcataataatcatggcaatttgcactcacacagctcaatccaccccaggctctgctaatattttacagaccagtaagtatgcttcaaaccagtaagtattttccaaccttcccagctgggagagcagggtctatatgcccaaccagaatggggtcttgccccctggtaagttagccacttctaggagcaccccctttccaaaggcccccatctcacagctcagcctcctgactccctcaagtacatccactttcagtccttgaggtcaggatgtgggaaggacacagttactcccaaggatccaggaaggttgggttcaaggagcacagctgggaaaggacttcgtggcagagatcctgaccagcctggaggcctagggttaaagacccagagaggatctcaagagatgatgtcagcagatactgatgcttcacagatgccttgaaaatcttacagcatctaaaaaggccctgcatgaatcgtttttctccaatcatcccattgccaaggtgggccctggtttggggccgccagttcactccacaaggcggccaaaaccacagctgcccagagaagctccagccactgagctggacatggcttttattcgtttgttagactagaagctgttcttctccctctgagccctcctgtagcaatttgtgtgagaagaggtatttctggttggacatattttccttagctaaatactacggctaaatgataaatgatgggtgatatctaagaacactgatgctttaagttatctaatatcttctgtgaaaaacaaataacaaatggaaaattccaccaacacatatcaagtataaattacggtcaattccattttaaatttcttctactattcctttaaaatagagcattgaattatgtatggactaatctgctctgtttccccctgtgatttataaactgtggcaagattcagtaattattaataaggaactgatttttttcttaaaatctgctactgacttcagccttgcacaatggaacctcactgtgataccattctgcagtccagcagtctactgagcagggattaggtggagagagggggtctccatgggaaggagatgcattcctggctctcagagaagccccctcaagtctcaggggtgagtgggatgggcagaccagagacagcaggagagcctattcagagaccaggacagagtgacagaggaggtgagaaccagacggtgccagagtatggaagccaaaggaggaggacgagccacgttagagtccaatgcaaggtcaggtggatatgagacggggtgtgcggagccggccatggtcatggtgcatcaggagtgacgggcccaggccagtggaggctgcacctggactctttgggcaagagagcagttgccaagaaatagaggaagtgagcgagggggacgagggaagcctagggagtacttgcaaatggccagggtcccaggacagcagcaggcaagatggtccctggagaggaaggttgaggaccagagcatctggctgggagaaagggcagcagctgcagtgggcagcgtggggcacaaggaagatgtcagtgctgtggttctgaaggtggacaactttgtggtgacagccaacctgctaggccagagccgtctggtggccaaagtgcaggtggaggccaccccagggactccgcagggtgctgagttgagagcagaccctgggctgtccccccgcccagagactgggattcagcaggtgtgggacgcctgggggtctgcacctgtagcaaccactcttaggtgcctgcaggcaccgtgggcttagggagctggcagataatgaaaccagcgaggatgggggcaggaggcagggaagagcttgggttcctgcaagagagtggctgggaggccaggacattactggcatggaaacacagggaagcctgggcctcaggaaagaagccatggttgagcaaaggaagctgagtgggctgagatcagctcaggacactgtggtcatccacacaggactgcaagggaagccaagaacccacgtggcatcgtctggaagacggagttccagggcagctccaccggtacaggagacagttcacaggatgagggtgatgtctggagcaggaccatgtgtgctcacaggctcagcacatccgtgcttactcgacaggctcaagcagaggcccagaagcctcaggtcgcttgctcagggcacagcagtcaggaaggaaaccagacttgttctcagtgtactcttattctcgtgggcacctcttgtctgcaattaatcggcccaagtcttgcatgcctctcgggtccgatactgctccagtgaggttctggtgtgctgttcttggatggcgtgaacggtggagaagatggtgataccaaactctcctgtccatcggcagttggtctgagcgcgcaacggcaaagcacatggagaactcccaagttgcttctaacatttatttgtttgtgtatttttttaaatcctggatttcctccacaaaggattgaaggtggagttttcaaataaacccgtgtcagtttaagcccatctagagaggcatcagccgctagccaggctgttcagcacgtgaacggagccccccttgtatgaagagacccctgctaggagttacgggaagtgacacaagaaggcagcggggcttggaggaactgtcacgctaattgaggcaaagggaaaagcagacctaagtacaaattgcaacacgaacatcatggttgcccagagaatgagctgcagctggaccagaacacgctcaggcggtggagtgattgggaccacgtggacagcaaggtggatttaatttaagaacgcttcatgggcgagaggaacctggatatttggcttttaaacacaattcaagtggacagccatactggggaggtttgtttacagatattcatctaggcatctccacccttggatgggcatcgtcttaacctgaccggtgggtgacctcagtgcagtgtgggggccctgcagctctgttgaatagcccccaaccttgcactgggctccttgcaaaattatgaataagctttccactgcagagagacccaggaacaggggtggggggtgtgaagtccatacacccggaccagcagctgggagcactgcttcaggaccctccccaaggctgtcctcctccgaggacatcctagaacattctgtctggagatggtgaggacatctgcactttccctgttcctagccaccctcctctcatccgctcagcaaatagtgattgagcacctgctctgtgcctaatgccaggaatctagcagtgaacacaccgaaccaagccctgcccgcccgtctcccattccgtgtctagaaagagtgaaaagattggtctgccgcctccctgtcgcactcctgccctcatcttcttaagatgaaggaaattgttcactttatcaagcaagacagacctgctgcctcctcagggagaagacgctgcaggaaaaggcaggagagaagtcctcaagtcaccacgacagccccgcgttcgctgggccagctgcgagggtgggaaggcgagagcccagtggctgagctggagttttgggctcaatgggtaatttaaagcaatggtgcgagaaatgaggattttggaggctgtcctcatagatgacccaggatgaggtgggcaaagaatccaatcagatgggaattgatccaaaatattatagtaaaccctctggagctggggggaggagtttagtaatgagttttagaaatggtgggtggcatctggaacccaggataccagcaccgcccaggaacagcatctagagtgtcctcgtggatacacacagctctgaaaggggttcacagtgggaaccgggacacgcaaagcccccccagtgaaaactagggaaataacaccagagagccttcggggagggaagccagcctcactgggtctaacactggcaaggtctggagacttcaagacgagtgaagagggctttgcgtgccccagcaaaaccccactgtgggcagcagagaatgaggacttttgtcttttcctcaagtccccaccaaatgaaggtggccagcaactcactagtctttactcttgagctcactccccatcccctctcataactcacacctcggaggaggaggtttttcttccagtaactcaaaagccttcacatgccccacttagtccctgtgtgtcagagctgtcggggtcccctgggccgtttcccagcgtaggagggacaggtgggcagtaggcaggagtccaccccagctgtagcttcaggcgtcactcctgccgaccagcgtggggaggacccctgcagcgtgccccgcccccgcctgacgggtagacctttaacactggcttcatctctgggatacctgggaaggacctagagggtgaggtttgctggcatctactcagctcgcctgcagttctcagttgtttttccaacaacacaccagcctccggagtgagaagctggggacccctgggaacttgagggaagacacagctgccgtcccaccaagggctccaaggaaagcctaaaggggatgttctgaaaggggctcagccctcagcacagaaaacagcagccccccaaccctaggacagcactgtctagctgtgtccctgccccaccctagacctggccagcaacagccccaccaggcggtcctgagcatgcggagatccatccccattcccaccacagcgagttgcgggggggctacctaattcctcctggctcatcagcttgccagcagctcccctgacactcagcaccccctcttgtgttgctctgtcctccacgtggaagtcaaaggtgctggctggtcccagcatgatgactggtgcaagtgagtgaatgaaacagctgttccagcctctccctccccgctacccctccaggctctcacaagtcccatctcctccctgctccgggtggcgtacccaccctggatgtttcactccttctcatgccatccctgtctagagtgctcagactgacactggagcccagcgaggctcagctgtgcctgttacccgcagggacggctgctcccgccttgtcgtctggccgtccagccccagcggggcctgggagcgtctcccaaccctgccaagctgcgatatcctgacacagggatccgcgggactgcagtagatggagaaggcgtctctctggatgaaaggcaatgcttgtttctttaaggtgtgtgccatccggagtgtggtgacaaaggctgtgatggccccaatgcagaccagtgcttgaactgcgtccacttcagcctggggagtgtcaagaccagcaggtaatgcatgtcccgcagccctgtggctcaccactcagtgactttccagttgtatccttagcccctccatgtcctgatgccccagttaggaagtaacgtagcacccccaaacaatcatcacactgaagttaactgctttggagtttttaaatttttagtaacttggcattcctatcatgcaagtcatacatgtccattacggagaaattagaagctgttgcacgttggcgtccgtgcttataaagccttttctatctgtgttgttaaagagaagtgggtcatgttgggcgtgccaaggctgccccagagggcctggagacggatgcgattcaaggccctggtgctgtcctcacaggccagctcaggggacatggctcttggacaggctgaagcctgttgatggtctttctttcagtgtctctggactctggctgggtgtggggctttcacagaagctctcctggcacctccccagagagcccatgaggctgagtttaccccaagggaggatatcaggagctctgacctgggaccccacgtatatggccagttgcccggttcaggctgacccttctgtgatgagtgtgccctcctgtgtggcctctgcagtcaggccctgggctctgtccacggagctcctccagctcctggcatcaccactttctcagattctcttccctgccagtcctgcagctgccctgttgtccattctcatttcacaaacttccctgagcacccattatgccccgcatgtgccaggcctcagaggccacgatgacaggacactgctaggctccccaaaggcctgggtgacagatgcacccaccaaccactggtgcacacccatgagggctcaggcacgggtgcggccgtgcaaggtcaagccgggtgcccatgtggctctcgtggcgtcctcgagctcccagccacagcgcactcactggccaaagtgcaaaggctgtcaccctgctggcctcactcactgcccacaagactcactccctgagggcgcccgagagagggttttgccagagccgacagttccaaaagtcaaatacgaacctcacgatgcccttgggaaaccatgcgcaccctcaggaccttccagcggggccagctttgaaaagaaaggattcccaggttctatgcaaggcctccagcctctccacctgtgtacgtaggaacctcagaactgcactcaccaagacaaagggcatcatgtttgacattcactcctgaagccttcgtttcctcagaggaaacaaaggggcaggcctggggctggggctgggttggcaaggccctcaccctcctgcctttgctcctacaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtaagtggcttgtttgtgggtacaagaactgatgagccagccccaactttctgggcccgtgtcctctctccagggagaatttcccagccttctgcttccgtgtattttgttgttctgagtaaggactttgaacagggaaggaggcagagatgatgaaatcaaagcacccagacctgttagttaatagcacttccccacagacctggccaggagaagttccaagtgatgctgagagacatcctggctgtccagggaatttcacccacctgcaacagagtcaacgtccactactgagcaagggcagagaggtggctagggccagccactcttgaactcagtctgatttcaggtatcagaagaggaggtcctgctgtctgtgctgtaatttctcctccaggaaagactatgccatcggcttctctgtaacacaggatgtgtgcgctgggcgtgggtcagggcacatgggattggtggtcagagctgggggagagccctcctcggcagagctgcggagatgaaattgggagtcagatgtgggcggaaggtttgcagacctccagacatgaaaaggagctgctgaccaacgtcagttgggctcggaagggatgggtttgtctttgccgggcatttcacaggtggcaaccgcacccctgaacactagacaggcagtgttttcctcgtcctacagatggggaatcaaagctgagcaggggcaaaggccacaactagtcatgatggaggtgggactcggactcagagccgcaaggccaggtgtcttgctgtcccaggagggtgggggctggacaggagttgtaggcccaagaccccatgccatgttttcgtaattcgcctcgccctgggagacacaaaagcagggcttgggttaaattgacaggggatagttctcaaacacattaaagaagctaccgtttggcactcgtggtcttccaggtagcaggcctccccacggccctcctctctgggcccttactgctcaggatgggtcattgatccggcctgtcatggcactgccgttacccctgtggacaagacccagcaaatctttaaagacgtataaagccatcaaataacaagacacccccttttttttttttttttcgagatggagtctcactgtctcccaggctggagtgcagtggcatgatctcagctcactgcaccctctgcctcttgggttcaaggaattctcctaccacagcctcccgagtagctgggcttacaggcatgcgccatcacgcccggctaatttttttgtatttttagtagagatggggtttcaccatgttggtcaggctggtctgaaactcctgacctcaaatgatccatctgccttggcctcccaaagtgctgggattacaggtgtgagccacctcacccgtcccagactccctttagcggggaaacaaaaagtcatgcaagacacatttcacagcctttgcaaacgcttgccctgggctgccaaccagacctttgcaaaggacggaggcgccttcatccccacccccttcccaagggcacagttggccgcccttcttcaccccgacatcctcactcagcacctgctttatggcgtatgatgccacctgtgggggccctgagggggacacgtgcaggtgtggcaagcagctgttagctcccaggcccagagcaccccagccacttaggagtggtgcatggtggtgtttcatgaggcgccaacccagataataagttatgacattgcaggtgggagttggggtgacccagaacttccccaagaggcacgatgactcgccgtaggttcctgtctcaccatctagagcagccagatcttcatacataggtttccctgagaaagcaccgtggtgggcaagcggcagcctcaggctctccaccccccacctgcccacacccggccacgtttatgaagatttccacctcgttaaactctactcagcccaccaggaattggcctccatccctgttgaaataagcagaaccacctcagaggcctggtggttgtctgaggaccgtttttacctcagaaaggggaggtgagaattctgtgaccccacaccaggtacaagcggcctctggctgctttatttccacccattccggaggtggactcggggaacagcccacccgcacccccgctttgaaatgccgggggcctgcttgcccagatttcattcctgtcagtgtcgtcccttctcttttcttatctcgctatttttctccaggtcagaaaaattgccttaaatgccacccaagctgtaaaaagtgcgtggatgaacctgagaaatgtactgtctgtaaagaaggattcaggtaaaaccccctcgaaacctgaggaatgtcagggcggtggcgctgcttggagtgtgttatggatttaccacgttggtgcatttctcctaaaagctgaactgtcagaggcccaaagccattgagggtaaagattccgagtcctggaaatcgtgtgtccacttaggatggaaagggagaggatgggcggaatctctacattttacacaacatgggcgaattgggcaaagcagcacttgatcacatcacgtacagcacagggctgtgcccagatccgcctcctttcgctccagcacctccacctgctccagttcccctcgctgtctgggccggggatgggctgtagcggctcacccaccctctctcctctgcatccctcggtcttctctttttctcccagctcctgacatcttcacggcttcctgagggtgctctttacgttcctggttctccctgttcatcaggctcagccccataaagctcagcatgcattttctttaaaatcattctactgggttaatgattgttcttggaatattttgaaatgtttcttcagcccatttagtgcaaccaaactgcatttaatgcaatcaaatatacattacctgttcctccgaattgctgtctaaaatcttagaacattctgttcaaaattttttgggggacactcccatagtagggagactagcaccatggtccgcactggaaggatcacctcatgtccagatgcaggttctgatgcagcaggtctgggcagagcccacgactctgcatttccgcaggctggcagtggtgaggatgctgcggtccaggcagggagctgcttttgcagggtgaggcggtggagggctgcaacacacccccagccccgtctcccttctcaaatgctgtgaggactggaattctccatagaagaagtttcttttttggagtaaagaacaaaggaagaaaacttactgagcatatcttctcttattccaggggcttgcaccagtgttgcctcatttaatctttgcagcaacctgtgaagtagacataattcttactcgcattttacaaacaggggagatgaagtttccccaggaggcactatgctactgccttcatttccttcagcctgcctctttcttccagatcagagtactggggagaagaggaccccaagcagctaggagtccaggagagggaaggcaaagcaaggctcccaaagtcatgcatcacatctgctgtcatttaaacctgttggctggacaaggcaggattaggagtgaaaggatgaactggcccaggaaagggatcccccaaagataaaagagttggaagaggaaggaggcattccgctggtggcctgggagaggccagctttgatgtcccaggctctgcaggtcaggcagcccaggagtggatcctcaacccaggctggtagctgggggcatcaggaagaggaggctctgtgttcccagctccctggaacctgcctgtttcccagcagagaagtgctgaggggtccccgggaatgcatttatgcatcccgtcccatcctgtaggagagggaaatcggatactcaatgtaggaatggtgtgctaaagagaaaacgcctcctgtcggtagccccgccacatagaggcagtgcttccgtcactgacgagctttcagagaggcgtgcaaactccagacgcatcgccagccgtcagccacagagagcttccgtttattgcccaatatcctcttaagctgtgacttctaatcactgcagtcatgttaaagcagcaagagagcagccgagccgccgcctctggccctccatctcttcagggggatcaacacaggaaaggtttgcaggggagtgtcagttataaagacatgatttaactgccattcgcagtgggcatggcaccatgaagaggaagggcgccgggtgggtgtccgccatctatgcagaggagcttgccaacatacagacgtcttcctgctaaatgcaggtgtaagagataggaaaaaccagtgttttctcctactctcacacacaaaatacaacacacttcacctctggtagccaaaacgtgtgggtttttccccacacaccaagcagttctccagtgaaccgtaagatatacgtaataaatatatagctcaggctgaacgcagtggctcacgcctgtaatcccagcactttgggaggccgaggcaggcagatcacttgaggctaggagttcgaaaccagcctggccaacatggcgaaaccctgtctctactaaaaataaaaaaaatagccagacatggtggtgcacgcctgtaatctcagctactcgggaggctgaggcaggagaatcgcttgaacctgggaggcggaggttgcagtgagctgagatcgtgccactgcactcccacctgggtgacagaatgagatcctgtctcaaaaataaataaataataaataaataaatagctcaattctgacgctactagatgtgtcagatcctacaaattgagggctcagcccaagactgccccactttgatgtcaatcacgagtcccacatggtagcctgtgcttctgagtgaccagccataaatcggacttgccatgacccctccttgggttcgattaattggctaaagcagctcacagggaaagactttacttacatgtgcccatttattacaaaggatatggcacacagccagatgaagagatgcggagggtgaggtttggaagggttgagcgctggaccttccatccctatggggctgggctgggctaccctcccaggatgtggttgtgttcttgttcaccaccccagagctctccaaaccctgaccttttgggtttttatggaggttttgttacatagccatgattgattacatcattggccattggtgatcaattcagccttcagcccctctcacctcccaggagggaagtcagagtagtagggctaaaaattccaaagctctgatcaatggttggttccctggcagccagcccctgtctagaggctgcccaggaacccccagctatcagttattaaagacatttagcactttgataattccaagggttttaggagctgtgtgccaggacaaagaccgaacatatatttccttttttttttctttttctcttcacatatttcttattataaatcccagtgtcatagcaggagtctccgggtctgacagatgcaccccagagcccttgctcagtatggcaaacccatctagaacatgtacgtcacagactgtacacagtataatctcaggaactaaagagataatagtaggtgatattgattcacactgctgtgtgccagacactgaaatgtttatgggtattagctcattgagtcctccaagcaactttatgatgtagaaaccaattaacaggaagggaaacagatgtagaggggctggctggcttgcttggggtcgaacactgggaaggtggcagaagccatccacgtgggtggtctagctcagcatctgtgtctctgtccagcactcggctggctggagtgaagtgagggcacaaatggggcgaaagaggaaggtaggggctgcatctgacaggcctgctggggctccagagggcgtcttatttcaagttcattgcgaagctgcagaaggttccaaggtttcaagcaagagaggcaagagcgggttggggttcagggccagccttgtagccgacagccccgtcacacgccataaatgccaacacttcaagagggacttgacactgagactgagctagcgtgccaccagtgatgacccacacagctccacttctcttcatggggtttggattcgagttggagaaatgacagtaagaaaaagctatcactgggtcaaggacggagcctggcgcctgctgcctggtgatgggagctttgcttcccagggccttgtaccccttcctgctgggcccccagcggactgcgggatggctttcccgactttccttagctgagaactttcggtgacacaaagaactgtgcctcagccacttacatctcctcttgggaaaggtgctagagggcaagtcataattagacttttggaatggatgtggaaatctgcctctttcttttcaacagccttgcacggggcagctgcattcctgactgtgagccaggcacctactttgactcagagctgatcagatgtggggaatgccatcacacctgcggaacctgcgtgggtgagttcaccgcctgcggaggcctcgggccagcgtcacccaagcgtaggctagctgccttgaacccgagaaagccctaggacttcgtgggcttctgcatttattgcagcattaaaatgcaagggcaaaacaaggtacaaaggccctaccagggactgggggccgggagagtggggatttaatgtttaatggttacagagtctcaacttgagaaatgacaattgttctaaggatagatgctggcaatggttacataacagtgtgaatgtacttaatgctgctgaactgtgtacttaaaaatggctgagatggtagattttatgtacattgcagtggctcatgcctataaccccagcacttagagaggcagagatgggaggacagctcgagcccaggaactcaggaccagcctgggcagcaaagctgtgagaccccgttctccacaaaaggaaaacgttttgttggaaattttttttaaaaccatgtttttaaatttgaaacaaaatcccaaaacaatgcaaaggcccactttgaacacgcagcctgaggttctcattagaaacccagccaggcagtggcttatttcagatggggaaagggataagagatgctcaccactcataagccatcttgtctcagagctcagctcttgctgtggaacggcgcggacagaaacacaacaccataaacattgagagggctttgggagaggcgggaatggatccaggtggggatggggatgttttcaaacatagccttagttctttgtgcctatcttcacttattttgaacattttttcaaagaggaaaagaattctataaacaattttacatgtattataattgcccacaaagatgatggcacagatgtctcccaggcacagtttttatgcagaatagcagagaattcattcattttattggattttgttttgcagagctatttgcacagtaagttgaagtgcaccatcagtctgtgggctcggatatgttttgggttaagttttctcctctctccttcctgtccttggtactttggtcctttctaagaaactcacatcatatgagctttttctgcagtaatactttaagaattaagtctctactggccgggcacagtggttcatgcctgtaatcccggcactttgggaggccaaggcgggtggatcacctgaggtcaggagttcaagaccagcctggccaacatggtgaaaccccatctctactaaaaatacaaaaattagccaggtttggtggcaggcgcctgtaatcccagctactggggaggttgagacatgaaaattgcttgaaaccgggaggtggaggttgcaaggagctgagatcacacccctacatacttcagcctgggcgacagagtaagactctgtcaaaaaaaaaaaaaaaaaaacagaattaagtctctgctaaaccagtttccatgatactactgtgcctcagaaatcctgcagaatgggcacacccctccccacgtggccggccatgagcaccccatgcagctccctgccgtatgtcctggaatagacaggcctgatgaacaaggctgtggccaaggccagtgtcctcctatgattgccaggctgacctcagaccacccaggggagacatgtcctcctcagttccctcctggggcagccctcaaggccacagtgctcagcatctggatgggttccacccgctggcagctcagcagatttccccagcagtttgcctgtcgcctttttgtctattatttttattatttctttgacttatttagcccagatggattaggcagcatcactgatgttgcttatttaaatttcgtagtcacttgaatccataacattcaggcatacagttttgcaactctttgatttcaataattcacttttctttctttgagtccccagattgcctgatggcaaaaagctttatagagtcccttggaattctcatctcaaaccagtgacttctccatcacttcagctattaaattcattggtgagcaggtccacagctctgggggtctcccctgcgccccatgccctctggcctggggttctttctaagctcctgggaacgtgtacatctatcccctggcagcctcttgggagagagacctcattttcctcctctgagtcactggaggcttcttgttccatgtcaggtgtggacctcattggaggcagctgttctcagctgcctacttcctgtgccctggagacccaggcccacctggcattcccctccctgttcccattcagtgaccactgctgtccaccacccacccaggggcctgggcacagtcgtggggagggtcggagtcaggcatgagtgcttggggtagggcatggcggaatctgtccccacccttggctcacagtgccccagtgcacttggcaggcaactcgatcgagatgagcctctcatcctcctgagtccaggtgccccgtgtgtcctggcatggaggttgtaatccttcggggctgctggcacagctgggttaatgcagtggccccgtgggacgcgacttacccacctggggcatggcatgtggattagcagctgacagcctgcagggcacacacataccaagttgcggggcagtgccccaagcacctgtgacggtcagccctcaagcatgagcgtcctgtgcctgagacggcactacttgaaacagcaaatgagaaacaccacaacagaccaagagagattcaaaagaaaggaaaacgctttctgttttagtccctgtcgtggcacattcttccagctttctgaacaaaggctccatgttttcactttatactgggccccgcaaacaacatagcaggtcctgtataagcacagcccgttctgctcttattgctatgattgtgggtgcttttaaagtgttcaaagtctatagagacttgcgacttaatggaatccttaaaagactttcactgagttatgaaattcatattttttagtagttgagaaaataggtcgcttagaaaatcaacccactttaacagcttttttattgcggtaaaatacacatcacataaaatgtaccatcttgactatttttaggcatacagttcggtggcattaagtgaatttacatttgtgtgccaccatcgccaccacctccaaataaatgtgttttaacaactttgaagcttaatacattgagcatgaaacttaagtacaaacaagaatgagctttctttcccacttgggaggctccacaggtgttaaggaccctggtgctggaggaaggatagtggggaagacgggttcagcaggtgaggcgtgagaggtacaacggcaggccctgaacagctcccaaaccccactcagagtggcaccccgcctggtgtatgagacccacccaccagatgctcccagagaccagtgatggggaggggcggcattggccaaagcatacgagcagcctctgctccagaacaacataaaccagacagagtcccgcccccggggcacagctcttccaccgcacctcaggaagagagggagacacctgccatgaagacggtggtcctcaagaggccccttgaggtccctacatctgcctcctgctcaaaaccctgtggccttctcggcttcactcttcctgactctccaaggaggagcttctcctgcaggagctcagaattccctcccaggcttacggctgtggttctgaggtgtgaagccagccccagagcccagggccttgtgcttgagccctccaggctccggaacctctgcaaagggattttcccttgatgcagcgagaggccccatctgagtccagagcagactgcaaggcctcgatctgcgaccacaatcgaactgaagcagctgtgaggaggtttacctgggcattgtgattatcatagagcccctgagataatctcctccctgcctgtaaccctctccgctgtcagtcagtgactacttcactgcccctctctgacgtcccatcagttgctccctggagacacctggcccagaggaggtgctatctagtcaactagtccaacatctgacccaggtcgacaggtcctcctcggaccctgagccaacctgaaggttttcctccatgactcgtggccctttgctcagaactgttgtgtcttcgagtctctcctccctgccctataaacccttagtcttaggcatttgtttctctgttgttgaaaacgccctggctgtacacaccaaacacctgtcaacaccattcccaaagatctcttctttcatcttcccccgtcatcttctacagcgttctgtgcaatggaagggccacaaacgcaagccacgggtgcaatttgaagttgcctagtaaccatatcttaaacagtcaaatgaaacaggcaaaaataattttagtaacatatcctattcaacctaatgtgtctaaaatattgccatttcaacatgtatccatacaaaaaataaatgagctgttttatattttttatatgaagactttggcactggatttccaagtgttcagggagcagaggtgggcctaggcctgttggaaacagggcccatcatcgtggcacggccagtgggcaggtgtgctccctctgagatcatctcatgcctcgatgtccccgtctgtgaaatggtgatggcgatgcccacctcctgggagtgggtgaggacggcccagctcacagaacctgggaaatggcagctgtggtggtggcctgggggctcctgaatggtacccctgatctcacaaggccctgaagcaggcctggggcatggtcttctgccagccatccctgatacctgcttcttttcctgtgtctctcagggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaaaaaatttttttggagacacactctcactctgtcgcccaggctggagtgcactggtgtgacctcagctcactgcaacctctgcctctgggattcaagcaactctcatgcctcagcctcccgagtagctgggactacaggcgtgcaccacaatgcccagctaatttttgtttttgttttcgttttttttgagatggagtctcgcctgtcgcccaggctggagcgcagtgggcgatctcggctcattgcaagctccgcctcccagattcacaccattctcctgcctcaacctgccgagtagctgggactacaggcacccgccaccactccccactaattgtttgtatttttaatagagaccgggtttcaccacgttggccaggctggtctcgaactcctggcctcaagtgatccacccacctcagcctcccaaagtgctgggattacgggtgtgagccaccacacctggcctaaaatattttttttagttagatacttagagaaattaaaaagatcctgacaatttcctcattctaaagctgttctctgcacagtccacgtacatctattttcaccctccatatcctcctcttgtgcttcctcccatgtgtccctccacagagtcaccattcttatttgatggccctggacccttctgttgttggacatgagctgttaaaggaggagctgtttgctctggtctcctcttttctggctgaatattgccctatgttgggagatcatgaactcaggacccagaacagggcagggcaacctgtcttattcagggtgggagcaacattgaggagtttgaagggacctgtgagggtgtgacgatggggtgagctgtgaggggtgacgatggggtgggctgtgaggggtgacgatggggtgggctgtgaggggtgacgatggggtgggctgtgagggtgtgacgatggggtgggctgtgaggggtgacgatggggtgggctgtgagggtgtgacgatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgggctgtgagggtgtgacgatggggtgggctgtgaggggtgacgatggggtgggctgtgaggggtgacgatggggtgggctgtgaggggtgacgatggggtgagctgtgaggggtgatgatggggtgagctgtgaggggtgacgatggggtgggctgtgaggggtgatgatggggcgggctgtgagggtgtaatgatggggtgagctgtgagggtgtgatgatgtggtgggctgtcaggcaagtaccaggcgtcagctctgcttctnnnnnnnnnnnnnnnnnnnngtgggctgtgagggaagtaccaggcgttagcctgctttcacagtgctaaaaagaaatacctgaggttgggtgatttataaagaaaagaggttgaattggctcacagttctgtaggcttcataggaaacatggcgccagcttctgcccagcgtcttcactcctgatggcaggtgaagcaagggcagcacatcacatggcaatagcaggagcaagagagggaaggaggccgggcacggtggctcacgcctgtaatcccagcactttgggaggccaaggtgggcggatcacctgaggccaggagttcaagaccagcctggccaacatggcaaaaccccttctctactaaaaaaaaaaaaaaaaaaaaatgcaaaaattagttggacgtggtagtgtgtgcctgtaatcccagtcttacaggaggctgaggcaggagaatcgcttgaaccaaggaggcggaggttgcagtgagctatgatcgcaccatgcactccagcatgagcgacagagcaagactccatctcaaaagaaaaaaaaaagtcaggagttgccacacacctttaaacaagcagctctcacatgaactcactcatcaccaaggggatggtgtgaggccatttatgagggatccaccccatgatccaaacacctcccaccaggccccacctccaacactggggatcacatctcatcatgacacttggaggggacaaatgttcaaaccatatcggggggcttccgtctgaaaaagactgaaaatgagggagccctcaaaggcttgtgtcagagcaggggaggggtgcccatggctggctgccagctgggtaccgattcaccacacagtggggtctgcctcccaggctgtgtgtaagaaccactgtgggttgtaacctattcccctagaaacaaagccctacagtgagcccatgagggaccaccaagcccttgcacttgtctgacccacagcagagggacctggtggcggttacgtatctcggcaagcatcagccccttctactgcgttgctgtaatggaggaaacttgccacccgcttgcaaggtgcagccttgctgagtcctgcacggggccctgggcacagttgtctgaagttaaacccttcatggtaaccagtcagctggttctcagataattaaatatagcaatccagggagaacttggaattaaacagtgataatcactttcatttgtcaaatgccctggatttcagggcatgctgatcatgcccacagctgtgcaactggacccctgcaggcagccccaccgcaaacctctctttgcccctcaggaggcagcaggcgggcagccccaccgcaaacctctctttgggcagtggaggacaggagtttcctgggtacttgttcccaggtgaggggcagctttcggccctgcagaggctgacagtgctggggctgacacaccgggtcttggagaagcaccccccaggaagagcgtcagtgtggacgcctcccaaaggaagcaaggccttggtccgattggttctgcggggtctctccccacttggacagcctgagctgagaaccacaggcatcctccaggccccagaatgctggtggacgccgtggccgtccgctgctgctgtgccaggcagctccgagggagcatgtggccagacgggctgcgttggaacatgcaggtcaggacgcaggcctgctgggttggcaactgcaggtggaagccgaggcccgacgctgagaacaatgcctgataagttccctaagagaggggccgaggcccgacgctgagaacaatgcacgataagttccctaagagaggggccggacaccctcaagacctagtgagaggacccagcaagagccagcctggacaacttggaagaaaaacaggcctctgtggagtgcttgccagcgggggaggcaaactcctcatgccctggccctgcctccacttgcccccaggctcagcgggggcagagactcccaggggcacagcttgaaggggcacgccttctgccaatgcgcatgctgcgtccaggctggagcatgaaagcgtcagtcttctgcatcccactcctgaacaggcaggaggctgatgggagtggcctctgcaagggagcagggacagagggctgcatccggcatccctgtccttccagaatgtggcagggcaaagcggccatggtgtttgggggaaaagtaggtaccatagatggttgcagaaccagaagcatcttaaaagccaccctgcccaaagctggtgctgcccacgaggacccgctgctgggcacggtaatcctgacggaaagcaggagctacacagggtctcccagggagagccgtctgcactggcctaacggggacgggagcatcacccatctccctgagcagcatggtgatggattatttccccagacctccagaggagagcccagcctggccaccaccttgccctgaacctcgtgagaccctaggtggagagcccagctgcacctgcctggacttctgcctgcatagcggggagccgctgagtgggtgttattttcagctgctgagtgtgtggcaacctggttagagcaatggaaaaccgaggcccctgccatcctgctgagctgggtgaggttgtatttgaagaagcaagcaagccgtaacctcctggctgtccaccgcagcgcgctcctcaccacagttcttcactgatgaagcagccctcagccgtggcctgggggcactgggcccctgggtcctccagaccactgacatctctttaaatgactcagctcggccctggttctcgtctcaccagtggcattgtctgtaagagaaaccagagggtctgtggggaaagtcataacctgtactggggcatcagggtttggtggctgggccaccagaatgtgcaagggcaggtgtggggagggggcagcatgatgggggcagacccatggggcttcccacaagtgcacaaccccctctggcaagtcctctaaccccatcctttcctctggggcggcctggatgggaatattagaaaggctcgtgggtgtgagtttgcctgtggggtttacacatttacaattacagaccaagggcttgagctctaggctcagcatcctcagacacactaggaataaaacccacctcccacccaggctgaagcgatgctgcacctggggctccagagcagcggagtccgtggtgagaccagaccccatcagagggctgctctgcaaagagccccacgaggaggcctggtgtctgagcgtgggaaggcttcacacagcagggaggggacatctgtataaagcaaagaactgccccccagggaggcccaggcatgagcacaacaaagctccaagccctgcctatggggcctgttccacccttaactggcaacaatggggaggtgggcagctgatgcaagcactgtggagaccgagtcaccgggctctggactcaggacaggcagcagcatagccggggtgcactcacggccccaggatgggaaacgtgctccttcaagcactcggcccgcatcggcaagtgctttctgtagagggcacaatggtcagtcgttcaggcttttggggccacactgcctctgtcacagctactcagctcagccactgctacacaaaagattgtcaatgaatgagtgtgactgtggtccaggataaatgctggatgtggcccttgggctgtagtgcaccaaccgtcccctgaggtcacgtttaccctgcattagaaatagccctggctggtgtccatctctgcgcaggctgggccaggaccgtccgagaggggcaggaattgtggggcatctctcccactccccgagggtaagcaggcatggccacatataggtgacagcagccttctggtcagctcgagtcaggtgtgtcacatccctgggtggagtctggcctggaccccaagcctacagccatcgcagcccggcagccgctggagagagaagactgacacagctctgggagccgtgtggtggggtgggggctgggtgccagggcccaggagggtgtccaggtgagctgcgggaagcctcggaggcctggcccctgatcctgggcttgctcctgccaactggccatggctgtctctgccctcccagggcaatagtgaggtcagacaggagaaaagacatgcagacactcagcccctgtgtcagggaatggtgggcgacacagcctctccacagaggaccgaggctgagggggtgggaaggaggtgcagggaggtgagggttctgggaagggagcccggagtggtggagcctcttccccagacttcagcaggaacggtatcttcccacaggtgtgacgagaactgcttgagctgtgcaggctccagcaggaactgtagcaggtgtaagacgggcttcacacagctggggacctcctgcatcaccaaccacacgtgcagcaacggtgagcagcagctgggttaccctggggctgcctgtggaggagctcagctggccagctcgtgctccaaagagaaaagcaaagccacataggcatggcggctccacagacaggcgttcgtgcccctgatccgattgactgtctgggattcctctagctgatatggaagacagctgccctgtctcccagcttccctctaggcctctcacatcgatcagagaggcatcccagccactgctgatctgtttattgagtgactcctaaaaatgattttgtccttgtactggtcccactgccatgccataggccgccggtggcccggatgtgacgacataccataaaagaagcctgacctggggggtcaaagccaggaagcctggagggtctctgctcaggacgagggggacagagcccagagtagagcacacgctcagcagcagcaatcccagctctgcagggatccagcatggacctgcatctgtgctgcaggagagccctggctctgccataggatgggggacaaggacaagttgtaaaaacagaaacttaaaagggcaccaaagctaagtgcccagtttgggaattccaggcaccaaggagggttggcaggactcgggcctggaggtgcagtgcaggagtcattgtagacacacgggcagggaagggggctctggcccagcaagcagcagggtggagccacattctgacagccaggagaggaaggctctctgctccagtgtccagggtcagggcaggtggtccttgggtatgaagctggcactggccctgtccaggcagagcatggagcttgtggagggccctgggatgcctccttgccttgttactggttattatttttggggggtggcgggagggttgtctaattatgtcccttcaaaggcccagaaactacttctttgggaagtcacctgcccaggttatgtatctagcccaaaaaagtgtggttgccactggagggcctcccaggtccacggatgatgcatcctcaaaggcctcttccccttgctgcagcggtgtcctcagcaagtcctgtccacggcggctcccttccccccatccccactcctccctgtccgccccctccaccctggaagcagcttccattccctcctgcctccaggcccgtcctccggcctcccctacagtcttcctcctaagctccactgccagcagttgtccagaaagacaggtgcacatgtgccccacaggcccaggctgggtgttctcctgagatccctcccacaccacccccacatcctgctcatgaatccccttgtcactgagactcagcaagagccccatataccagtgccctcccgccacacagggctcccagagtcaagtgcattgcaggagaggggcttcaagggctgccatcctgctgcccacctctgtctgtgtccctcttgcccagggcaccactgatgcccagcatatgtggaatgattgaaacaatatttatttatgtatttatttatttatttttgagacggagttttgttcttcttgcccaggctggagtgcagtggcatgatctcagctcactgcaacctctgcctcctgggttcaggtggttctcctgctttagcctcccgagtagcttggattacaggtgcccaccaccatgcccagctaatttttatattattagtagagacggggtttcaccatgttggttagactggtctcaagctcctgacctcaggtgatccacccacctcggcctcccaaagtgctgggattacaggcatgaggcaccgcgcccggccttgaaacaatcttcacaggcaccgaagactgacctttccctcttttgcctttcctgatgcggggccccagctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcacaggagcctgtatttctttccacggcacacaaaatgaaacatgagtgctgaccaagtgttaagtggacgttactttaactgtggtttcagatctgtttgatgtcattacgtggaaggtcttcttttgagctttagcaaatgttgatgtaaggaagcaatggaggaaatcccagatcccaaccccagaatgtcactgggcaaagagaccccttcagaccacgttagcctcactgggaggaggttctagagcctctccagatgtaggggccccttccatctgtcacgggggagctccccagagcccagactgcctcttcaccggttgctgccaagtgtgattgaattaggttacagcttgtcttctatgcagtggctgaaatccctgaacccatggctgatgcactccttgggatgtttaccatggcctctctgtgaagtcagaagcttgtacttgctaggaatcctttggctgcaagtaaaggaaacgcaccaactagaaatgacttaggtgaaaacaagagtgggtgaggggcgttgttttgagaatccagagtggattcagaatttcagggaggggtgcagcagagccttgggaaagctggagccggcattaaatgtcacctggaccctctctgtacggcagcactgcccttctctccatggccgccttctccagttgatgggacaaatgacaagacctccagcatcttccaggtaaaactggtacaaatccaacccctcaggccaactttctgggtctgtttcttggctcttcttttcccagggacaggacttggtcagcctgccttacatgggtactctccctgtgtcatcagctgtggctacaaggacaggcttgtgcagcagaatatggctgcagggagctctgcagcagaggaggggagcagtgtgcagctctcagaaggcagggcaagtcacacaacccaacagctggccaccacaagcaccaattgaccagagttgtgcgtgtgaggcagtgaaggaataagtgtgtttgggatgaacattcaaccccttgccccgcccatgagaccgaccttgaattaaaagtaacttgttaagtgctgctggtgccaggcagccttttagaccctagagcccagataccagcaaatccgagctgcccactgagagcttacagtctaccatgtttgcagctgaatcagaaataaactcctggccgggcatggtggctcacacctgtaatcccagcattttgggaggccgaggcaggcggatcacctgaggtcaggagttcgagaccagcctggccaacacagtgaaaccccatctctactaaaaatacaaaaattagccatgcgtggtggtgacacctgtaatcccagctactcgggaggctgaggcaggagaatcgcttgaacccaggaggtgaagctgcagtgagccaagattgcaccactgtactccagcctgggcaacaagaacgaagctgcgtctcaaaaaaaaaaaaaaaaaaaaagggaagaaactccctttatctcccaaagggagatacaactacaggaaagccaaccaggcagcctcgtcgagtggctaagccaggcaagcccagcttggggctgacaagtcgggtggggagttgagaagttgttcacaaagtcctaatgactaaactccaccttgttgaaagagaccaactacatataatgtctgctcacaagtggtccgaccttgaggttaaaattgtctggactctggcaggatatgtgtatggattttaagtgacaggatcatggatcacctcctctaaacctgtcatttcccagacaaggacactgagacccacagaagtgaatgccttgcctggggctgcacattggcaaagttgctccccaccgggcccagggaaggaagctggctggctgcaggaggggcgtcgttctgcagctgcccaaatgcagccatgatgcatttgttttaaactagctttattttcagggggtgatgtttac

SEQ ID NO: 15239 - DNA, 32725 bp, Human
  misc_feature (1)...(32725): n = A,T,C or G
ggcataggtggcattcagtaatattgtcatcaaggatctctcttggttacaatattattgtaggtaacaaatttaagttaatccagaaattggttttagatgcagcagaaaggaaagggggagagggtttgcagaacagagactattttatttagtcctaccaatctggcctgagacaggctttcatatctgcttttatagagaagaaaagaggggccaagaaggctgacttcctcagccagtttccagttgctaggaatgagctatccctgggtcactatgactgcaaaaccagaggtttatctgctaccgtatctcatagcacagaagccactaagatgagtaaccaccaaaggaattaagacaagcacacatcacaactaggctacacaatgctactggcacgatgaaagaggcagaaaaaagtgcctgggggtcacaacagggcaaaagcacatcgagtggaggcttggtggatcagggaaggtttctgagatgtggtgacattccagaaagtccttcaaagatgcactgtgttacaacaaacagagaaggaggtgttagaagaaaggcctcaatacgggggcacggaggaatgagaggtaagcagtttagatgcggaatgaatctagcaaagctacatcaagaagttagccacgtgaaaaaaaaaaaaaagaatctcctcccacggcaaggtccatcacgtgaggccaggagacttcaagcctacaaggaaaggcgccacacatcaggcccaggacactcacctgtgtgtccaccccaggagaggcagaaggacccgctggaccccaggacgccaggacgcccagacacccacacattcttcctcgtacaccttgttccctcctttcccttctcttcccttcagaagccttccacctgcctgtgccttccatagccacaaccaggcacactctgggtggctgagggcaactcacttcatcttccttttcctctcagagagggaaggaagagctttgtttccttttcaaggatccccaccagcagcaaggcaggtggaagaaactgagggaagaggaagcaggacccccgccgcccccccagtctagcctttacagactccttttaaggagctgaagaggttgggagaggcttgccctgccccggggcagcagaaacccgggcgctgctgcagcagctgtgggcgatctccgtcagctcctgggctccaggatcctgcggcctcagcccctccgcgtctactctcggggccaccacctccagttggcttctccagggcacttcatttcattccgtccctagcatccaataagacgcgaaaaacttaatcccattttacaactgaagccactgaggcccagagagcaaagccatttgtcctgggaaagtggtcaagctgggactttgactcttcagaccacccaagggaaggggtgtgtgtgtgtgtgtgtgtgtgtgtgcgtgtgcggtggggggcgcttgttttgagttcttaagaaaacctcctggcgacccccttcttccacatcccaagacgctcgtcccgcactttctcgggaatgaggtttctgcaggcgagggcggcgctgccttcttcctccgcggcagtgagaccccgagggcgccccagggtaggaggggaggccgaatcatctcctgagaagagcgccagagaacttcagagcgtttcgcccttccccgggagaggcaaacaccgacacgtctgtgtcttttaccaacaagtgccttcaagcccggcgggggcagacacctccgcgccggccgccggcgaggtctccgcggtctgcgggggccacggcctcgcctcagctgcgctgatttagggcgttatccggtcccggggcgggaggcggcctcccgggcggcgaagcagcgcccgcggcgtggggcgaccgcgcggtgggcggaggggcagggggaggggcggagaggcgtccccggggcgcagggggcgggcgtgcgggcacacgcggtgcgcggcgggggcggccatcgtgctgcgcagcctgggcgcttggggagccgcccacttcgccgggtcgcgccccgacggccggagcgtggatgcggcggcgcccgccgagccggggcggacgcggggcggcccgggcccgggagacgcgccggcagccccggcaccgcagcggtcgcaggatggccgaggtaagcgcggcgccctccgcgggcgcggggattctctgtgcgcggagcaggcggcccgggacgccgctgggctccggctcccgtgggtacccgagggccacctcccgagggccagctggctacctgcgcggcagcgcggccccgaggcgcggcgggagggaccgtggtctccggccgggaggcggcggcgggggggttggggctctgggacccgtccctgcccgacgtcccggagctggcaaacggtctccgcgccggatctgcgggcgcgtcggaggtgccggcgggccagcctgtggaaatcggcggcggcactcggcgggtaccctacacgccactctctgccgcccgcaccccaggcttcagcccaggacgttaggacttgctgtttccacctgtgggggtcgaccccttctttttttttttttcttttacctcagaatttgtgaaacagctgatatttcacactggccgtctttctctccggggattgtttctctggagaacggggcgcgcggcagcctccggtcactgaggagaactgcggagacgggcgggcggccgtgaggaggctcccgtccactgcgggacaaatcttttgtagagcaacaacaacaacaaaaaacaaaacaaacccacaagaacaaaaaacccacgactgaaagtcgctatttagacaggtccggtccgaaagcttccgggacacagaccgagcgttgaccgtgtgcggggcagatttgaccagcttcactgcggaccctggagtccttgtcgcggctccgcgcgaggtggcccgtctttcagaaagcgctgggacggggctaaggcgcttgggctctgggctggaagccgggccgagccgcgtccgccgctccgaggttttcctggagtgacaggaagtgggcctgggctgcggagcccgcggctgcgcctgccgcttccttcaggggtttgcatgggaagcgccgggacgggaagcccccggcccccgacttcgagctcccttaacagtcccgcccagcctggccttgggacctgcgagcgcgtggctcgcccgtctcgggagcgccccgtcggttccgtgctgggagccgggcggcggcggcgaggctgggggccgcgggcggagaaggaggaggccgctgcggggtctcccgctgctcctccggagccgccgcccagacccggagccccgccgccgcctggctttgccggagttcctcgggatttgtcagccagatgtgacaagattgtggcgaggcgagtgaaggagatctgatattaatcagcgcgtagctccgagccaaactttcacaaatgcggtgtagaaacatgttcttctcatttaaggcatctctttgtggctgcggggctgccaccgctccgagtctgacagttaagtggaatgccatctcccagccttaattgtgtgagtgaagttgtgtgtggttggggggcggggggcatcagacgctcgggggttcggtaacgtcccctggttttatggctgtgctcgcctcagtcctctgaaggccagggcatttaaagcggcccagacgcctggtctcagccaggcctcttgctgttaacacttaaggggcctaaaagaggccccaccggtgtcctgggaatccctgtcagggagagagagagtgtgtgtgtgagggagagagaacatgtgttactgcataggaccacagagcagatgtagcaacaatttttttaaaaatatattcttttcatcaaagcgacaagattttggcttgacagtaagtgaattgaaaaacagcatttggcagattttttttcattcgctgtttatttaatttgctattcgattttatgggatctcttgataagattctaagtcttcgaccctgagtttgcaaatacgtgttaatgtattgaaacttttgttcagtgatggatacactgactctcttttcattgatcccttcccagattcgttgatacatattaaaaccttgttaaaatagtttgtcaaaataaaattttgtacatcatataaaagaacattacttcagatgttacaaattgtactggatttgatttgctctttaaagaggtgtgaaaagatggcttctccttttgtgatgatgaattttaagaaataactttattctttttggcatactttcagatggttaaaacgaataagatacgagtcatcgtttgatttctcatctaataagtttgctaactaatttcaccaagaaactattactatttcaagtcaactgttggttgaacgtgttcctgttgtagttaaatgctgagaagaggtggtgaaatcttcacctagcacacatgatgctcacactttgggaactcgtaattatgttcaggcatctgcataatttaatttgaatatcatctgtacctatagtgtcccttcagactagtaaggatttagggacattctcctccttcagaaagtggttaaagttctttggccattgatacctacagtgatctgtttgctgtggttataattctcattagaaatattgactaacatgaagtaattgccttggaagcatgagatttactggagggctattttatgttttattgcatctcccccatgtagcagttaggcctgcatcccaggcccatgcccactttctgtacctcaagatcatcagattggaaagacgatccaacccgatagatgagagagaaaagccatacaggtttccctgtggaacaaagtagttgtccctaagcacacatttgtcatttatgaatgcctagggataagtataaacagggaaacattttaaaagttcaatttgtcagtaaaattaaactgcagcttatggagtggggggcagaagtgtcttttagcttctgtatgtggctttagaagtaattttgatgtggccattaaaagggatgccctgaaggttccacagggtaaattacttacaggagtgtgcttcaccccagggtgaattttctcctctacagatgtcatttagagtgggttacttttgtcagaaactgtcctttttagaaggaactgaaaataccttagctaaggtaaaatctcaatgatgagccacccatctttttagtatctaaaatcaagattttagggagttggtacttttcttttaattacgtaattccaagtgttctactgcagagtttttgtttctttatttttgatgacttctctgagagatgttaaagataactggattctgctcaaaagaagcatctggaaagcatttctttttccttttaaactggtttccacctgaaaaccttatttctgcatatcttgtcattctttgaagtccttttcctaattctggaaattccaagcttccactgtggcaccatttctctgcacggacacatgcctatttcagccgaagagggtgggtataaacagagaacagacttgtttctccagggtccaattttgggccttctcaaacctcacatagttagttatcggcaaacagactgtcactcttgccgtctacacatggactcattattataaaccagcctaacaaatcacaggaggactctgccttggggaaatgataatttcattcaactaatgtgaaacaaaagagagatggagaaataaaatgtgagggtcaggtccaaacagccctgtccatagggaaatagttgcctcaggtaaactcttaattcagggttctaacattttttcatatagttagattagtttgatggtctcctacagattatttgtgtgatcctaccaaatactcaaacctcaaatttcttttctagttgtacatcagcttccggaagtgttgtcctttttctgtagtcctctaattgtttcttgcattattcattatgaaggtaaaatttttatactgtcaactcttagcatttcatgatacttcacactgaatttgaagcaagggatcaggatggcataattaactaagtttgatcttttctttttaaaaacttagtttcaaaaacctagttctcaatgagtccccaaaagaatgttttacaaaatcttacttagaaatgttcacaatttcgtctttattttgtatcagcagcagtagtgaagttgcattgcttatgtaacttaggtaaaattatgctaaagtgtaagtgttttgctctgtatttttttcctcaggctgattcaactatgttcggaaagttccctttacatgcaattaatatcttttggttttttgttatcaaaggtttctaaagattacctctgaggtttcccaaattaggttataaaggaaaaaatatatccatataatttacatttctgtacagttcttaaatttttttaaagaagaaatatttggcttggcttttaaggtagtgtttgcatgtttttcagctatttcatagattttcagtttttgaaactaataattttaagaaaaaaagcacagacattaaattattttggcacacagtttatactttgattcatagacatcaaaagaacaagtattttccccatcacagtctttgaactaagcagctagagaacactacaaatgtgtcatgcatactttaaactcacaggtagactcagcccaatcaatatctgtcacttgaaggagctctacctcccacctgccctttctctgccagacccttctccatgccctcagtctttggtctctcatttcatcctcatacttggagtgagaaaccagattttgtccattctcctttagtgttgtgtttatattgcaaatgctgactacctggtttctgaggctccccacatctccttttaaccatgcttgtggtaaacagtgcctccccattgtagaaagccaatgatcctatgaacccaataaagagactcctggctgctcatctggacagcccaggcccaccttattttgtctttcaaggtaggtctcactgcccgtaacagagacctgtgctctgtggcccaggctccttggcctgacacatatgtacatgttaagctttacattgtacctaggcttgtggtatttcttgcatgcactgatgagagcatgccttcttcctggaggaagccctctctggcctctctgtacaaccttgacttctccatttctcctatcccactcaaactatttaatttgggggagagtaggagtttgacttatttttttcactttttattatagaagatttcaaacaatcaaaattagaatgaaacttgatgtaatatgtgcttggggattcaacagttaccaactttgggccagtctcatttcatctgtatttcctacccatcataaccaacactagattactttaaagcaaatcctaggcattatataatttcattcatatatattataatatgaagctctaaaatacaaaggctcttttttaaaaaaccagggcaatataccatagagcacctaaaaaattaacaataactgtaatgtcattaaatttctaattggtgttcaaatttccttgattacctgacaaactttatattacagttggtttcttcaaatcaggattcaagtaaggtccgtacattgtcttttttaatatataggttcatactttacttttttccttgcaatttatttgttgaaaaagctggatcatttgtcctgtagagtgctccctggtctgaatttcaatgattatttccttgtagtatcatttaaacattcctgtatctcctgtatattcttaaattggagttgagtaagaggcttgatccaattcaggtttgaacttttttatcaagaacaccatatgtgtggtggtatgtatccttcagtccagagacaaatggcctcctatttttcattaggagttgcggaatggtgatactccagttcttcatttatttgatccacattcagagataatctttgtctcatcaatgatttttttaccctgaaatacaggttatatagcaaaggatacacatttgatttttttcctttgtttaccaattttcagaatagttagttggtttcctagcattttctaaaagtggccaatgagttttgtttgttttgagtatattttgaattcctagattttaacacagtgaatgactcatgctaatttttgacaaatcatattctctactctgctgtttttgaccaacccagttgtgtgattttttcttgcagtcattcaagtcttccctagtgtcagacactggcaattactcatctttgtatctccatgaagctccccatggttaccaagtacatagtagatgctttagaaacaaacaaataaaaaccttgttaaataaatgattatcattttcttaaactattagtggaagatgatggcatgatgtgttgagtgtctgccccatgtgtgtttctcaaggtcagctaaagtccgacactctcacctgcagataagctgcctcacattaaaggacttagtgggcttcacctctcttcttcccggttgtccttattacctatttggcaaagggtgatactatttttcagaatcctagttgtacctctgtgggttttcatatgtaagaaaaacaatgggaaacttaaaaagaaaaagtgaaaggagtgaaaagtgagaggtgggaaggtaaggagaaaaaaaaaatccagttctaataaggaaagtaagaagtgcagaggcaaagtagctccaaagagcagtggggtagagaattaactcccacccttgaatgatgcagtttcctaaaccaggaaggnnnnnnnnnnnnnnnnnnnntgttttatgtgtcctgattggcagtttttgatatgcacgttagcaacaattatctatattcaacatttaaaaagtactacttagaaaaaactggccaggcgcggtggctcatgcctgtaatcccagcacattgggaggccgaagtgggcagatcatgaggtcaggagatagagaccatcctgactaacatggtgaaaccccatctctactaaaaatacaaaaagttagccgggtgtggtggcatacatctgtagtcccagctactcaggaagctgaggcaggagaatcacttgaacccgggaggcagaagttgtagtgagccaagatcccaccacagcactccagcctgggcgacagagccacactgtctccaaaaaagaaaaaaagtgaatcaggagttcaagaccagcctaagcaacatagtgagacccccgtctctataaaaacatttttttaaaaattagctggttatggtggcatgcgcctatgtgagatttgggagggcgaataaagtgggaggatcccttgatcccgggaggtagagactgctgtgaacagtgatcactgtcctccagcctgggtgacagaacaagaccctgtctcaaaaaaagaaaatcctgaagcatttttattgtaaacttggtggctgttaaaaagtgatttgtggtttgccagactgggtttttaaatttaaagttgaagagttacgatttttttccactgagaatctggcatagccttagaatctcacacgtaagagaggaccacagactctaaaacttaacttcggtgatctctgctagtgagtcattttccacgtggtttttacatggccctctccatagtcaactggaagatcagtgtgtaaactagaaactgcatttggctgcaaattaaaagaattcctaaataatagttgctactctttcttctcagccatccttagggcatgacctcggtattgcctcatagtcacaaaatggtatctgagctcctgccatcaggttcttgttccaagaaagaggaagagggaaaggcagacaggtcttacagtagagtcatctgctatttatgaggagttttctacaatacttcacccaacaatttgtattgtataccattggtcagtacttaagtcacctgaccaccaactgagacttggaaattaaatttatttttactaaggcatattggggaaaaagataactgggggaaaaagattaataatcagtaagcatagtacagttctctcattgatttgttcaatcattcgtttactttctcagataataccagtggagggcttaccaagtatcaggcccagtgctaagtgttggtttggagttttagttgtttcattgcctcttgcaggaatgattcattgtgaagcaacttttttaggggcttttaccttagatatttttggtagctctgtgcagagtcggacaaccagagcccagaagaccgaagaacttacttgttgtgggtctggcagcagtaacagtctcactgttttgattgattgcttcagctccccatctgtgtatccacattaatatggctaacaggcctctgaggtaggcaggagtaggtttccagcccacatgatggccaaaggcaccaaggcatggagctgaagtttttacatggcttaactggaagtaagacataggttgaggccaatcctaggttttactacctctcagtgaaaggtgcccggtgaggtgaacgggaaggggctcgggctccccagccctgcagccagaggtatctttttaacagggagattatattcatttcatacataaaaaaaaaaaggcttactgttaaaatccagactccttcacctgccccacaaggtcctatgcacagtggtctctgacacctgtcttattctcattttctgctaataacctcaacaacttcactccagctacattggccccttaactcttccctgaacacccatctctattgtgcctgagagcctttgcacttgctatgccttctcccttaaatacttcctctctctccagtctgcacatgaccaactccttggcatgccttgggactcaattcacatgttacctcctcaaaggctcttgatgatgactcaatctaaaacattcttactcctgtccctatccctccatgccacccagttaaatcattagcatagctttcttcttagttttttttttttttttttgagatggagtctctgtcgcccaggctggagtgcagtggcacaatctcgtctcactgcaacttccacttcccgggttcaagcagttctcctgcctcagcctcccaagtagctgggattacaggcatgcgccaccacgcctggctaatttttgtatttttagtagagatggggtttcgccatgttggccagtctggtcctgaacccctgacttcaggttccctgcctcggccttccaaagtgctgggattataggcgtgagccactgcgcctggcctcttcttagttctttcataacacttgccttattctgaaatgatactgtttgttgttcatttcctgtctctgccctttagaatataagctccttgaaggtagggaccttatcagttttgttcaacattttaatctgtagaatttagaacaatgcctggctcataaatgctcagtaaatacttattcaatgaatgaaatgtctttactgtgtggaactttaatgtccccatctgcagaatgtgtatgataatacctaactctgaaagtggttgtaggaattaaatgaaaccataactgtagttagcaccaaatactgatatttcaaggcgtaatcctcccctagtatccaaatttgagaccatcccagtagcctgtaagttctttaccttcctcatctataaaatcgggatagtaatacctaatctccctgggtagttgtgagaaagaaatgaaataattcttgtacactgattagtacagtatctcacatgtaataaatgctcaataaggctcaccaactgcgtgaccctgggcatgttacaaatcttccataaatttaagtttctgagaataattctctcctcacagtactgtagtgaggtttaaaatagatcacatgataaaccacgtcaaaaagcagatgctggaagggtggctaatctacctaccattgaactcagccttgtccagtagagctttctgtgatgatggaaatgttgtgtatctccactgtccaatagagtagccactatctacatgttgctactatgcacctgaaatgtggctagtgtgaccaaggggctgaattttacattttatttatttatttattttgagatggagtctcactctgtcacccaggctggagtgcagtggcgcgatctcagctcactgcaagctccgcctcccaggttcacaccattctcctggctcagcctcccctgtagctgggactacaggcgcctgccaccacgcccggcaaattttttgtattgtttagtagagacggggttttgccgtgttagccaggatggtctcaatctcctgacttcgtggtccacccacctcggcctcccaaagtgctgggattacaggcgtgagccaccgcacctggccattttatttaattttaattaatacaaatgactcccttcaaagggccagtgctgtgaatctgggaaccccaaaattccctcttccccttaccagttagtcccccaggaatatccccctgggtttatcttcagtgaaatgaaagtatatgcacatactagagatgaaaacagccttgaactaaacagtttttattctgagctcaattcaaatcccatgagagacctactctgtctggcactgaatatctatgtatatacccaactatgtgcctagcctgatcactgccaggaattcaactcagcatctcctgacaagaggcctgtggtagcatctcctcaagccaaaggtagaacagggtgtccgagagaccaagtgggtccaggagcgtgcctaaaaactaggtcataactttctatcccaagactgcaaaacccaatcttccatcacatactaggtgtgtcagtagtttttagataaatgagaaaacgatagttacgaaaaagcaaaccaggattttgaatgttgatttgtagcacatcaaagtgattaataacaattctgaaaatagtctgattaagatgagtgcattaaaaagcaatgattgtgtcttgatgagttcagaatgttgtaaacatctgctttatgtttctgaagaatggaacaagaatggattccaaaggctatacattttaagagttttccgttttgatttacatgagtactttttgtcctgtaattagaatattttcatttaatttcattttagaagttttcatttatctttagataatggtgctgtaattttactatgtcgtggagttctaagatgggtggaaaaacccaagggccttgatattggaagttttcttagacactgtaattagcttttttagttcataaataattcctctgagatttatttccatagatgtttaatgagctttattaagccttattcaaatgggctcatggagaaccacaagaatatttctcataaagctgcattcattcattgaattatagacaaaattatttaaaattatcccgaaactgaagctaaaattgcccccaaactaaaactataggccccaaatgcccatgggagtggtataggcccccccccaagggcatttggtagtgtctggagacatttttggtggtcacaactggagggtagggtgtaactggcatctggtttgtagcagtcagggatgttgatcagatgtcgtacatacagaacagccccccactacaaagcattatccagccaaaatgtcagtagtgccaaagttgagaaaacctgacctaggtgacgagatgcaaaaaataagtttcagtattaatctatgaaatgtgcttggaattgttccctctatgattttgctgtgctgaacctgagacagtcacctggtttcctgggttgcgtgagccttttgagcagagtcttcaggaagcatgtgcttaaggacatctctacttctggttaaagcaggtcttattttccaaataagcaaaatgtgaatttactcatataattccaacatcttgtttttaaagagtgaatggggccctggtgcagtggctcacacctgtaattccagcactttgggaggccgaggcaggtggatcatctaaggtcaagagttcgagaccagcctggccaacatggcaaaacccgtctctactaaaaatacaaaaaaaaaaaaaaagccaggtgtggtggtgcatgcctgtaataccaactactcaggaggctgaggcacaagaatcacttgaacctgggaggtggaggttgcattgagccgagattgtgccactgcactccagcctggccaatagaatgagactccgtctcaaaataaataaaaattttaaaaaaaggaatggcattttgagggatataatccaaaataagaacttttctcccttttaaaatttttctgtaaaatggtcatatttatagaatcaagattgtgaaatatttcagaggtttagtactgagtgtactggtgctattgagaatgtagcaataattggttcatccgtgagctgatgttcagagggttgcagccaagtttgagatgctggacaacgttttaggtgtattacaaactaagttaatcgtgccttttagaatttttgttttgacagtgtgtaatgtaaattcaaccatcactcacttgtatcctttaacttacattcaaggtaactatataattatgtatataggtatacttacatagatgtatactgttcatgtatttaatacatttgtatgtgtatatgcaagtagaaactctgtaaccaaaaagtaaaatagtttctgtcattagaacagtgtttcttgattttttttcattaacctccacacctaaggagattttagacattttttcttaattgtgcctctccaaagaaattttaggatcacaccattgcgatataggtttatgtatgtatgtacatctgtgtttatacatagagtaattctttcaccccccaagaccaatttttattcctttggggatgatagcatcacccttgagaatgcatgcattattaaagtgagtgttaatcacatggagttttttgtattatactgtacagtttacaagagcaaaaccttttctcccacatttcctgttttttggtagcctcttgaatggattaggtaatgctgttgctatttactgtacacctcagttttaaacagccctattccgcatcacctgaaaatgcctagctgcagctgtgttcaaacccattctagtccaaaataaatcgtagaagacagtcaaatcatgaaaaatttaacctgtatttaagcagggtcactggtttttttgttttgttttttgaggcagagtcttgctctgtttcccaggctgcaacccctacctcccaggttcaagcgattctcctgtctcagcctcctgagtagctgggtctacaggtgcatgccaccacacctggctaatttttgtatttttggtagagacagggtttcactatgttggacaggctggtcttgaactcctgacctcaggtgatctgcccacctcggcctcccagaatgctaggattacaggcgtgagccactgcacccagcctgtgttttaataatatttttattgagatgtaattgacataccatgaaattaacttacagagtgtacagttgagtggctttcagtatattcatagagttgtgcagctatcactgctatctaattttagaacattttcatcacctcaaaaagaaaccatggtcaaaatttgaaacttctgtgcttcaaaggataccatcaagaaagcgaagataacccaaggatgggagaaagtgtatgcaaatcatatatctggtaatgcacgtatatctaaaatatatgggggtcttgtataactcaatactaaaaaggtaaacaacccaatttaaaaataggcaaaagatctgaagagacatgtctccagggaagacatacaaatggccaataagcacatgaagagatgctgagcaccattcgccatcaggggaatgcaaatcaaaaccacaatgagatctcacccacagtcactaggatggctctaatgaaaaaaacagacaataacaagtgttgatgaggatgtggagaaattggaaccctcatacgttgctggtgagaatgtaaaatgatacagctgctttggaaaagtttggcagtttcttaaaacattaaacaagagttactatgcaatccagtagttctaggactatacccaagagaagtgaaaacatgtgtctaccatattattgtacatgttccttttggggaagatgaaaatgttccaaaattagattgtgatgatggttgcataactctgtgaatatgctaaaaatcattgaattgtacaccttaaatgggtgagttatatggtatgtgtgaattgtatctcgataaagctgtttttctcaaagatgaaaacaaaccaaacaagaacacactccctccaactactacccactagcagtcacttcttatccataccctactctccacagccccaggtaactactaatctggtttctgcctttatcaattggcctgttcttgacatttcatgtaaatagaatcacacagtctgtgacttttgtgcctggcttctctcacttagtacataatattttcaaagttcatccatgttgcagcatgtatcagtatttcattactttttattgttcagtagtattcaattgagtggatatatcacattttgtttatctgttcatcagttgatggatgttggggttttttctactttttggctattgtgaataatctgctatgaacattcatatacaagtttttgtagacatgtttttggttattttgggtatacaactaggagtggaatttctgggtcatatagtaactctatgtttaactttttgaggaactgccagaatgttttccaaagtggctgtaccattttacaatcccaccagcaaccaatttttaagtggagactgatcatatactccttaaaatgaatttcccaagtcttcagctagattctcctttccctctcccccatgcagggccacatagtccctcaattggcagattagaggtttaaaccttaattgtaaggcttttttatccctcctccagatgcgcgcgcacacacacacacacacgcacttcccagtttcaagactcttgtgaatcatacaaattctacccagcagctcttcccaggaacctcactgacaaagctgctttgagggctttttctgtttaataatagattatattcttcagtactgtatctcctttgagaaactcatcttaaaaatatacgtgaagctttgtgggttttgtcattgttgtttttgtttttttgagagggagtctcgctctgtcgcccaggctggagtgcagcggtgtgatcttggctcactgcaacctcagcctcccgggtttaagcgattcttcggccttagcctcccgagtagctgggactacaggcatgtgccaccatgcccggctaatttttgtatttttagtagagatagggtttcaccatattggccaggctggtcttgaactcctgacttcgtgatccacccaccttggccttccaaagtgctgggattacaggcgtgagccaccacgctcagacaaagctttgtttttaatactggaactttgttggacatgtacatctctattttcaatttcagctatatttttgtacattctatgcccccacataaaacatggcaccataacatgcaaggggcattgatgcaaggcttgttcagcctgtgtctgtctctgacagtcacatagttcagtgaatggcgtcagggaatcatcctcagtgtagtcagctattacatgttctcaaatcttatttgtattttcagcttctaccatatctgtgggtggggggaaataaattttatatgtagattactctcagttcatattattctcccttttacttgttccaagacagcttctgtatactttccagggttgctgctttagtcaacttagaaatttggtgaaaatatgtttaccctttctatgagcttaataacagtgcaggagatttcattctaacccataatcttttcttataaaaagttctgatgtttaaactcattcttgaatgtggaatatctgtgtaatgtgttcacggtctccaggtgcaggggtggctgctcatctttccagagtacaatatacacttctgggcctggcacacagtgggcacatattgctcaataagtgctgccgaatggaggaatatgttttgtttgaaatacaatgaatgtttcacacatcacttacatgctccacatacctgttttctcctctttttcaggctatcagctgtactctgaactgtagttgccaaagtttcaaacccgggaaaataaaccaccgtcagtgtgaccaatgcaagcatggatgggtggcccacggtaactttatttttcaccctctcttggcctgtagtgttacctctaagtaacttagagttattcaggaactgatttaatatcttaagaatgacaactaactagtaaactagtaagttactagcatgtcccaggtaacaggctaagattcaaagagtcttgaatcttaactactctatatgggaagtgtcttattaacctcattctaaagatgtagaaactagtgcttcattgctatcattctgtaatgatagaagtattctgttctatctattacagcctctaggctaggattgccagataaaatacagaacgcttagttaaatttgaatttcagataaacaacagattgttttttagcctaggtatatcccaatgaatatttttagtatatgtatatcctacccattcattgtttatctcaaatttacgtttggatttaactgggcatctttttttatttgccaaatctgacaactctacagtagtcacttgtggctactgagtacttgaaatgtgactagtgtaactgaggaatggagttttaaattttgtttaattttaacttaatctaaatgtaaatagccatatgtgactgatggctattacattggacagcgtggccttaggggggttaatttgttaagccccacaactagaaaatgtcaagccccacaactaacgctcaaactcaggtctctcagattcccaaacccagattctttacccccagactctatgcttcctgattagctattctcttgattatgcacctcccacctcagtttttaccccttttccttattccttccttgtttgtgactatttctttccttagcaaggccacaagaaagggagaaaagtctcaggctagttcatgtattttagaagttcctgtaaataatttgaagtttcatagctattaaggtatttaatcatttgtatattcatgtattttctgtggaataaataaccaagaattggtcctaacctacttttttttgcagtgtttctcttacaattagaacttttcaaaatgacatttcctcaatttgatttttcagctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggtacagtaaacatgaacattgtcctcctagggtgctttctgaaatttgtgcccatataactgacgtaacccagttacctcccaatgctacagcccttggtggccatctttccctttaatacttcttttctaatggcctaagcccctacctcatgttcttggggggagtccaaggctttcctccaagatacctatgaagctttaggagcattacatattctctgatttggcttttactaaactacctcttccacaataaaccatttgccccatttcaggtgctgcctccatgtctttcattagtcccaaactacttactgacacaagatctgtctgtatcagattttactgagagtttgggattgagaaagggaacttacatgaaccacacagcaaacaacttataatttcatagcacaccttcctgttctttaaagccttctgccatctcactgatgttcttccttcttaggctctattttttatatttctgtgttcatgtatgcatttgctcattctcaatctctctctctatatgtgtgtgtgtgtgtgtgtatgtctccctccctccctccctccccacaccccagttttcttttggcatcttcatatattctcttcttttctccagtattccaagcccttcatcctctctgtcctctttattttgcagagtagtttacctctgttcccagatcatgctgagtgtgtaggcttcatgtttcatttccaaagaggctatcaaggtgtttttagaagcaaagaacatgtttcctgagatgaagcatcattcctttaagatatgaaacagctacagcattgtattttcttgccattacattagaaaatgtcaaagtttggtaaaaatttcaatgaaatgggaggcgaacatatttccaagaccaacatagatgtcagtcttactgaggtaggccatgtaattaaaatgaacactaaaaacaattttgtagacctagatccactcccaataatcttaagcttaggcatattatccccattttccagtcaaaaaaccagagacttagagtgcctcaaaatcatgctgaaagtcatttcactagtatgtggcagacccagaatttgtactcacttctttttaactcaaaagaccataatcttcccctgtaaaaatgtttgctcacctctagtgcaggacccccagcagactagaaacaaccgtttatgtagagtagcattatgaccttacgttaggacatagatcaatatttaatgatcctaataatcttgctttctagtgttaggattaaaaatatggaatcaattaccttgaacctctagtgcatgaaaaatttatgatgttacattcttcatcatcttcaaaactcttacatgcactgtgaaaaatctcagtaggccatcaaatacatgttctgtgataaaatatttattgtagttttgggaaaagttaggccttgctagagtttgaaagatctccaacactccagtgtaattacagccctgctttgtgaatgtgtgcagtagatcaatacagttcatttgttttctgatgttagttgcttaggaagattattaaacttgcagcaaatgaatacttgagctgcatctaggcctgattgttccatctattctctttagataaagaagttactattgttcaaatgatacatattttaattttagcagggaaaattattatgtctaatgctagacaagcaattggtctgaaatgaggtgaaaaataatcactacatttccctgacttcacttgagtaatatggttttatttgtctcttttgcaccaattgtaggactactgctaatatttgtgcagcttatgttctgcacaaagcttctggcctgggagagtagggtgagcagggactaaattccccaaagccctgcattcatctttttcctatatgcacaaaagtatcccatagtctagtggactacatttttagaggaaagggtaaggagttgtaaattgatcacacttctaacatctggtttgggtttaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacaggtaaggcatctgtaggcaatcattttttctaaggcagtggctcttcaagtttaacatgcatcagaatcacccggagaattgttaaaacacagacttctgagccccaccctagaatttccacttcattagatctagggtgaggcctgagagttggcatttttaacaagttcccagatgatgctgatgttactattctgggggtcacagtttgagaaacactgttgtatgaattttcatatttcaacattcatgaatacaagttcccagatgatgctgatgttactattctgggggctacagtttgagaaaccgttctatgaattttcatatttcaacattcatgaatttttacttccaaaaacctaacctaatttggctgcaaaacctgacctgaagtgatgtgaggctacttgtaatcttctttaatctccttttgtgtggatttataaatacatatatagtacaaatagtaatggatttattatagggcattaacaatgtttcattatatgcatcattctgcctgtctgaagtctgagaaattctgaactcagaaacacatccggccacaagggtgtgggataagaaatcatgaactatggccaggcgcggtggctcatccctgtaatcccagcactttgggaggccagggcgggcagatcacaaggtcaagagatcgagaccatcctggccaacatggtgaaatcctgtctctactaaaaatagaaaaattagctgggcgtggtggcatgcacctgtagtcatgtcccagccactgggaaggcagaggcaggagaaacgtttgaacccgagaggcagagattgcagtgagctgagatcatgccactgcactccagcctagcgacagagcgagactctgtctcaaaaaaaaaaaaaaaaaaaaacatgaactagttgtcacattagcaggttgagtaaagcgtaaacaactatttgaataagagtgagaagggagctttttaaattgccactatagcgtcccaaaacgtgactcattttcatttgataatatgaaatccatagaataaaatattttcctttatttctagttacccagctacatttgaaaggaagaatcactgcttgattgaaggttttttaaatattaagttataaaagaataaaggtgattggcaggttgtttcagggactgtgatttctggttgaaagatcctgagttttcatgacacacacacgcaggcaaactgtttacaaagtcccccgctatagagcatatctcatcaccgtggggatagcagtggtgttactgtcttgcttgtgcttttcttcatgaacttgagtcacctaaccactcttcaggtcaccttcctccctagcctataaatggaagagcaagcataccaaaagatggccccaggaggcttatggaaaagatcagctgcctgatgaaatggaatatgataaatgttaaatggtacactgaatattaaaatgctacatttgcagaaacaagcttgacttgaagcagttcaacaccaccacttggtccaagttgtaatgcctaatttgttaagagggtgaaaatgtacagactcccacacacattcctggacagggctcataagaacatacttattgtctttagcaaagaggatagagcacaggagatattagttaaatgtttatattaaatcagtgtttctactgataggatgttgaaccaaaccaccaaggcaccctaattagtgaaccagtccttcttcagcctccaagaggaggagtgtttgttcatgaataagctgttgctacagagacagtcatgttggtcatattatctttgatatttatgatactgttctatcctacaatatctactaaattggaaggcatattggattcaagatactttttcatttgatatttattttttcatagatttaatatttccttatgttctgacctatttgtattaatagatccgagccttcccccaccacaacaggaaagcatcttgcgttataaattaaaaccactaattagtctagaacttgaaaatgcattttacctagaatctatgatttaagttacagtattttaaatttgactttgtgggcaggcccagacctgacaccatttctctcagtcagagattgagaaccacattcctgtagggacatttaacttctctttgagccactgctactgccagcaacagttaccaagacccatcaggaagggactgggacaacaccctggatgcttatttacccagcaaatattaagaactgtctatgttaggtgctggggacataatccctgcccatagaggccttctgtagtggaggagacagaccagaaacaggcaattacagttgaatgtgattacttctgcagtgaaggaaatgtaggctgttgtgggagggcaccttgagaagttaaggaaagcttcctggaagaagggatatgtctacaccagtaactctgaaacgttttggtcttataacccctttacaaatacttaaaacctaaggttactcaagagcttttctctatttgggttatatctatcaaaatttatcatattagaaattaaaaatttaaaaattgtaaaactttaaattatatattaacatatgtttatgaaaaaaaccctacattttccaaagcaaaaatttagtgagatgagtggctttgttttacatttttgtaaatctcattaatgtctgacttcgtagaagacagctagattctcatatctgcttctgcatatgctctgttgcaaaattgtgttacgtagcctctgaaaaactccactgttcactcatgagacaatgaaagtgaaaaaggcaaataatatcttagtattatgaaactttgacttcaggaaccccctgaaagggcctcagagatcactaggggtgctcagaccacactttgagaaccactggtctcaactaatcaaaatagaagccaagaggaagagttggaggggagaggtagaggttgtagggttgaagggaagagatggagacatgggcagtgagtacaggattaggagagtcctagaaaccaaagcctggcacatgatccagagggtttttacagttgtagtagttactggtcttaggggacatggcacctcaggaaatgtatctaaccctctaaggcttgagaggagcgagagcccacaagttagccattagtatgcatggaatactcaggagttgagtatgagtcccagaggtttgctttgttccagtagggacctttctttacaaggttccaataaaagtgtttgtctttctttttaaccacttgtatgtactggaacctgtacgtccacccagtgtctggttttctgtcggcacataccagccccttcaacccagaatgctgacataatcacagggcagagttggagttaagaagggctgcttgcaaagtgggtgatctgggagtataattctgattatgtccagaatatatgtgtaagggaatagaagacagaagttgaacagtaaattttgtacattttataaaacataagtaagcttcccacacacgtctttggggatttaaaaagttcaattcttagttattttggtgaaggtgttttcccaacttgactctgccatacattctgatatgtattgggggagtgttttctctatttggaataattctcctatcacctttaagattgtaacccccttggtaaggacttttgcttgtcaaaagttagcagaggatttctgaggaagaccaacattgatttacaagttaattccaaatgataacatatgactaaaaggcatgtgtcataatggatactcattatctgtccttcgagagtaatcattgggtggaagattggtggtatgcttattctgctgcatttgcaaaacttctgtctggtataggatagtgaaacgttacaaatatgaactaaactacatacacacacaattctagccaattggattctcaaccacacttttagaatttttgggatgaagtgtatgtcaatgctcttgaccagtgctatccaatagaaatacgatgcaagcttcatatgaaattttaaatattatagccactgtaaaaaagcagatgcagtaaaatttaataacatttaacttcagtatatccaaaatattatcctttcaacatatgatactagccacatttcaggtgttcagtatccatatatggctagtggctatcattggacagtgcagccccagaaggtaatgtttcctgatttcattgaaataaagtccttttcttagttccttatagtttgtgaccagttttctcctgggatctcctggttccagtgtcctagttaaactagtctagttgatttagtctagtcattctgggagacagaccagaaacaggcaattacagttgaatgtgatgacttctacaatgggggaagtgctgctgtgggcacatgggagggcaccatgagaagttaaggaaagcttcctgggagaaggggtatgtctaaaccagtagctctgaaacagtgagctcatttacagaaaggacatgaggtacagaaagtacatcaaacagacactggaaatcaaagaagactacatattctcagtatccagactgtcggctttcctggtgaacactaacttctggcaagcaatgaacaacagtgggtctgtatccaccagacaggtgttacatcccatgggggcctacccccttatcatcggtgctcccataccacatgtttttcctggtatctaccaagtctctccactcagaatgatgactgtttctaaaacagcccaacccattactaaccatcttttcactcttgtagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacaccttttgtttaaaaaggcaaacatttgtaaaaatggttttgtcatatgggctgcgttttgtacaagtgtatatccttatgcacacacacagagatgcattatgaatttgacagagctgaaaaccctggagggtgggggagagtttggtggacagggaagagtgtcagtaactactgacacatcaaacaaaagttgcagaaattagtgagttcaaaaagaaaagaagtggttacttcattgggagggggatttgggtgtgctgatcttttatcaagaaaaatacagcccggtcccagtggcttatgcccgtaatcccagcaccttgggaggccaaggcgggcagattacttgacatcaggagtttgagactagcctggccaacatggccaaaccttgtctctactaaatatacaaaaaattagccgggcacagtggtgcattcctgtaatcccagctactcgggaggctgaggcatgagaatcacttgaacccaggaggcagaggttgcggtgagctgagatcgcgccactgcacttttgcctggcaacagagcaagactccatctcaaaaaaaaaaaagtgattaaaaaaaaaatacagtgctatcaaagagaaatctccaaatgctccaaatagagtgcagtgaaaaaaatgttaagcctcttcttaaaaatgcaggtttttaaaaaaaacagatttttgtaacttttaattttttcaccttttttcctagtcttccaatatatagataagagtatgatcctatctacccatccagccccactctcagttgatgttcttgcttcatatttcactgggagaaaagttatcagagggaaactaaacacatctaccatcatctgtactgttctccccctactctaagccctgtctcctttctgaatgattgcagttgcctcttaactgatctgttgtttccattcatacattctacaatggccaaagtggtccttctaagatgtacaacagatgatgtagtgcctcatctcaaaaccatccagtggtttcccttaacagttagtataaaatccagtctcccaaggcctacagctttgtcatttggaaggttcccacccctgctacttctccatccccttttcccactagtctccttacattttatctgtcaccagctttatcttccttctcccacagttcttctaaaaccactttgcaagatcccaccccaccaactctccatattcacagtagctggcctcactgcctactctcggataattgagagacctcctcccccattgcccaccacctccttttcagtttgtgtataatgacacccatcttcatgtggtcatatctgcctcaacctcctgaaaatccaccttatgcctggtgggccgtcacagtaagctgcaaacatctctatgagaaagttaccaggatcccaccaccacccattttgctgtcacattcagacccatcatgatctccctgggctcaacacctgtcattgagggatctgaaattccctggctcagcctttctggttttatccacttgcgcctataaggggctgtgtttgggtcctccatgatgccgatgccaacagggctaaatgtgcatggattttattaagataaattactttgagatgaaatagccgggctgggcacagtggctcacgcctgtaatcccagcactttgggaggccgaggcaggtgaatcacaaagtcaggagatcaagaccatcctggctaacatggtgaaaccccgtctctactaaaaatacaaaaaaaattagccgggtgtggtggcaggtgcctgtagtcccagctacttgagaggctgaggcaggagaatggcatgaactggggaggcagagcttgcggtgagctgagatcgcgccactgcactccagtctaggtgacagagcaagactccgtctaaaaaaattatatatatatatatatggagagagagagagagagagagagagccaaggaaagctgggagagccagc

SEQ ID NO: 15240 - DNA, 47968 bp, Human
aaggccccaaaatgagaattttgggggtgctttcaaggattacaaataataacaccatactttgaatatatgaaatggtatcaaaatagtctgaaagagttcaccctgtttgttagctgggcgtagtgacgcacacgtgtaatcccagctacttgggaggctgaggcacgagaatagcttgaaacctgggaagtggaggttgcagtgagccaagattgcaccgctgcactctagcctcagcctgggtgacacagcaagactctgtctaaaaaaaacaaaaagcaaaaaacaaaaaaccaaaaaaacaagtttcaccctgtttgcacctgagatttctaaatccaacaaacacgtggattattattcaacaacgatctcattaaggatttaattatccaggcggccaggaaatgcttgaccacatacagtcacagggtctgatctcaacagatgtcttttttcagcacctgttggagtcaactttgccgctagccctttcaatgggatggagttttaattttccaaaagtagcaagccagctggaatgctagaaatgcacatttgctgcttctgttccattctagtaaaccatctcccggatcactatgttgatctcttgagtgtgtagttaatgacagatgtctacaaacaccattaggatggactagcagccttgtttgtaaaagtttattggagggagttgatttcacataattagccaataatggaaaacaatgttgtttttaccgtctgagaagcctgtcaacaattgacttgttaaaaaactagaaatgtgattgtaaattgaagaatgcagaaagcttacctagaaagctgtttcacaaatcccccaagtggagagtctaaatttgtgtttgatggtaatggaatagctaatgtgttacacagcttaatgttaaacatacccatggctgattctatgcaaaagtatacataaataggctgtgttagtatcattacctcaagtgcattcatcatttctatctatagtgtaatactgaatcaggtgttgctgagctgaaggtcacgggttatgcatagctattgaaatactttatttttgagacagctgaattactccctgacctgacgttagtgagtgggcagatcatcttcatctttatgccttcctgtcctttctaaaaatagcagggcctttgacaaggatatattttaagcagctcatattcacttgtctcatcaggagaagcttattttggccacttgcatgcgtcaggtttgcatgtgtgcatagttagacttttggaatagcagtccatgcttctccacaccactcatataagaaacttgcaaacataaagacactgagattgctagctgagagtattggctacaagtcagtgggtacacaaaaatgaagggaagacactttttaggaatgtgactatgcttccgaaatcatccatttcggacatttgtacatcagttctcagcttctcggatctgttttcataaaacctggctgtgatttcgctccagagacctccgtgatcttgccgcttttaataaatatttataggaggcactgccagcctgtggataagggaaactgatgagaaactgccatccgaaatctgaacggcaaaaacaaaaccaagcaaaaccaaaaaatctaaaacaaaaccaaaaaagaacaactcaaacaatccgtgttcacaagaagacgcgtagaaaaagaccaccatgtaactttgatttgataactggatttatcagtcacttgactggcatgcagtgggtactttgcatttttctaccgtactttgaaacacaagtgcaaatttatgttattctgcacaactgggaccaaaaaattatgagtgtgagaaaacacaaactctaaaagcaagatggaatgtaagcaggtaaaccctgttccacagtcatgtcattctggtacagatgtacgtggtactcgtgtttgcacctctaagaaatttccattttttcacatcaaaaaatccagatatgaagctgaagcggctttcttcgccaacctgaagctgtctgatttcaacatcattgatacccttggagttggaggtttcggacgagtagaactggtaggtgattgttctttaaatgcttttgatcgcctctgcttcctttttaattttttcccctagattaagatttctttcttttctcttgttttgtctttcatcattaattaccatgattcctaaatcagttccaaatactttgcggcagacatgtcataattagacacaaagtgggctaaattatgcagtcaacgactaaaaataaaataacaccttgctttttagaaaacctcttcatgttaagtgtaaggtaaacacatttacttaaagaagagtcattaagaacttcttacccaactaattttctataatctttatttccttagttctgagtggtgcttactaacaattatgcaccctaacaacaattacaataatttaaatgtaaatataaatacatataaagggaaatcgaagagatatatatgaagtaaatggtgttgtagtagcaattctgtgattctgtagttgcaagtacctatttctagtcctaacagtttgaatattttatatagtttatttcacacacactgtctgtatacatatgtatacacatatacatacatctatatattcatgaagatgatgatgacactttgtacaagttcatacattaaatacattgcatgaatgtggtgtaaacaatatgaaaacgtactctactttgcatttatttgaaatataaattttaaaactgacatagtgtcacaagaattagaaaaaaatgtactcttatgactaactgcatttcaagacggtgtggctataaaccctaattgagaatgcagattgatttccacctctctgctgaacatagaggagttcctgatatcagacaccagtacagtatgtgaggaactccctgagactgtgtacagtgcagtaaacagttaccgttgccatcaggggtcaggagaaatccccttccttaaaagtacattgacccagtactatttttatatttgtctatttgtattgcagttggaatttctgacttgaacaggtagaaagatgttatttacttaaatattagatgagaaggttttagagccatatgcctcactgaattggtattatgcttcccttaacactggttggagatactgtagtaatatcacctgtgacttgaaagtccatagtgtgcctttgacaatatgagtattttcagttctgggagaaaaaaaaaaaaaagtaaggttctagacaaacctcttgcttttctgaaccctaccaattaatgtagccatggatttattttttaagaactttggttttgtggcaaatcataattgtctgtatagctaataaagattcattaacagcattatacatgaactgctttgatttggaggtgttcggacatacaggcaggaaagaggacagagctccctgccatacaggatttattttctggtgtgtttatatagttgcgtatttctaaaacagtctccaaatgaagcagtataagggacagaatttctcagagagtgattgtaggactgttataggtccttaaatattattttttaaagacgaaggacaataaagctactatttttgttgacaaaaaaaaaatcagtgttacaactttgtgaactcttagaagtttgataacttaaatggtgatctttgaagttaccagtgagatattacatgaaatataggaatttacttaagatttttgaaatactgaaaataacttacaggcactgaaatcatttcaagctagagaactgaataccaagctgatagtgcaaatcttctagaagatcctctgaaaagcaaatgaggaggtacaaacaaaattttgattagcctcaaaattgggaagaatttaatgtgggcatataaaagttagcttagtttaaaaacaaaaatttgcatgtgtgctctcgtgtgtgtgcacacatgtgtatgctcatttctgtgtattcatgtgcatgtttgagtatatatatcatatatatacatatatatgtatatataatctccatccccagagaaataccagatagcctaattttcctctcatggatattatattttactcttttagacagatgtttatatataatgaacaccatagtcctaagaattaattgagattggaactatagcccactttgcaaaaactgtagatattactgctgagtgataaattcaaaatggatcattgggtacaacttctacatcgggacggagtgcacgtccttaaccttttacggccacatcagcttttgttgtcttgtacatccacaacacactgtaggacaatcagaatgcctatattgtcttcagtattcaatgtggaccagccacttaagtgatcactaataccttattttcccaattcttgccacttactaattgcctgataatattacttttggggtattaaaatattatctgtgattgttcatcttttacatacattcaatgatgctggaattgggagtttggcctcatcactttgcccataattgtacataacattgtcacggaatataatcaatcaccataagggtaacagtgtaccatcagagttaggagtaagatgtaggcagagaccagttcttttgtgattacagaagttttactctcctctgagaatgacgcatgcaagataatcttgtcaatattataacgtgctattgaagcaatatctaagcaataaatcttcatataagctaatttcatatttatgtacacagtgctcaacatgttaatacaaagtatataatacttagtgtcttagtttagcagtaatgttgagcaggtaaatgacatttcaagataataccataagttacactttaattttaaaatagtattttaaaaaatttcccagaaataagattataaaattataaaccctccagtggagtataaagaatttagaaatttgaatttttgaacttcatttcctgttagagtgaagttaagaatgtagttttctcatcactgtttgacatacagattgtgtttgtgtgtgaaggtagttacacccttcacagactttttagcatttcttaatttttatcattcatgtcaatttagataaatgtagatgcagaagtatttttctacaggagaatttataaatagtttattatcaatttttggacgtgagtacataattttgccacataataagaaacttaaatgtgttcagtaaagagtccagaagcttaaagtgaagatcttttaggcataggaattgtagtcttaagctattcagtctcttcctaaatactctcagcataactgacattcacttgtttaatatcagacagtatcctgttcacaaccatttcctctgggcagtcatttggactgctttcctttctgttttctggcatgtgccatattttctgcctatgttctttatttttaagaatggtctttctaatgtgttcagttactgtctgtttacagtatgtcttccaggagaacacattccatttatagtatcactttcagcaaaagaactcagctctctttttatatatgacttattaattaaagctctaagcactgctgtaagtcatctaggtaatcgtcttcatttacaaagtataactgtaaaataaggaggttgttttacaaattacaagtgaaaattagtcccattgccttatagtcatattcccaatttactctacttttgtccctgcgagaaaggcacctgcttttcagaatagatttgtatgactcaaagacaaactgattttttaatatgccaataatatgtagtcggtgctttaaatattagatatttaatctgtttatttagcaatccacatatctcctataccagagcggcaaacttggataaagcacaggaacaaatataagataaacataacctctgtctttttggattatattctttctgcatcagttattatgtatatatgtagtgagctctatgattgaagataaaaaatttaataaatagaatagttcttagctctagagactcacagtctactgggaggggcaatcatgtaaactaataaactcataagcaaagcatgatcagcaggggttcagtgtgtggaggaacaagacgtcttgcaggagatagcatttctgaggcagagggagagttaaggcatcaacataagtaacctgatgcattatggaacatacttagtaaaatgaaactattgaagaaacaaatgtttattaataaatattatttctttaataaaataacctttcatttgaaccctactttataatcttcaaattactttcatgttcattgtataattttgcccttatagctactctgtgaggagaacatgagacatgatccacattttacaggaaagaagacaagaataatgtatttatgtggtttaaggccacttagtcattgaaagagctgttgttattgcccagaattactgattttttaactagaagctttttctgccattctgggttttaaaaatatttggattcttaccaccaccatcaacaaccacccccaaatcaaacaagtgttacttcattgttatatgtacacctttgctttaaaaaaattcttctggaattcaagaacctgaattagaactaaatctagaatagatgtagtaattgtctgctgtgtgcctctctttttgttatatcctcagaggctcccctttctctaaatccttttctgctcctagtttaatggcaaaatacctgcagagaaaaaaaatccgacagtgtaacatggtagctagaagctagagctctagaattaggctttctggattcagatattacccattgtgtatgcttagtcatttacttaaaactttctgagccttgcttttcttgtctctgaaatgatgataataataggatatgtacctcacaaggttgtgaagattaaacgagttaaagccctcaaaatagtgtctcacacatcataggtcagtaaatggtgttaatgttgttattgttgctattattattaaagcatgctaatgatagttctttttatttatcacttccagctataagcatagaaaaggaagggaatgaaagtattttactcttttcttttccattgctaggccaaggcctgagagtgcaaccattattccaatataagtaagagccagaggtcttcaaatgaccttcagtgataacctctattaaatttctccagaccactaagctcttaactttctgatctgtcatgagaggagatgggaaacaattttcaatatcccttatgctgaacctgtgtgcccctgaagtagcctgcttttattcatccatttcacttctaaattgtgaagccccacctcttaacctctcaatgggaaatcattttcagtgcaaactgctgaatcatacctagttcctctccagccttcttaacccatggcacctcagttgggcataataaagacctggctcttggcaagttgaatacaaaagttacctctcattccttctctgctgcagttcagtttctaaaccacataactggattgcccaggaaaagaaaatgtggtagtcgcgagaaccaatttatgctaagacaaggaggtgtatttcacagggtgtgtctgttcatgacatccataccactctcacagcatttttgccagctgccttggcactataaaaacaagcaagcaggcttggagtgctatgtaaaccaattgaaaaaaaaatagaaactaagaggtgattaagcaagaagttaggtgataaacccattgctcagtcagcagggtcttattgcgaaaggtgagcaacttaactccaaagggaaaccccatgtaagatgaaaacatttcaagagcttcctactgccaagccgcacagcaatgaaacagaatagctatggagatctttgggcagtattgccatgtgtacccacggtgatttatgctacatcggacacctggggaaaccctgctgccctaaggccttgcatcctctgtgactaaagtgagtaaggactcaatactggttgaaactgaaagtttgcttcattttaacacagcctcttctttagtagtactctgtggtttattattaaatatgtaattctcatgttatgtttattcttcaaaagaataaaaacggacaaaaattattaactctaataaatagcactcatttctcagaaaataagttcttcagagaactaatgaaaatcccatctaataaacactaattgagcatcagtaggtgtagtaacaatatactgcaactgctaaaataaccacatgacagtttcaatgcagaaattacaagtagtaaagcttatctctactttggtatatgcaaataaagtaagataagcattacttcatctcattattgtagaataaatttcttttgtacattgataattataataaaatttagattacatgaatgaaaacaaatatgttactttctaacccatcttgtgaaattacagaaattttatatattagcaatcaattgaaatgcctattttttcttacaagtagttgaagttagtatcctaccacaagataaaatgttaatagtttctcctctaaacctgcatatgattttagaataatcactataaatctagaatgcactgggcatgtctttccaaagcttaaaataattggtgataaaacagctcttacaaaagttgacatttaggtcatacttgccttttttgttttctatgacataaatattatttctttaatccaagaaatattatttctttaataaaataacctttcatttgaaccctactttataatcttcaaattactttcatgttcattgtataattttgcccttatagctactctgtgaggagaacatgagacatgatccacattttacaggaaagaagacaagaataatgtatatatgtggtttaaggccacttagtcattgaaagagctgttgttattgcccagaattactgattttttaactagaagcttaataatgggtacatcatattaggcaaaaatcatctgttttaaaacatccaaaatatttgtgggatataaaaatatctgacatgattcctgccctcaaggaatttctgccccctcctaagaaagaagataagattaacatattggaaaagtagcaaacaaaatattatgctattgtgttaaattaaaaattatgcagaaatgttcttagtatttcatcaggagagaggtcatttgaaattgatggaatagaagaaggcctgggaagatatacagaactgaagccaggcagtggagaataggttgggatttaaatgaacagatggggaaaggccattctgagaaaaggccattccaggcaagggttacaacataaaaggccacatgttgtcacaggacaccaaagcaagtgaccagactagagtgaattactgtgggaggagcagagagaaatattagatagctgatcagtagagtatgattgtttatattctttaaaaagattagacttgccaaaaaaaaaaaaagagttgtttggacattaagtaatgaaagcacataaacacagactctgctctgaacttctatctatgacatgaaagaatgcactataaggtgactagacaagctatttttaggtggcgctgctcccagaaatagacatcataatttctcttctgacaaaagtaggttattttgtaccacagtgcagtctgcattcctgaaaatttcatgtaaacactttcaaagagggattccttccatgagagggaaaaatagtccctttgtatgtcttaattatgtagaaaatagtcatgtctttttaaataaaatgaaataatttatcttgctttctggaaaaaatatgaaacaggtaattctgtatgtttcaatatatctcatcaattgcatatatttaatttattgctaattagtacttggtccctcagtattccccattgtcattgacatatacaacatattagcttgaacattgagctatgaggtcaggagcttttgtgggccaggtagtttgttcttagtctctagctccagcccactgcctttcacgttcacactgagagtggggagatcatcactacccaaaagaagttcaaataaataagttaaacaaaggagagccactgtctcgtcatcactatgaccttggatgccacatctgcacaaacaaagcaatttaaatttttaatgtgactgttttccctgaagtaaactggcataggcaaaatccagtaaattcttattgaacttacttagctacagttgatgtcctcttatatttgtgaaaatctgaaacacaagataaatgtgaaatacaagaatcgtatgggggaagaagttatctttttctttttcttttttccttaatttacttttatctgaaaatgtctttattttgccttatcattgaaagaggcattgaatctttcaatggttggcaggttctcctctacatccttccaaccccatcctccccaccctcattcccattcccccagccctgtctcccagcactttttcagtattttaaaaaatattttaaattgtaatagctttagggggtacaaatggttttcggctacatggatgaattgtatcgttagcctttttgtaacatcagaaggacaaagtttgaggatagcatgtaataagacattaagatctgattataagccattttattaaagttttccagtatgtaacagtttaaaaaattataaagtcattcatccctatatttcaaaagtataactgcaatgcaaaacctttcatgagttaattgggccacatgtcagaaagagagttgaatttcacagtatgtgatcctctgtttcatttcaactcattttagattttcagagtcaataaatgaaaggaattgaaatataaatattcaacttcacctacgtggttatatgtgtgctttaagtattagaataaattgaatctatgtgagctattcatgtgctcaatttaaaatatgtaaacaagttttcaaaactgatacacatagtatttccttatacaagggagattatgcatagaaattaaagtattgggtagaggatgaaaaatatttgattagttggtgaaaaaaataacttaaagtgtattataggtaataaaattctgtaaataccatttttaataatcactgcaaaatgaagtaaagtttatttagcataaaagcagtaggaaataaatgttatgtttaaggaatgagaagacactcaaagtaggtagccttttgaatgaaaatgaatgaataaactaattccttaataagggaaattataaatgttctttgatttgcaagtaacttctagaaaattgtccaaccctttgttcacagtataattaaaaataagaaattataaatattctttgatttgcaagtaacttctagaaaattgtccaaccctttgttcacagtataattaaaaataagaaagtattaggttctttttctgactttcctccaaactgaaagttaaatgtctctaaaaaatagaaaaaaaaaaccttatctcctcttcaaaaatacctttgtcttttgataaatttaaacttaataagatagatatttcctgatatttctggccaccagctgtagaactgattttaagtctgaaggtaagttacaaagcaaataagattactgatattttgatgaagggttaaggtaaacaaagaaagaaaaacaaggatgagaagaagagagaccctctcttgattatctttccattgtgcaaatggcagatggattcaaatgaaaaggcatatatatataataagctacttttctatcctcctttcttttcaaaatgttatacctgactctgtgtgtgtgtgagtgtgtgtgtgtgtaggtgttgggggggcctgtctatgaataggaactttgatgcataaagcctttaccatgaagttgagtcaccactacagcagtgctgtgcctctgtgcctcattcaaacatgtgtcactcaggctgtgacgagttccttttattcttctctcttgtgtatcctatgaaacaaggcaaatgctatggttcattcttaaatttcagacattggccaaggagaaaaataaatcatatgatgttattgtgcagagaaaagtgaaggaagtagagaagttattgtgatctctggttaagttaataatagaattagtattttttgttattgttgttgttaagaaatgtatataatccaacattgatgtgaatccaacactgatttgtaggatagaagctttctgttcacttaaagcatttcatttccttttaagaatgtagtaagctggcttctcctgaacaagtgggcactttagttggccatgtccaaaaagttatttgagttggagtaataaaattgctttttctttcgccatgaaagtaaaacttccttaaatttaaacaggtagatttgtcctagtcctgtattcattcagttgattgggactactaacttaaaaacagatttaattatcagttgtaatagtaaaatatcatatcttggaaatcatagtagtaatgatcattcttatgtaacacttcttaatttataaataattttcacatacactatctgatttgaacttacaatatctgtttctataatatgaagctggttttttttgtttgtttgttctttgtttttgagatagagtcttgctctgttgcccaggctggagtacagtggtacaatcttggctcactgcaacctctgcctcctgagttcaagcaattctcctgcctcagcctcctgagtagctggattacaggtgcccactgccatgcctggctaatttttatatttttggtagagatgaagtttcaccatgttggccaggctggtcttgaactcctgacctcaaatgatctgcccatctcggcctcccaaagtgctgggattacaggcatgagccaccgcacttggtctggttttattctcataagtaaggaaaataaggctttaggatgtcatatggacttgcatacaaccacagttggtttattattacaatattttaaccttccaatccccagcatccatgggggattggttctaggacctgtcctcaccaatacctcttcctgctgtggatatcaaaatttacagatgcttaagtccctaatataatatggcatagtatttgcatatacacacattctctcctatattttaaatcatctctagtttatttacagtacctaatacaatgcaaatgttatgtaagtagctgttatactgtattgtttagggaataatgacaagaaaaatgtctatatatgttcacctcaaacacaaccatccatttttgttttccgagtattttcaatccttggttgtttgaatgtggatgcagaacctacagatgcagaaagctgactgtacctattattttgacaagataagttttaaagaactttgtgttaattatgtacattttgtttaaatttattcatgatcctaattttttaaaaaataagacttttaaatttaggtttttcaataaacaagtagtaaagtcattaaaaatgactttttaaaaatgtgtcaatatttaacagaaattagagtttaaaaatctagtttgtggctaactggggaacttttattgtaagtgagatagtaagcacagagaaatacatttttgacattaaattctttaaaatgtaaatgaaacatgtagctacctgacaaatcaatacagaactagaagttgtagattcaaggaattacaagttctctctctttttaaaaattctttaacaacttcattgaggtataatttacataccataaaactttcccattttaagggtataattcagtgatttttagaattgtatgaccatcatataacccagctttagaacattcctaccactgcaataagaacccttgtgcccatttagaaatactctccattccaatctccaggattttttttttttttttgagacagggtcttgctctgtcacccaggccggagtgcagtggcatgatcttggctcactgcagcttgagcttagaggctcaagcaatctcccacctcatcctcccaagtagctgggactagaggcatccaccaccatgcccgactaatttttgtattttttgtagagacatggccatgttgcccatggctggtctccaacttgtgagctcaagtgatggtctcacctcagcctcccaaagtgctggcattacaggtgtaaaccaccatacctggcctgtcatctactttctatctctcaagatttaccttttctggtacagatattcaaatgctaaaattttgtgttacactaaatatttttattttctacatgtatgatctagttcaataatctaaatacccagttatttaatgtatagtaacttcatgtcttttttcctgttgaattttagggcagttttatggcttctgtataccctgcttcagctttgttattatactccactgctgcagaacaggatgtctacattgctttctgaacgtagaatctaaggccagtgtcctacagggctgtgaagagctttctggcaacaggggaatattgggaaatgatggaggtggaacatagtgcttatgcatttatagggagtctagtggtttgtttactgatgttcttattgttgatgttttattataggcctttggctgattttggtgaacctgccctttggcccggttaatctaataggataagatactcacagtctctcaatgtagggctttctctctccttccccctcccctccagctttttttttcttcttttcttcctttgcagaacatttcactacagcacttgtcttaaattccttaagttatcacaatttatattaaacgtgggttacttaaacgtaaaatcatataccttgccaaattatttctggattacttacaaagactttttctcccaggttaaagagagccaaaactaaaaaatggctttatgcttcaccaaataatatagatttcctgagtaaaattttgtgctattttatttagagaaaatatttgccattcctattttgcagctattacaattacggtgactctgcctggattcccttatgccttgaagcctgttttaatgctcttcctgagaaagctactgctacttttttccagtgtgtgttctttgaaagttagcaacacagagaatataacagaaaccaatcccttcatatgttggggttgagagggcagaaaataaaacccccacccccgaagagaatatgaacataaatgtaaagtcaaggtcatactttcagagaggaccatcatgtttccttaagcgacctttgtgttacttggagtatttccccttttccttcttcccaagatattgccacatgttttttgggccgtttctataaggttaaatataattaacatgctttaaaaatgcatattacgtcaaattgcagatgtatagaattctctagctggaatgagtttttaaagataatatagttttgccctttattttctgaaaagtggtctgaggcccagtgagattatatgacttattagtgaaagatccagaattaggtcccaggtttatgttttccttaactcccttcatcaccgttgttctgtagcatcagtttacctaaggtagagcatgaagggagtacccttctcctgctgtgcatggaaatgtaatttgaaccacttcatatgggacttttgcataataatgagtcatgtgacattgacagtttaagccttgaatttaagaaatcatttcaattacagtgtagttcaggaagtaattttcttccaaaataattaagatattgacagtgcaaaataagctacgagctcttaataacaaggttaaatgaatgaatagatacaaattctaaggatcaactcacagccagtggtactgagccagttttaaccttgccttgatcataatcttccttcccaataaaggcaaaaaattgggtccagtaggaaacaagcctttttaaggcaaccagataccctaggtagaaaggaagcatgtactgtatttaaatacaaccagcaaatgcatcttcagagctctttaaaatgctgatgacatcacctctcattttcaggccagtattatgcagacatcagctatagccagatagttaagaacttgtcaaaatccttgtcaaaaattcccaccttaagatctacttggcccaagtatacattcattcaaatgtcaatataatacttcattttgaagtaacaatgtactgtaaatgaaacatttaccgattctaatttctaatatagcacatagcatttcttatataaaataaaatgaagatcttgagtattgaaattttcttgttcattttccctttttaggaattttgagagtaaaaccagtgtggtataagcatccataatctttgttttttgagaacagttatataattacagaaaaatgtgaagatagtacagaaaattcctatatacgctgaacccaattacccctattattgacaacttacgttagtatggtacatttagttaatgaaccaatattaatgctttattattattattattattattattgtaaacttttttttaagttctggagtacatgtgcaggatgtgcatgtttgttacataggtaaacatgtaccatgatggtttgctgcacctatcaacccatcgcctggtattaagtcagcatgcattagttatttctcctgatgctctctgccaacacccccagctctcccccgacagaccccagtgtgtgttgttcctccccctgtgtccatgtgctcacattattcagctcccacttataagtgagaacatgcgctgtttggttttctgttcctgcgttagtttgctgaggataatggcctccagctccatccatgtccctgcaaaagcacatgatctcattcctttttatagcatccacaatattatagaagtagcttctcaaatccttactcatctacttgttagcactgaggtgggttgcagtcggaacaaagaaaacactttgtttgatacataacacttttatttagttttcacaggtaatctgtcaggatatccccatatgatagatgaggaaatgaaagcagagagagtttgagtaatttgtccaagagaacaagcaaaaaaacaaaaaaaaaggttgagattgaaaaaaaattagtcaaatgtcacactagtcacactctcaaccagtgcattagcctgtacacctaggagattaggacagtcttcaaaggaagacaaatctgaggaacatgcataactatctaggctagtccttggcaagaggcagaagaaaaatatgcactcctgttctccttttttgctggctgatctctttctctactcgaaagtaatttcatagctctaaccaacttgctaaaaaatcatcatcatcatcatcatcatcatcatcttaaatggacacaagtggactttgtataattaatttagacaacaggaaaaataaaaagcaaactaaatgtcaccttacaattcatcatggattaggtttgttaaaatatttttataataaaacctagtatcttaggctcaacaaatacaaattgctataactgactcagagtttactttaaaaaaaatttttgtggccagccctgtaagaaggtaatagtgtggttcagccccagacctcaataggttgttatgctctgtacaatttctcaatatctttgcattcatggaattctagttgaatcagaatcaattagaaagattcagacaataataataaatagctattacaatttaaaagagacttgcaagttttttcatgatgagagttttacttttactcattgtaaaagcaaggtatgaggattgttcaaaagttaagcaattcaaaaagtaaaaagaagtaaaaatcaactaaaaatctccctaaggaaaaatcattgttaacgtattgatgaacacatttctgattgtctcttcatacatttatttcacatatagatgtgtgtgtatatatatacatatgaatgtatatatacacactaacatacgaacacactgtgagatcataaaatgcatgctgacttgtaatcagtatcttttattcatatatatgtcttggttatttttccgtaatgttaaatataattctaagtcatcatttttacagttgcattgcatggatataccataatttatttttcaagctcctcctcttgctagaaatttagattgtttctaaatttttccattagaaacaatgttgaattgaacattcttgaatgatctttgggaagttgttggtttatcagaagatttctgatgaatatgttacttgggctttatggaaataattaacttcaacattctccactgtctctgttgagttagctcacaccagtggtcctcaggtaccctgactttctggttaagatcctgagttctgtgagtcttgtagcattctggtttaaattggaagtggagattctaagggccctgctctaaggagctcatgagatcttgtacagagtccaaagaaggaagatgattctagacccaaggactggttccatgcaaagtaaaggcaaagcagaaagcctcagtaggttagcagtatagttctataaactttttgtaattaatgctttttaaattggcaactagtaagcctgactcccaagaatttctgttgctttctgtagcttttacctatctcttatgacatctgccacccaccagttctcattatcctctttctaccccacttggcttctccttgcagtattcaagcaatcgggtatctcaaacccctaacacatggaggtccctgggaagtgcctaggaaaatgtcagtgaggctttggctgttctcccaaatcacatgcctagcataagttaagcttaaaggtaatagaaatattgttcagtttatctcacagtccatgagttagtcgattccgttaaactctgatttgcaaagtatcaatcactatgcatttaattggttttgtattcagctgaagggaagcagcatatactggaaatagcttgggccaaaaaaaaacctgaacatgaatccatttctgccacttgatagctctgtgaccttgggaaagataggaatcatttttggaaatcagtttgttcctctgaaaaagcaacatttgatttgccctattcagtagagattgctgggtacaagcagagtccatcaatgaatgcccatttggtggtgcgttttcatttaggatcataataactgtggtatctggtattatcctcagctagaactagggctcagagcagttaagcaactagcccgagagagactagttgcttagactgagagggactaagtggagtcagaattcaagtccagacctgtgactataaaggctgaattctttcctcctaccctgtgtacaagtataaaaaaaaaaaaatctgtgtatctgtgttatcatcactaaagagaatcatttttatagtaggcatttttgaacaactgcacaacagtcctcactagtttaactgggaatgactctgaagagggaatatgactttacttcttcttctctgaattgtagtactctaacatagctcatttttcatgccatcttccctagctttccagatttcttttagaagtgagttttcacatttggtgttttattttgagttactactgaatttatttgtagcacactaatctgtcatctttgagtttcacagccagagtacagggtctttggctgttaaaagcattttcaaatacccatttttccctctacctgtcatactgattcacaattgctggcagctaaccgaggcccatttatttgcagtatcttcatgctccctcctaaggaacttgccacatgaatatcttcgaagattgaactcaatctgtacatgtgtgcaggaacaagacacttaagaccttcgctatccctgctgatgaagcagtaaataattaacgactaaagaggggacagccatacttcagctgaaaagcagaaacagcatgccatgttatttccccaaggttacattactcccaaataatatgggctgtttggtatcatcttgaggattctgctgcttgagagcactagatgataatgtccttacattgcttttaagtaattagctctattacctctcttgtttttgttacaagtcaccttcttgaaatttcttgtaaaaccataaacagcaccctgtctgagtaaggcatgtggaagatccatgcctcctctggagccactgggagccatgagggctgcaagagaggcatggcacattgaaagatattaagcctccaagtcttcccagttattagagagtaaagtttgaggtcaaaggaactaaagccatcatgcttgtttgagaagaaaaacaaacggttttcaaaatctcctgaaaaaatcttgttacaattttttttctctttaaactgtagggagggaaaattctgcaaggttaaaaagaagaaatgaatacagtcagtactgaagaaataacagtctgcagtctcagcagagactagggtccaccactcaagctaaaaattagaaatgttaacaacaggtgctggagaggatgtggagaaataggaacacttttacactgttggtgggactgtaaactagttcaaccattgtggaagacagtgtggcgattcctcacagatctagaactagaaataccatttgacccagccatcccattactgggtatatacctaaaggattataaatcatgctgctataaagacacatgcacacgtatgtttattgcggcactattcacaatagcaaagacttggaaccaacccaagtgtccaacaatgatagactggattaagaaaatgtggcacatatacaccatggaatactatgcagccataaaaaatgatgagttcatgtcctttgcagggacatggatgaagctggaaaccatcattctcagcaaactatcgcaaggaccaaaaaccaaacaccgcatgttctcactcataggtgggaattgaacaatgagaacacatggacacaggaaggggaacatcacacactggggactgttgtggggtggggggagggggaagggaaagcattaggagatatacctaatactaaatgacaagttaatgggtgcagcacaccaacatggcacatgtatacatatgtaacaaacctgcgcgttgtacacacgtaccctagaacttaaagtataataataataaaattttaaaaaaaagataaaaaaaattagaaatgtttgtggattagaactaaggaggaagaatataaaggcccatataaccctatttttggccatctttactgaaataaaattggaaaagaagttttttttctactcttttgacagaagaactataaaatgtattcaaacacactctatgacatgaaataataaaactagaactaagtacattttccctcttctaatccacacgtgaacacaattaatttggaatcaagttagttaaaattcagccaattcagagcatgagattggatgatagctgtgagccctggatgttaaacgcagctctaccaaggatttactgtgttttgacttgggaggtggctgaggttcatttaagtgcgccatgtacctgttaatttggggataataatgcactcttacaagtctatgggctttttcttactctcttctctctttctttaaggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgaggtaaaggctccatgccagggacagacgtacccaactccaagtgacaaatccaccacaaaaccctctgccacttgtgctcactgttaacacatttcgtatgcacaaagaaacttctttttaatctaatcttaagaaagttttgtttgatttctaaaaataaagttctgactctattctttcttttaaagagaatcagtgtctgaaaacaatgtgttttcccaaaggaggtaccagagtttctaacattccatttttatctttttttaaatccccaaactctacatagacctttgatgcttaaaagacaaaatatccaaaatcaaactatttaacctttaattatctgaatattttttgaagatctaaaaaaatgaaatgacagctgaccattccacctcagtactaataaatggataatggggagatttttatatgtggaagcagctttttgtagtgaattttccagtggcatttactgaaaacaagatgtaacatgaatttgagcgaatagcatatgaaatttatacatgtctgaatctgtaaagtttaatccactttattcccattttcactgcatgttgatgaccactaaatgttgccccaagggtctatgctcaaaacattacccaaattggaatggaaagaatcccaagaaaccctctttgtccataatcattatgattaatccatttcaagggagagattagcgccttagtttcttctattaaaatcctattcatgagccattggcttcttttccccatgtgtgggcttagatctctctcattctgacaaaattttgagcttggcaaatcaaaactataatctgggccccccaaaattgcacacttgtaaaagacagtaatgtttataatctttgttttcttgtttgcaatttacagactgtacagaacatttaaggacagcaaatatttgtatatgttgatggaagcttgtctaggtggagagctctggaccattctcagggataggtaggagatttaagaaatttctatgatatctctaaaaacagttgcccatgttggtctataagaagagttaatatgataaagtataataatcatatttataatttacacatgcttatatttcaatatttaaagtaagcacagggcataacccactatacacatatgatttactgtacatataacaaaactcactttgtaactaacaatacaggcttagtcgatcataaaaatggtacatagcaaaatatatacatggccttagttttgcatgaatgttagaattagctctgtagctggaattcaattcattgctttagcagaaagagaattatagttattttataattataatttgaattaactatcagtttaattgctctactctttttccagataggcagtttgccttttgtgacattgtgaattttttccaaagtaatttttccctctacctttacatggctctttggtttcaaaattaacaaaagtttccagccatctctttatcccttggctagtcttaggaaaaagaaaagaatccacttataagcaatatttcatgtaaattatctgatttagatttaccttcttacccttccagggcaaggaaagtttgtctacatggtgcttgtttgttctaatcatgcaaattcattgtcttaattttccatctcatatttagataactagcaaattatctaattatcttctaatataatttatcctataaaatgtctcaggagatcattatctaccctgtgtttttttaaaaacacacttttattttcctatgaataatcttttgattattttccatgaatgatttattgatcatacaaaagtcatctttgttcttttgaacactcacatttagacatctgtatttttcttatttgtttgagtcctgcctcccagactctccttcacagggtagcatccttctgaaacttagctataggtagccctgatgtatataaccatgtaatgtttttatatttgttactttgcagataccccagaataaaacaagtggttccttatgaactgttgatttaaattctcattcctaatggtgttcttatggtaccttcatatctttgtacaacaggccctttcgtgttattcccatggcctttcttatatatgccaaatggatttcttgttaccacattgtatcctattgcatcggtattttatttcaattcttaaatttaaggttaaaaaagcataaaagggaatgtaatcatgttggcattaggcgataaggttaacatctatactaagctattatatcatagtgtatatattatgtattattgctagttaatatgtacatagagattatataccaggcattgtgatagaggctggggatccagtaataaacaaaacagatgtggtctctctcctcagaatgtatagtttgtggcacaaagttaatattttaatctgtgagttaacatttggcatatctaatgtgtttctactgtattatatttgacttgatatttcaattcactgatttatttgaagtcttctacttttttttctaattagaatagaagaagatttacaggtggaattaaacatgaaagcaataataagccacaaagggagagcccagctatccctcttatagcttattatttttttattttttcataagttattggggtacaggtcatatttggttacgagtaagttctttagtggtgatttgtgagattttggtgtacccatcacgcaagcagtatgtactgcaccatatttgtagtcttctatccctcacccccctccgactcttccccccaaatccccaaagcccattgcatcattcgtatgcctttgtatcctcatagcttagctcccacatatcagtgagaacatgtgatgtttggttttccattcttgaattacttcatttagaataatagtctccaatttcatccagttccctgcaaatgctgttaattcattcctttttatggctgtgtagtattccatcatatatatacatatatatatatacatgccatcatatatatatatatatatacacacacacacatgccatcatatatatatatgccctcatatatatatcacagtttctttatccattcattgattgatgggcatttgatttggttccatgattttgcaattgtgaattgtgcttctataaacatgagtatgcaagtatcttttttgaataatgacttcttttcatctgggtcaaatggtaattctacttttagttctttaaggaatctccacactgttttccatagcagctgtactagtttacattccctccagtagtgtagaagtgttccctgttcactccatccacaccaggatctattggttttttgattttttgattatggccattcttgcaggagggaggtggtatcaccttttggttttgatttgcattcccctgaccattagtgaagttgagcattttttcatacgtttattggccatttgtatatcttcttttgagaattgtctattcatgttttagcccacttttcattggattatttgtttttttcttactgatttgttcgagtttgctggagattctggatattagtcctttgtcagatgtatagactgtgaagactttctcccactctgtgggttgtctgtttactctgttgactgttcctttcgccatgcaaaagctcatcagttaaactaggtcccagctatttatctttgttttcattgcatttgcttttgggttcttggtcatgaaatctttgcctaagccaatgtctagaagggtttttccaatgctatcttctagaattttagtagtttcagatcttaggtttaagtccttaatccatcttgtgttgatttttgtacaaggtgagagatgaggatccagtttcattttcctacctgtggctagccaattattccagcagcatttgttgaaagagtgtcctttccccattttatgtttttgtttgctttgtcaaagatcagttggctgtaagtatttgggttcatttctgggttctctattctgttccattggtctatgttcctatttttgtaccagtgctatgctgttttggtgactatggtcttatagtatggtttgaaatcagttagtgtgatgtctccagatttgttctttttgcttaatcttgctttggctatgtgggctcttttatgattccatatgaattttagaattttttttctaattctgtgaagaatgatggtggtattttgatagggattgcattgaatttggattgctttgacagtatagtcattttcacaatattgattctacccacacatgagcatgggatgtttgtgtcatttgtgtcatctatgacttctttcagcagtgttttgtagtttttctggtagaggtctttcaacttcttggttaggtattttccgaagtttttggttttttgtttgtttgtttgcagctattgtaaaaggggttgagttcttgatttgattctccacttggtcaccattggtgtatagaagagctactgattcttgtacattaatcttgtatccagaaactttgctgaattctgttatcagttctaggagcttcctggaagagtccttagggtttgccaggaaaacggttatatcgtcagcaaacagtgacagtttgacttcccctttaccgatttggatgccctttatttctttctcttctctgattgctctggctaggacttccagtactgcgttgaagaggagtggtgagagtgggcatccttattttgttccagttctcagagggaatgctttcaacttttctccattcagtattatgttggctgtgcctccctcaatttacaattggcaataaatctgcacagattgcaacatacttcaggttcatacactcactgattgttgttactcgtcaatgaaaaaggtgaaatattttgatgagagatgcttagctcctgttacattctgatatccaagaactcagtttatgacaagttgactaaacattgtgattaaattttaatttgagtctatcaatattcataaataaccttctatttctctcaaattgtcatctaactgccatctagcttaaaacaaccacccatccccaaagagggcataagggccttatctctcactggttttaattgaaatgacacagctgtcaaggcataattcattatttcaaagagctatataaggcaagtgatttatttctttaagtaactatctaaactattgatgaaacagggtttcttttgttttaaatcaaatttacattgtcatttccaattctaatagtaatttttcattgtgagtcacctcagtgttatgctttgtgactgctttcaagatgtctattttaaaatccacaagttatctacatcacatgtttagtgatgggacagtgtggtgctggtaaacatttgtgtgcatgcattgtatagatttatcaaagtttgagacaaggttttcatttaattttcaaaatcggttacaaatatatttatatgtgaaagatactcaatatagatgtgttgaaggaatggaaactagatttctaaaaccctccacattccaaaatgactcaaaaccagagaaaactggaaacaaatagagttgtcaagaactgaggaccctaagatgtacaatttgtggtctgtttgcttcgtggtgaaaaagggagagctttgattggcaggcaataaaagggtaattttggcccatgtgagaagcatggggaaagtgaaaagaacagagattagcaaaggattcttcagagttgatttgtggcagttagccttggcagtcagaagcacttaaataacagagaggattggtgttccaaacccccaacctccaccctgaaaatacttcatccctattctatactatgttagttaattttactatattaagacatagtagctaaaaaatagttttctggtgctcaatcatagtggctactattacatttagtgagcacaagttgtgtaccaggcacttattttcagtacatgcattattaattctttggatcttcacaacaacccagtgagatagttactgttattagccccattttgcacatgagaacacagaaacacagagacatatagttaattgctcaagaacaaacagtaaatggagtctggagttgagcccaggattcttgcttcagggtccatattctaacatatagcctcctcccatgaatttgagtttgtattagcatttttccatctttctgctaatgaccagcttattcagaatataagtataatattctgcagacatttcatgagaaattgatctctcacctaagcatttactctcattacaacattaacaatgcatttgtccatttgattccattaccaattgactattaaggaagcagaggtatgttgcccagagtcacaactgtagaaataatctcctcttctactaacagtaatcaagcatttgtaagctttcaaaaaggcccactcaaatcacaattagacagtcctgatgtaaatgagtaaacaggcaacctacagaatgggagaaaatttttgcaatctatccatctgacaaagggctaatatccagaatctacaaggaacttaagcaaatttacaagaaaaaaaacagacaaccctatcaaaaagtgggcaaaggatatgaacagacacttctcaaaagaagacatttatgcagccaacagacacatgaaaaaatgctcatcatcactggtcattagagaaatgcaaatcaaaaccataattagataccatctcatgccagttagaatgacgatcattaaaagtcaggaaacaacagatgctggagaggatgtggagaaataggaatgcttttacactgttggtggaagtgtacattaattcaaccattgtggacagtatgacaattcctcaaggatctagaaccagaattatcatttgacccagcaatcccattactgggtatatacccaaagattataaatcattctacttaaagacacatgcacatgtatgtttattgcagcactattcacaatagcaaagacttggacccaacccaaatgcccacaatgacagacaggataaagaaaatgtggcacatatacaccatggaatactatgcagccataaaaaagaatgagtttggctgggcatggtggctcacgcctgtaatcctagcactttgggaggccaaggcaggtggatcatgaggtcaggaggtcgaacccccatctctactaaacttaaaaaaattacatgggcatggtggtgcgtgcctgtagtcccagctactcgggaggctgaggcaggaggatcacttgaacccaggaggctgaggttgcagtgaaccgagattgcaccactgcactccagcctgggtgacagagtgagactccatctcaaaaaaaaaaaaaaaagaacaagatatatagtttgaaataaaataagaccattccctttactctttcattttgttttgttttgctttgcaatgctctccattgagaagggatttaattcatagatagcagtgtagctaaagctatatattaattatatatacacagatgcttactctttaaggtaaataatctcttcaaatgaaagaaacatgctactcttgacaggtaaacatacttaattaagggcgaagaagaaaggaccttcaaggcaatactgtaatccctttggaactacatacaattataaaattttaactctgccaaagatatctccaagtcagaggaaaattgtagcatgaagtatatcatttgtttcctcatatggatgcagttctcaaactttctcttgtgctcataaattcacaattgttccattcagatattattcaagggagattcaggagtcatggtaattatagttaagattctagaatctagaggaatagatatcattatgcctataattaattatgtttcagaagaatgatatttttcttaggaaaagctggttatttcagtgaaaactcaagtgatattagtagctgaaatgaagacattctctttctggaagacactacctatttctgaaagcctgaaaagtggctgctttagccttgattcacttatgaattttgtaaaaatgtaaccatattccactgcccagtttgttaaactttactccacaattttgaaaaaaaaataagtgtcaccaaaatgcaaacaggcatcagagactcatgaaagcaagctctgaagctatcatttgttgtacactgtctattaataaaatcacttgtgtgcttgtcactcatgttatatctcaaccacctcaggcgctgatgttcacactaatatttttgaattatgaaatgaaattattaaattgtgcttactactcgggaaagaaaaaaaaagtacatggtttatctctttaagaagtaccatgaaaaaaaaaaagaaaaatagttaaagttaagacgttctgccctagaacaaagggtttaaccttagatgccaaggttttttctaaattatttcattcaatcaatcaatcaacatatatatgcccatatatcatatatatgagacagagagagccttcttgctaaacataataatcaagattactaataaacattcccttctagttacttttttctttgtaattgtcttttagtccatcttttccccttaataagaattcagtagtataggaaatagatattgtttgttttggatgcagaagtttcaaaaacagaagagtacttagcttgcattatgattgcatcagtagcattataacttatttccggagtggttctttgaaaacagttgcttttattcagactctcatgaaccatatctgcattatttagaaagattaaaaaacaagccctctaagaataaatatgaataaacccataaacttctcctttaaaaaacaaatgcttggtaggcaagctctaaaataggattatttttctctcctgcctacttctgtaagtctgtgcctttttcgattgtagtgggctgttgagaggaagacactaagtacatgaaatgtgttgtgttgaactattctttcagccctttcagtaagtgagatttaactattccattcataaagacagagaattccttaacttgatccttgaatgcttcagaaaacccaatgtaatggcaatcatgtaacatttagctagcaggacagtgatctctgggttaaattttggcaaaggaatatagtgaaatgagaaaaaaaaaataaagccatattacagaaattaattttttatacaattttcattccatttctgcacctcagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggtcagtgcatttcatacgtgctttctgccctgcagattaaaaatatttgtttataaaactgtgttcatttgctaatatgaaatctgagttttccttttcaatgttgtaactttcttaaaagcagattttagcattacacttttcaactgaatgttctttcaaatgatgcatcagttatgaaaaattaagttggctaagtttgaattaacaatactctggcaaaagatgcttttataagcatgagaaaacacacttgctggcatgtgtttacatgcccagaagtccttttctccagtcagctttttgccattcataagcaatgggtttttatattatggaaaaccataaatcattttaatattttagatttaagaataatgctaatggaaaaaaatgtgctttacaggcaatgctagccaggttatgtaatagtaataataataatggtcaaaagctgtaaagatttaccatagaagagaagttcttttatttacaaatgcacaacttttgttggatctgttaacagcttgattccatttttaaagttttcagaattgttattcagcatgtggtttttagagaaatcaaatcagtggcagttttttatttgtagtttcaaccaaatcgttttagaaaaaatatattttctgcagtcgacactcttccttcaaaagagttccagaaaaatgaagaatacattataattttatttctgtttatgcttactaagggcagagtcattggtcccaaaactatcttactcacttcctgcaaacataaaatagcttttcaaataattaatactaaatgaattgtcgccttcattaaatccagcagaaatcatgtatattctgggaaagatgttaagtaggcccaactggtcgttaacaatttttaggtacagaagagattctgtgtttacactccaacctccattagcataaaagaagaaaaaatgaaaactatattcggaaaggaagatttacctttatttttaatgatgtgaattttatgctatactcaggtgtcaacttttgccattaaaactgaggtgcatcagggagactgtctttgcaatatagactattctttttggaagacagaactataaaaacatacatgtttttaaattattatcatcatcagtgtgcttcaaaataacttattactttaaaacttaatcataaggagcttaagtatcttgtttttctctctttgtaaggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcaggtatggatattgatagggaactgctgataaaaatagaccagcatgcagctacacactcctgcttttgtcacttggattagaccatcttaaagtacttttcaccatatcttggtaccacagtttaattagttatacagatgaccaggaattcataatgtaaggtataaaatagtccaggctagggcaaccacctgaacactaacttttggtctcattattgctacttcttttttacatatgtgaatgtggaaggatataatgtccttctgtgagctatcttagcccagtcatttagccagcaatgaaacaggggagatgataatcatataaaaatatctagggtcaattttctatagaagtaagaggacctgttagcaactgttatatctaaatgaaaggtgactgctttgtacatctttcctgtaatgttattatcatcaactcaaataggcactagggacaccacaaggtataaaacaaactttaagatcctcaaggacccatattaaaagaacaacaaatacactaccatgacatgtgctaaaacagtgagtgacaggggtgttatgacctacagatttcaggacagggatgggttcgtaaagaggcttttgaagaatgaatataaggcagctgtgtcttgaatgaagagtaggacttagatatagagagcaagaaaagggtattccaggcaaataggcatggcttaaagagaaaggcaataatcgtcacagacatggagaaggttcatgtaaaaaaaacaggaacagtcatcttttgacgatcatgattgctgcacttgagtgtttggactccatctacagagggaatcattgagattttctgacaaaggttgagtgatgtgtgttgtggtatttaaggaaaaacaagttggcagtaataagcaaattggaagaggaataggaagctagtttgaagattgttgcagtaatttagttctaggacactgagagcctagagtagggcaagggcaatggaaaaaaagagtaattgtgaggcaggatgtgaagaattacttaagaggacttagtcactacagtgaacatgagaggaagactgaggactttgagcacagggtactctgtgaggattcagtgcatacatgaaacacttagaagagtgtttcgcacatagtaagcattccatgaatgttagcagctgctactactacaacaacgacagtcattgccagaaatagttgtgttttgattttatttttatttatgggtattttacattattacccataaagtttctctattgacttcaaataaattatgtgtgacataatccaattttgttcagtgtggattgttcaattttgatcttgtggatggaggtaaattattttaaaagtatgaccaattaagtagacctgtaaagatatgaaaaatttggacaaagtagaaggttaaatttaacatatgtgtgtggatggatagataggtaaataggcagagagatagataaaaaggtaatctttctagtgtgcttagaattgctataagaaccaattatataataaatagaagaaaactaaatattaactatttttgaggaagtaaaatattcacctataataactagactaaaatattaaacatgacaacttatatttctccttaaatgtttagacatttctctacaatcattgtttattcattaagtaataaggtgaaaatgattaaaaccttaatcttaaaaactggcatatactaaactgtaagaaataattaataacagaaaaacctttaatcctttaaagtagaaattgcacaggttacaatatctgactggaatataataaaacttggaattaataacaaagatttaaaataaaaagtctaaatacttgaaaatttaaaaagcatttttctaaataacctcaaggacatagaaattacagaatagcagagcagcaataaaaataaagcactataagtcacaatttatgttgtattttcaaaaccaaacttaatttttttaccataaatatatatatcgaaacattatgattaaacatacctaaacttaatattcatttcaagaaataacaagacagaaagaattttggtcaaagacaacagcattaaaaaaatctttacttttccttttctacccaaagagatgatggtggtggtaagagacggtggccaggggtgggggtgggagaaggcaagaataaaacaagtaggatgatctttagttacaaataaagttccacaaaacacacctgccaaacactatgaagtatggcatgtgactaggaatgatgcttggaccacaagcatgactccaaagtattttggtcctgaatgtcatatctaatgatcttcgatagtaataatgacatttagaggactggctggaccttgaaaaagcaaagactgttcatgcagagacctaattaagcactacagaatgaaagaggaactgaggtgaaggaagattcatacaaatgtaccaattctgccttttaaggcttataatgttggtcagtgaagcagggagtgaaaagggggagagaggcagtgattaatgatttcagagaatgtggtggggctttgtatgagccacatgacctccctgaatgttttaaattgagggcaaaggaaataaatgatctggttataaggcaacaaacagtagtgaaggctggtgaatttctcattgcttccttccctccaactttccctgttctattcttcatggtaggcggcccaatctaaggataagtaatggtcagaaagggtcccagggaagccagtccctgcccctcttacaaccccagcccccttccatgcatacacaccaactcctttcttactgattttgctcaaggatccatctcccccaccaacttaggaaaagatgaatttatctccagttttaggttttgattcagctcgtctattccagtcacatggcattcctctagtgattggcatttattggactgggtacataaattagaggaataattttaaaatacattattggaggagaattcttttttcctacagtagctactcagtaaataattactgaatgaatataagtccttatttccactggtagacttcctataactatgaggggaaacagccatgatgaaactaatagtgactatggcagaatgaaaagctggaaccactgatcctaccagtctagaatttgccctacctctggaaagtgcttttgtgagttcaatgtttttcttattttaatcagtttgagctgatgttttccatttatgtcagctgaaagatgcaaaagtaaaagaaagctaaagaacacacaagaaaaatgaatcaaggaaatataggaggaagtgtttagataaactcttatctataatttctttgaggctatcaaaagcatgatctccctaaaaagtaacctctaagatatttgcaagtgttcataaatgagaagacaagtaactagcagagctcaggaccattacagaactgaaagtcatgctgtaagtaagagaaaataaaatagtaacaattaaaaatgcagcaagggagatagtagacaggcttggaaaatataatgaaaaaagaaaaaatacatagatatgatttcagaaagagaatctattagtcaaaggaaatagaaaacacatcaattatgtgtatgaatataatattacaaacaggagaaaaaacatctttaattacataataaaaatccatggcataaagaattgactcagtatatccttttgatctgcagtgaccatggagaaactgattcagaataatatcaccacagtatttccatgtggtgaattaatgaattaaattcattaataaggaatagtcttattggcatcaaagccataaaaacacggcatgtgtggtattgggagtgaagacagttaaagttccagctggcctcaaccttctctacagcatctttaatgccaaaagatagtatatcaagaactacgtagttctgagggtcagagaaggtataacccaagtaatttatactgagttaagttcttcttcaaattcaaacacgacatataaagtgtggaccccaggcctttctcaaaaacactactattcaatcaagcccacaaaaagatgaatcaaaataaagcattcaggaatagaaaaactagtaaaaagattgatgagctttgggtctaattaattagaacttagatcaaataatttaaatttgggtaattgaacagaatgtaaatattgtagtctttggcaatcttaaaataacactaaaaccaacaaaaattaaggtgggaggtaaagcaggtataactataggtatacttatttctcatcattaataattagtaatcttacatatattttatagttaaaacatgtcattacagaagagaaatctctaaattcagtttgattttttttttaattttagagaaatattttaggaattaatattggttaagaagcacacatatctgaaatttagcatttctctccattttactcctcagtttagctaaagtaaaattaaatcgaatacttctaaatttaaaaatatgcataatataatcctgtgtgtctacaatctacatatagaagtctatgaaattatgttcatcaaatgtagagcattctgaatattttgaggttttggatgactttcttctaaataattttgttttatatattgaatgaatattagactaacatgcatcacataaaaaccacaaatactatatttaataattgattttagttttctaagataagcaactaaatataaaagcaaaataaatataaaagcaaaactataaattagaaatcattgccaagatgtggctcctcctcattttttaaagtaaaaaatgaaaactggcatgttaagagattaaaaagaatattcaatcatagaatcaactaaagataaaattttaaattctaagagaatactaaatagatttgcatgtttatacatttttcaagtgatttaaaattgataggcaattactagctaatgacatattaaagtaaatagaaagcatttttcacagaaaatcaaagcagaatccatcacagcccttaacaggcaaatctactactccttactttaaattactcattagcctgcttgataaaaaagaaatagtttgaactgctcttaataaacatgaaaggcaaaaaaaataataattcagatttcttccccaaagacacacaaaacctgtattaaagagagtaattaatttccaaagaaatcattcgtcaaggtgtatcatcatctcccctctgaattgtgagaaatttgaaggaaagacctgactttagtcatctttgtactcactgaagctgccacaaaccacacttcaaggatggatcagttaaaaataaaaaaaaaaaaaaaatcaacagatctggctcatgagggctggggtattacatccttgctagcaaagaggatgcctagtgttaaattatctaatgaggtcctctgagcagagagaaaaggataggaggagtactattctatagaaacattagagcaataaatatttattgcctccttagtatgtacatgctgcaaactctactcaactctgggaataccagcagaaaacaaactcttctggaagggaagacagacataaaacaatcacacaaatgaaaagataattacaaagtacaataagtggcataagggtgctataaaagtgtaacagggactctaatttagattaaactttaaactagagcatgaaattagattgctaggttacgtgggttgatataggttatgtaattggttgtaataggttgaccagagtaggccttttggaggaaacagcataacacttatactgaaacttgataaagtgaggcattggccagataagtatgggaagaaccttccagaccaaataagtaacaccatgaggtaggaaagtgctcggcatttcagtggaacagagagaaggctattgtttctggatcccagtgagtgagggtggtaatggcatgaggtggggtagtatcgttggtgttcctgcggcccctcctaatgattttggacttcatctcaagtataatcaatgagtcagtaagtgtggaaaaggtcagagagtagaagaagcatcttgaatgaccaaggacagcatgaaggcttagactccagcacttaaaagaaagcaagagaagagcagataaacttgacccatttctggtttcactaagtgatttacttggaagggcttccacactgttttgctattaatctattttcattccattgtcactattaatctaagcccccaaatatgaattgatgtcatctgtggagtttatagcaattcaagtgttctcatgtagaaaataaaagtaatatctcttgtcgtgtctctcattcttgcagcccacctttctcaggcccagatcctatgaaaacctataacatcatattgagggggattgacatgatagaatttccaaagaagattgccaaaaatgctgctaatttaattaaaaaactatgcaggtaagtatttcaaccacattatttttgaaaacatcataatgtgaaaaaattagatttaataaaaccattattttatttttagggacaatccatcagaaagattagggaatttgaaaaatggagtaaaagacattcaaaagcacaagtaagtgttctttctgcagagttctgaacacgtgacatcatttccccagggtgttgctttttaagttattggtgtaaaactagtataattagcctataggaacatccaaagacagcgtataaactagtaaggcttttaaatgcctttctagttgtgattatgaaaccttatttatatttatctgacaaccctgtaacataagaagctgaactcagtttcttacaactcataccaactagcatttttttcccctctggcacaaaggggaaatgtgtattttaaatttggggattctattctctaccacagaattacaaataaaagtcccctactgtatcttacctgatttcctaaagacaaaatatatttttccaagcatttcctaattagatgttataacaggagaaaaacataagtacagaatacagtgttttttaaacaatagcaacatcttaaatatcagaccttccctatgttgattggatgttctaaagctaaactaattgggttttctctatttgtttgtgtaacactgacaggaaattcacatccttatcaaagaaacatgtttactaaaatatctctgaatatctgaaaagcctgctgagaatttgttgtaagcatttgctaatgctgaaacccttcaaagacaaaagaaaacaaacaagcaaaaactttagtcttttttggttcttattttcacgaaaaactgtacacaaaatatctttattcttcattaaaaaagggaaaaaaagaagaaaatgggacatgtagagactatgacaatgatgtgaaaaggttaattagctgacactgtgcactgaatcagtggcaaaaatggaaagttaattttctatcctgacttttcatgccctggttctacctccttaaaataaaatatcctgtaaggcacagggccagacacattatgacatgtattaaattttaattatagtgtaggaacaaggtcatagagacattatgactgaattacaaggaataagtgttgcatgttaattggtgtttaaaatttgacagttatacttttaaaaatatgtatttcataaaataaactattaggaaaacatatgcaattaaatagaaaacatttttgtcacatgaaaatgtttgcctaactgcttcccattagccatggacattgtatacactgcaatgagaagcttttagctgacacaaaatgtttttatcaacgttttttccttttctagatggtttgagggctttaactgggaaggcttaagaaaaggtaccttgacacctcctataataccaagtgtaagtagactttccagcttataattgtatgacataattgatggtgtttatgtcagtcaacaatgatctgttatttttaaagtttaatcctatgattaagttaaacaaactctaggaaaaatgtcacattaaaataatgacatattctaaaatccaaacttgaaagcagataaatttggggatagtcactgtaaatgtgttttactcttctcttttttaactattcatttgattcaagtttccctcatttatgaacataagttaatttttagcatgggaaatgttcaaaatatagaaatgcagacaaaaatatataggtgagaggatcacttgaggccaggagttcaagagttcaagaccagccagcctggacaacatagtgagactctgtctctacaaaaaaagaaaagaaaatattagccaggtgtgctgatgtgcacctatagtcctaactactcaaaagtctggagcaggaggatcacttgagcccaggaatttgagcttacagtgagctgtgattgtaccactatacttcagcttgggtgacagagtggaaagaccctgtctctaaaaaaagaaataaaataacactttttcaaagagtctttacatgatcactcttttttttttttttttttaattttttttttgagatggagtcttaatctgtcacccaggctggaatgcagtggcgtgatctcggcttactgcaacccctgcatcccaggttcaagcaattctcctgcctcagtctcctgagtagctgggattgtaggcaagtgccaccactcccagctaattttggtatttttagtagagacacagtttcaccatgttggccaggctggtcttgaattcctgacctcaagtgatcctcccacctcggcctcccaagggttgggattacagacgtgagcaccgcgctgggcctacgtgatcactcttttatttttttatttttttattttttttattattattatactttaagttttagggtacatgtgcacaatgtgcaggttagttacatatgtatacatgtgccatgctggtgtgctgcacccattaacttgtcatttagcattaggtgtatctcctaaagctatccctcccccctccccccaccccacaacagtccccagagtgtgatggtccccttcctgtgttcatgtgttctcattgttcagttcccacctatgagtgagaatatgcggtgtttggttttttgttcttgcgatagtttactgagaaatgatttccaatttcatccacgtccctacaaaggacatgaactcatcatttttatggctgcatagtattccatggtgtatacgtgccacattttcttaatccagtctatcattcttggacatttgggttagttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggtttaactagtttacagtcccaccaacagtgtaaaagtgttcctatttctccacatcctctccagcacctgttgtttcctgactttttaatgatcgccattctaactggtgtgagatggtatctcattgttgtgttgatttgcatttctctgatggccagtgatccagtgatgatgagtattttttcatgtgttttttggctgcataaatgtcttcttttgagaagtgtcggttcatgtccttggcccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgcagtgcaggagctctttagtttaattagatcccatttgtcaattttggcttttgttgccattgcttttggtgttttagacatgaagtccttgcccatgcctatgtcctgaatggtaatgcctaggtcttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcgtttccccattgcttgtttttctcaggtttgtcaaagatcagatagttgtagatatgcggcgttatttctgagggctctgttctgttccattgatctatatctctgttttggtaccagtaccatgctgttttggttactctagccttgtagtatagatgcagaaaaggcctctgacaaaatttaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggtcagggcaattaggcaggagaagtaaataaagggtattcaattaggaaaagaggaagtcaaattgtccctgtttgcagatgacatgattatatatacagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttccaagggatgtgaaggacctcttcaaggagaactacaacccactgctcaatgaaataaaagaggaaacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcgccaagtcaatcctgagccaaagaacaaagctggaggcatcacgctacatgatcactcttatactttcatggcatctttgtttccatagctctagccaaagtttattatatagaaagattttagtgattatttgttttaatcatacagtttattactcacaagggtataaactctccaaggataagaaccatgtctgcttgtacttaccactgtgaccctcaatacctgctacatagtagatactcaatgaaatagtcactaatagggaataaatacagaatgcacttaaaaattccagcttggaattccactaaaaaaaatccactaaaaaaaacctgtccattttttacaggttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattac

SEQ ID NO: 15241 - DNA, 8093 bp, Human
cacatatatgaggtacctaggatagatgaattcagagagacagaaagtaaaacagaagttaccagtggctgtgggtaggggtaaatggagaattctagtttaatgagttgagagtttcagtttgggatgatgaaaatcatcccatgatgtggtgatgatagcacaaccgtgtgaatgtacttaatgctactgagttgtgtgcttaataataatggtcaaaatggtaaattttatgtctattttaccacaatgaaaaactggaaaagtaaagtcaatgactataatatcataaagtgtaagtaacatgagagaaaataattcaggctaagaggatagagactgctaggtaggactattttagaataagtgatcaaggtactgatttctctgaaattggaatatttgaatagaagagaaagagctagctggcgatgcccgtaaggggtccaggcatggagacatcaaatgaagagtctgaggcaggaatggccttaatgcattaatggcagcaagaggtctatgtggtttcatggatgggtgtgtgcgtgcatgcacgtgtctgtgtgtatagttggtgtgcatgagcatgtgtatgcatttgtgagtatctttgtttttctgttggaaacaaggatgtcaacaggactaactaggtgaacctagctgtggtagttcagcaatgagatttgccaaaatggatggcaattgaaagaggaattgtgctgtattaaagcagacagctgccgagcactgtattggaggctcctaaatttctcatagttctgagaagagctgtttattaatctggagttgaaggccaggcccaggatatccttgttcacaaggttgattgggccctacattgctgagcccagcctcctccctcactctgaggcatctgccagagccccaggctagagggccagcgtccttgtcactgagtccctgctctgcagaaacaccagtaagtcatttctggtgaataaatctgggtttccggatcaagggtttggggagctgacatgaccctggaggcatggaggaggctttctaggggtggggggagtgggatggaaagcagaaatcaggttgaggatgtctctttttctgcttgtgctggagcatctgtgactttcctccattatctgttcatctgcagtggagactgtctttgttttcaaagggaaacttggaggcttagacctatggggctaggctgctgaggtttcttagggggcaatagctggaagaaagctctgaagaacaaatgaaaggttaatactgagaaatgggaggaggattcaaggcaagttttctaattgccagtggtttttgactcacagaacatggggaattcctgccagaaagtagagaggtatttagcactctgccagggccaacgtagtaagaaatttccagagaaaatgcttacccaggcaagcctgtctaaaacaccaaggggaagcaaactccagttaattctgggctgggttggtgactaaggttgaggttgatctgaggttgagaccttcctctttggatcaccagctttcagctcagggcctgccaatgagtaaatgatagttaacaggtcctggaggggaatcagctgcccagatacaaagatgggattcaggtggcagatggacccgaagaggacatggagagaaagaggaagctcctacagacacctgggtttccactcattctcattccctaagctaacaggcataagccagctggcaatgcacggtcccatttgttctcactgccacggaaagcatgtttatagtcttccagcagcaacgccaggtgtctaggcacagatgaacccctccttaggatccccactgctcatcatagtgcctacctttgttaaagtactagtcacgcagtgtcacaaggaatgtttacttttccaaatccccagctagaggccagggatgggtcatctatttctatatagcctgcacccagattgtaggacagagggcatgctcggtaaatatgtgttcattaactgagattaaccttccctgagttttctcacaccaaggtgaggaccatgtccctgtttccatcactccctctccttctcctgagtatggtggcagcgtcttactcagaaactgtgacctgtgaggatgcccaaaagacctgccctgcagtgattgcctgtagctctccaggcatcaacggcttcccaggcaaagatgggcgtgatggcaccaagggagaaaagggggaaccaggtacgtgttgggctgttctgtctctgcaattctttaccttccagaggaaactgcctggggatatgaggagactgatgtcctatttgagtatatttttctcaactatactgtaactcaaaacagagattcagctctcattctctggcatctcagaattccacacagcagtttgtgactaatagttgtcttgccagcccaggaaagtggcccacaggtcaggccatcccgtgggacacaggatgaatttttcttctctgggtcattgtcatgtcagacccctattcacttcagtagggatggcaccaggttcaagaggccaaagaagagatggagtcagcaaacaaacataggttttactgggggaatctgtttacagggagatccagcagcagtgggctggacaggagaacaacaactactggtaaaaacaaatgcagttaattttcactttgcaccctccctgcagcaacctccacgtggcaactttatttcttaagttattgctctcaggtgcacaccatacagttattgagagcagtgctcagaaaggtcagtcctgggtcaaggtctcctttctcctgagaagggattgggcatcaaactcttgaagagagagagcaagaacatagatattaagtcacatttcctttgtcttccaacaggccaagggctcagaggcttacagggcccccctggaaagttggggcctccaggaaatccagggccttctgggtcaccaggaccaaagggccaaaaaggagaccctggaaaaagtccgggtaaggaccccagcaaggtctgagctgacttcacccagggttctgagaccttgagtatctggtaagaggtgccccttctcctgttccttcaaaggaagatacccaaatttgctttctgacccagtgccctcagccctctcttcattcttagagccttagggaattcctataagtgcctgagtacagacttacaaacttttcaagacaactccctcatcaggcactccctgtaagagctgagcctggattctccatcagctgaaacagtctaatgtgaggccctggtcctagagggagaaaacaggccatctaagtgtgggcttattatacctatttttacaaaagcatgtaaccatggtatgtcatattttacttcataagaaaccaagccaaagcttaatagcttaaaaacatagccgtcaatttaaatcacaagtctgtgggtcggccatgtgatttctctgctggtttaagctgggcttacccacatgtctgtggtcaactgatggccaatagtctcactcatgtgtctggctgttgtctgaatgttagctggagtgatgagggtaattgaaccacatctctcatcatccaacagggcttgttcacatagcagtgattacaggattcccaagagtagaaataagataggctttaggcttcttgaagactcagagcacattatcatttctgtcagactgtattggtcaaaacaagtcacaaggccagcccagattcaaggagtggggtaatagactcatgtcttaatgcgaggagctgtaccctattgaggccatttttgccatctactacaacaagtgatttgctcatgccctccccacttggataatgggcaactcacaaaaatcttggtttcctgactaacagaacaaacctggaaaaaacaaaaacaaaacaaaagacatcaaaagcaaaacctctccaaagacaaaaactctgcaatctttttcgtcactcttcaccaggtcataatagagtaacgcctcaagagatttctttttagttttgatagaacaatttatttgaaaaaaaaatctgtgaagaacctggcatatggattgctaggtaatcagggagtatatgtgtgcatgtgatatgtatgcgtactttgggatacagtaaacagacaaagagggacatttggggttggatggaaatagcgatttttcattctttgggcttttcagtattttttattttccttcaaagtgtaaacatcaatgtaaaataagctttttttttcagtttgaaaaagatactccactcccttgtatatgcacagttctgaggctccttctcaacaatgcttctttactttgttctaattttctagatggtgatagtagcctggctgcctcagaaagaaaagctctgcaaacagaaatggcacgtatcaaaaagtgtaagctttttctcttactctccaggcagcttgaagtttgggaaaaatagaatgcaacaaatatttgttgaatgcatataattttctgtaccctgctaggcatttctcatattcttacctcatgaaattctcacaacattttggtagaaatggaggcaaagggaagttaaattacttgttcaaatgcacagagctaataaatggcaggggtggtttatagatggaagtcagtctgactcgagagaccctaatcctttaccgtctgatattgctcactgaaaatgggacttatatccctttgttgcactggtattgagacctggccgtggggtctaacctgcctggggcaaatattttcagacattttttgtttggtctcaagttaacaatttagaattcagaagtccaaattatatgtcttttagaattctgatctgaaagcacagagaggcctttgtaccagtctgtctgttcacatttgggttgccatatttaacaaataaaaagacaaagcaccagttaaattggatttcagctgaaaaacatttttagtataagtgtgtctgaaaaattatatgggagatatactaaaatattcattgtttgtctgaaattcaaatttaactggacatactatattttatccggcaactctactctagaagactttttcttgagaaataccttgagttgggcttaaggatgagtgagtttcacccactttttcacattttagggctgaccttctctctgggcaaacaagttgggaacaagttcttcctgaccaatggtgaaataatgacctttgaaaaagtgaaggccttgtgtgtcaagttccaggcctctgtggccacccccaggaatgctgcagagaatggagccattcagaatctcatcaaggaggaagccttcctgggcatcactgatgagaagacagaagggcagtttgtggatctgacaggaaatagactgacctacacaaactggaacgagggtgaacccaacaatgctggttctgatgaagattgtgtattgctactgaaaaatggccagtggaatgacgtcccctgctccacctcccatctggccgtctgtgagttccctatctgaagggtcatatcactcaggccctccttgtctttttactgcaacccacaggcccacagtatgcttgaaaagataaattatatcaatttcctcatatccagtattgttccttttgtgggcaatcactaaaaatgatcactaacagcaccaacaaagcaataatagtagtagtagtagttagcagcagcagtagtagtcatgctaattatataatatttttaatatatactatgaggccctatcttttgcatcctacattaattatctagtttaattaatctgtaatgctttcgatagtgttaacttgctgcagtatgaaaataagacggatttatttttccatttacaacaaacacctgtgctctgttgagccttcctttctgtttgggtagagggctcccctaatgacatcaccacagtttaataccacagctttttaccaagtttcaggtattaagaaaatctattttgtaactttctctatgaactctgttttctttctaatgagatattaaaccatgtaaagaacataaataacaaatctcaagcaaacagcttcacaaattctcacacacatacatacctatatactcactttctagattaagatatgggacatttttgactccctagaagccccgttataactcctcctagtactaactcctaggaaaatactattctgacctccatgactgcacagtaatttcgtctgtttataaacattgtatagttggaatcatattgtgtgtaatgttgtatgtcttgtttactcagaattaagtctgtgagattcattcatgtcatgtgtacaaaagtttcatccttttcattgccatgtagggttcccttatattaatattcctcagttcatccattctattgttaataggcacttaagtggcttccaatttttggccatgaggaagagaacccacgaacattcctggacttgtcttttggtggacatggtgcactaatttcactacctatccaggagtggaactggtagaggatgaggaaagcatgtattcagctttagtagatattaccagttttcctaagtgattgtatgaatttatgctcctaccggcaatgtgtggcagtcctagatgctctatgtgcttgtaaaaagtcaatgttttcagttctcttgattttcattattcctgtggatgtaaagtgatatttccccatggttttaatctgtatttccccaacatgtaataaggttgaacacttttttatatgcttattgggcacttgggtatcttcttttgtgaagtacccgttcacatttttgtattttgtttaaattagttagccaatatttttcttactgatttttaagttatttttacattctgaatatgtcctttttaatgtgtattacaaatattttgctagtttttgacttgctcctaatgttgaattttgatgaacaaaatttcctaattttgagaaagtcttatttattcatattttctttcaaaattagtgctttttgtgtcatgtttaagaaatttttgcccatcccaaaatcataagatatttttcatgattttgaaaccatgaagagatttttcatgattttgaaatcatgaagatatttttccatttttttctaatagttttattaataaacattctatctattcctggtagaatagatatccacttgagacagcactatataggaaagaccatttttcctccactgaactagggtggtgcatttttgtaagttaggtaactgtatgtgtgtgtgtctgtttctgggctgtctattctagtctatttgttgatgcttgtgtcaaacagtacactatcttaattattgtacatttatagttgtaactatagtccagctttgttcttcttaaagtcaagatttccatataaatattagaaacagcttctcaatttctacaaaatcctgatgaggtttctactgggaccacattgagtctatcaatcaacttatgcagaactggcaacttactactgaatctctaatcaatgttcatcatgtatcgcttcatgtaactagaatttctttaacttaattgctatgttttgacatttttagtttaaaaaccttgtatatcttgttttggtggttttagtgattttaataatatattttaaatattttttcttttctattgttgtacacagaaatacagttaagttttgtgtgtagtcttacgatgtttagtaaactcaataagtttatttcttaaatctagtaatttgtagattcctctggattttgtatatgcatagtcatgtaagctgaaaatatggcaatacttgcttcttcccaattgctttaccttttttcttaccttattgcactggttagcaaccccaatacagagaccaccagatcaggtatagactcctgaaagacaatataatgaagtgctccagtcaggcctatctaaactggattcacagctctgtcacttaattgctacatgatctagagccagttactttgtgtttcagccatgtatttgcagctgagag

SEQ ID NO: 15242 - DNA, 9850 bp, Human
gattctcaatgtgaagtggcaaagcagcctggagacaaagtttaatgaattgatatataaagaaagtttgttcaccagttgcttggcattcttggtgccaaatttagagcccgctggttctgatcagtgattttcaaagggtacataagaagaaacccaaattaccatcatcagtccaaagtttttcagagttctatgtgactggttgaggaaacactgcttgaatttccccatagcctctgcagcggcatcactgtctatgaactcttgaagaagctctttgtattcaggtatagatatgtcggaattgatggtcttttcaaccatgtcctccaggagtttgcagccagaatctggaaaaaaaaaaaaaaaaaaaaagacacaagaacatgggccattactagaggtgtgattcattctacagatgaattgggaagctggctatcttcgtacctccagggacagaccgaggttcagaaagattttggtgcagtatgcagagttctcaattctgggagtgtaaactcaggctctgcaaattctctctgaccttccaaacccagagaagcccaaccctgtgtattcttggtgaagaggaccctcgagaaatgaggtgttctgactggggggacatagcaaacactgcttggactttcttggttcaaagtcatgcaatgcttccctgttatcatgcccagcatcaggtagggtttccaaggatttcagatgaatgggtctaggacattgtccattagttctgttgactctactgcaataaaagggaatgtgtggccaggtatggtggctcacgcctgtaatcccagcacttagggaggccaaggcaggcgaattgcttgagctcaggagttcaagaccagcctggacaacacagggagacctcatctctacaaaaaatttaaaaattagccaggcatagtggtgtccacctgtagtcccagctactcgggaggctgaggcaggagcattacttgagccttcgaggaagaggttgcagtgagctgagactgtgccattgcacaccagtcccagtcccagcctgggtgacagagcaagaccctgtctcaaacacacacacacacacacacacacacacacacatgaatgtgaaatagagcttgttcatgaggggatctgaggtcaccccccactgtaagggagaggaacgagctcaggacgtggcttcatgtgagctggttgtgctctggactttgtgattttccagttagttgactgtgagcttgtcacccttctacacatctgcacctaccttggatgccaatacggtagggtttggaatccacctttgtgaactgcacaaggcaggctacctatggaaatattagcgctgattccagcagccggggctttttcctcccactgaatctttagtgctggaaggagactccaggggttgtgagttctcacctgtctgccttgagcctgaagcaactgggagggtaagggcatcccagaaggacccagatcaactctgagaacacagagtgagccacacagggtgagagacactgggtcacactctgcagcctgggccttctgtcctgggaggtttcctatttcgttccacattcaaggagacccatgattatttcctgatttctaggtgtagatgccatctctcccttgccccactgaaatagttcatttcaatatttaatcctgagactcatcctggtttctatggtcaccgtgaccatggtgagacgctgagtgccatgatacactgtgtgcagctccaatgcaggggacagcccatgaggacactgcatgcttgattgtcaggaactcatggggatcctaaggcctatcgcacccaggcccttcacactggggctcgtctgtgctggggattagaggttgggagttcttctacaggggcccaggtgacaattcctagcccagaagcagccctctctgcccagaactcacctgcatagcagtgcaggaggagggccgccagcatgaggaccatcagcagcttcatggcgaggcggctgctgtctgtgttcagtcgtgcgtggcagggatcaaggaagttgctgtggaggtgagtacccagccctgctctatttattccccagggaggcaccttagtccctcccaggaatgaggcaatgtgtcaacctggcatgggaccaggacacaatagtgtacaccaatgggaacacagccagcctgtgctctgtttgtagaaaccaagaaggcagtaatatttggatccctgacaatctggggactacaataatgatacatggcttttagtaaaatggatgtgacagtgttttccaaaatataaagcaaaacccagtggcgtgatcttgtggtctcaacaatgttgttattattgtagttttcttctagtcctccttcccttcttcctcctcctccttctattctttttcttctattcctcttggtctcctcctcttctcgttattcttcaaggtacaaacagtttcataacttgtgtatctgccggtcctggaatcatcaaatatttgggctacgtgcaatacctgcatcttcctatgggaggcagaccttcctaatccatagacatttctttttcagaaaagcgggtttttttgtttttgttttttggggttttgttgctgttgttgttgttgttttgagacagagtctcactctattgcccaggctggagtgcagtggtgcgatcttggctcactgcagcctccgcctcccgggttccagaaattctcctgcctcagcctcctgggtagctgggattacaggcatgcgccaggacacctggctaatttttgtatttttagtagagacagggtttcaccattttggccaggctggtctcgaacttctgacctcaggagatccacctcactcagcctcccaaagtgctgggattacaggcgtgagccaccatgcccagccccgaaaagtgctttaagttttggggaaaacattaatatctaacctctactgaaagcttcttgttattcttgttaagaattacaacactaagttaattcaactttacaaatttattttacaatatatttataatttaatttgtgcttagttctttgttagccttttacggttttctatccactgactgagaggatgctgtgagtgagtggagtaactgactgcttgggcaggcagtgctaggcagtgggtggcaatggggttgggtgatgatgagatttaggtgataagatttgggcaggtgtgggtgtggatcctggaggccacacgtactcatgctgtgtctttgggcaaattacaatgctggtccctctgggcttcctttctgtctttgtgaaacgggtataagtgatgctgaatttttttttttttcgagacagagtcttgccctgttgcccaggctggagttcagtggcacgatcttggctcactgcaacctccgcctcccgagttcaagcgattctcctgcctcaaccttctgagtagctgggattacaggcatgtggcacgaggcccggctaattttcgtatttttagtagagacggggtttctccatgttggccaggctggtctcgaactcctgacctcaggtgatccacccacctcggcctcccaaagtgctgagattacaggtgtgagccaccgtgcccgcctggccgtgaatttttgtaaagatgagagatactctgtaaatttttttttttgagatggagtctcactcttattgcccaggctggagtgcagtggcgtgatctcaactcactgcaacctcagccttcccgggttcaagcgattatcctgcctcagtctcctgagtagctgggattacaggtgtgcaccaccacgcccagctaatttttatttatttatttatttatttatttatttatttatttattttgtatttttagtagagatgggggtttcaccatgttggccaggctggtctcaaactcctgacctcgtgatccacccaccttggcctcccaaagtgctgggattataggtttgagccaccgctcccggccgacgctctgtaaatttttaatcacgcagccaagcatgagataattctgaataaatggcagttgcattcatgcgtggatcccttgttgtacgcatcactgttttgcttctcctgtgagctgggccttgcgctagattcagttatagaaacaggttagaccaggtgcttgctcctgtggaccttattttctaatgaaggacacaaagaacaagactaaagatatatcagaggtatgagaaagtggtcattgctgcaaagaacaacaaaatattcacaacagctgaatgctgtcatagatggcctgcccaggggcagtggcctgtaagccccccaaggcagcctgtaggagcaggtgctgtttcagctgagacttggatgagtggatggtgatgtccaaggacacatctggggaagagaattccagggagagggaactgcaagtacagaagcttgaggacagatggcactggcaaggtaaggaagggaaggaacgtggccacatagaatcaggaaaaggacgggacagcctcacatgatagaaagcccatccctgtttaattaggggcacagtgaaggtcataggaacaagaaaaacaaagttggctcaggtaaaaaaagaaaaaagaaaaaaaaagaagtcgatgaaacagccagaggaatgaatccattgttaattccctgtgaatgcattgttttctctctggattacttgcgacatgtttctttccaccattcaggtggagcctcagtggccaagaacaaacctaattttggggaggacagaaaggagaagtgttgtttacttaccactgtacacagctgaccctggctggtggccttgtttcccaagggtagtgaaggaccttgattatgaaatgtgagagtgtctccttggccagtacttattggggctctgcctggtgccccagtccttgtggccctgccttgtcagtcaccttcttacacagaacagaacttcaggaaaggcctctggtcttggagccatctttgttggcagcaatatgcctgttgttcaagtcaccaaggcctcgtctagacccagcgcctccctcgcgcccgagcctcatgctgggattccaagtctgagttgctcagtgttcaatccaccccagcacccccatattccagctcagtgtcccaaaatgtgtcagaagcttgcaaagactgacctccccctgcgtaggggtgaatacatctggtgacacggggttgggattgagtgaagggaacagggtgaatcctctaaagagaccgcaagcatcagaaacgctttctggcctctcctttctgaaatggggctgaggaaaggagaggctgtagcttccatggggagtctacagcaaccaaggaagaacccccttccccttacacacacacccaagatgcacgtgacggtggtgcgtttttcatactcactcaattgtcagaagagacctgtgaccctctgtacctctgagaggcctggggagacacacacaggagactataagcccggacgggaaaggagaggtgcagagagagatggatgaagggctctggaaggccaaaggagggaaagggtgctttcccttaagtgggagaaacgtcctctggctcagaggttgaggggaggctgtgggtagggagaggtaggttaaagatggataaattcagaagatgccggaggtgactcccagaggagtcagatgattgaaaagtaaggaaaggataaaatcccttattccatggggcagtcccatcccagctggacattcccaagactcccaggaaggatctgggaagggagggcctgagaagctgcagctctgctgagcgccgctgtgttgcactgctgggtcccatctctgcaggttctgcagccctttctcgtaagggttggatggcaggtgggtggtgagtgaggactcggagcctgaccaccacttgtgttcacatcacagctcctccgtttgctgactgccacattggacaggagacttaatgctgtgtgttccctttaaaatgggaacagtcatagaattgctgtgattcacaagtaaaaagtggaaagtcctgagaacagtgcttggcacaaagcaggtgctatccagatgtcagctggtagccattatttttgaataataaaaaaatgtatttatggtaaactccaaggaccactaggactgttcgacactactgaaactcggcttccacataatattctctaaaatatttgagtaactattcagatataagctaaaacttttaagtttgaaaacaaagttctgtgttttgatccatgtgtatttgattttttttcagcgttcccctttcctcagaggttttttggttttatgatttttttttttttttggaacagggtcttgctctgtcgccccagctggagtgcagtggtgccatcttggctcactgcaccctctgcctcctgagttcaagcgatcctcctgcctcagcctttccagtagccgagattacaggcgcacaccaccacgcccagctatatttttgtatttttggtagagacagagtttcgccatgttgctcaggctggtctcgaactcctgggctcaagtgatccgcccaccttggcctcccaaagtgctgggattataggcatgaactaccacaactagcctcagagttttattgaaataatttacaaataacttatcacccaagcatcttctacttagtattaccatattaatcttcccagaaaccagttccaatttattgaacatgtttacatatattttttaattttttacccagctttactaaggtaaattgacaaataaaaattatatttatttatggtttatatgttttgatgtatatatacattctgaaatgattaattcaagctaattaacacaccatcatctcacacacttgttttttttgtgataagaacatttaagatctcattgtttagcaactttcaggaaatgttcaataaaatatgaatgaaaaacaattctacaccagttcctaaatgacgggcactgttgtaagcccctttgaatctcacagccatcatcctatgagcagggtgaccatgctattgattgtaaatgaggggcactttggagaataaaagggaaccctaaatgggtgggatgccaggataacaatgtaaaccaggcctgtcctgagcaaactggatgtgtgatcaccaccctgtgaagtgggcagatcatttcaccccagctacaggagaaaggacacagagattccatagaactttttgggacacagctgggaagtggcagaaacaggatatgaagccaggtgttctgcctccacaagctgctgtcaacactatttccctccttggctggacactgagaagcctgcacaccatggttcaggtggatcctggtgaccttgacacccactgctgccctgtgggaactccgtgtggatttctgcacaagacccgcagttttctgcttgagaaattattgaaataatttacgtttactttgcaattttaccttacagtaattgaacaattttactctgctccctgtggtctccactgccttgccttagtcactctgggttgaaacgcttcattcattctggaagccacatcaaagcagctcacaccttgtgttctttgctggcccctccaactccctggatctcccctttcccagggacctgtggctctccgtgggcagctccgacctgacatcccctggagctgacctgtcctctctgttcatgctcctggagaacatggcctctctgcatgtcctgcttctgtatgacaacatcatacaataagtgcttaatcaataattttgtaatttattttctgggccaaaatttggtgctttacaagagttcactgatgatatctctcatgttttagtacaaggtctatctaaaaagaggcactcattgacatttgaatctttagtaaaggcagggattacacacaacactaaccacacatctgggtgacatcctgggcactaacactaatgttgtactttcttggatgagggctttggggtcagggtgggaggagacaggcaagggaaggaggtagttggaggctgtgccagcttggggtggggccacctcagtgttcctttttttttgagacagagtctcactctgtcacccaggctggagttcagtggctcaatctccatctcagctcactgcaacctccgcctcctggattcaagcgattctcatgcctcagccaagtagctgggaatacaggtgtgcaccaccacggccagctaatttttgtattcttagtagagatggggttttgccatgttggtcagtctggtcttgaactcctgacctcaagtgatccacccacctcggcctcccaaactgctgggattacaggcatgagccaccacgccagcccagtgatctgtttctcaaaaaatgacgattaccacgatatgatctgacctggattcatctaatgagttgggagatggagctggattaggaagcagagccgaggtcaggtgtcagcccctggctaattctccttggctccttaaccaaaactatgaactttacttaacttgacatttccctataatgtgtggtgaaaagcttaatcctgtacccatgtaacaactgatttggttcattagatatttacactaacatcttctccattaagttcatgacttttttttcttttcaatgccccattcgtttttctggtaactgtggtgatcccaaagttgtgaacgcctgccttagggccattgcaagagtcacataggagaaccgacataaagttttccactgtagagcagcgattgtcaactagggcacacctactcccatctcctccctattcccaaagacatcagtctggacagttttgggtgtcacagctggatggtggtagggtactatcagcacccaggggacagaggccaggggtactgctgaacctcctacaatgcaaaggacagatcccacagaaaaaggattacttacctttgatgtcagtactgccaagtgctagagaaatacctgcacacatttgctcttgtgatgaatgaccagtagcattcgtgagcctcatactcagcaaacagggagtgtagccccagcctggcaaggtgccagcaggaatgtgggcatctttgtcctccaggtggttgagtcagcctcatgtccatgcctttgcccaggctgctccatgcacctggaggccctgcttcccctgcctgtcatcctcgtcttctaggtgcttcatggtccaactcagccatcacctcttccacaagctttcctttctatatccttggatttctataggtttttaatttgcataataagatctcatctcagtgatatacattttaactttcttcagttctatatcgtgtcttcccattcaacttgctgattaattccttaaggaaatttatgaatcctttcaacaaaatgtatcaccctcccccatttggtgtggtgtcgattctgcattgacctgagaccttctttctctacagaaggatttccatgttccaaataatcttttattactgttctcttgatttatccactaactcctattttcatcactgtttaccgagtcccatgtctttctctttcttgttgtacttgtttttgctggggtctgtcctccagtaccttttggagaagaagtttattgggcataaaatgtttgaggatctttattttatctttgtgtttgaatgagtaggctgattacagattcatatttgtatagaattagaggttgacaatcctctgattttttagtatttatc

SEQ ID NO: 15243 - DNA, 12284 bp, Human
ccttatctttcacgatcttgacaatttcaaagagctctaatcagttattttatagaatgtccttcaatttgggtttgaccgctagttcctcatgataggaataaatttagcattttggtaagaatactacaatgatgcccttctcattatatcatatcaagatgttcatgatattaatatgacatcttactagtgatgtttagcttgtttctgtctgccaggttcctgcaccagaaagacaccttattttctatgaacttggtaaatattttgggggagatactttgacactatgcaaatcttgtttctcctcaaacttcacccatgaattttagcattcactgatagattatgtctgcaacatttattactgtgctgtatgcctaatagcaattctgtctttactttcttctacatttattcattggatcttctacatttattcattggaattatattttgaggaagacctgcctctttcctcccatctgtttatttcatcatttctattagtatgaacctacagataattgttttattctggggttaaaatctaatactatcactattttgttgttcaaattggtacagctttatcattaggagctcccgttctttcagcaagtcctctcctttttaaaattattttttatttttttaatattcccttactttccggcaccacaagatgctcaaggcccatcctatatttttcttgtctcgtccccggaatcaaccacttgtaagagccctagttcctttactggaaaaaggtgtttagagaccagtatctgggttctaggcgttctcattgttactggagtcactgcttctaggcctctcagctgagataggcaggaaatatatgtatgtatactaacctatacatgtataaatatctgtatttctgtattttactgtcatacatttaaaactatgggtttatactgatacttctgatcccaaactaaaaccacaggattcattttagcctttaacatttccttgtttataacgtctttctccacaagtgagaaatccagctttcactgttggcaacctatgatttgttcaattctagtaaatacataaaatagttacagaattgctaacctatacccctgtgagaaacactaaattataaacagttctgtcttcacctttacattatatcaagatacgcttttggtagcattttattatttaaaaatcggaacaatatatttaagattagcacggcccctgtgcatggatgatatgcaaattcatgaagtgctcaaaaaaaaaaaaaaaaaaaaaaagacaggctttaatacagactttagttctttcttccccacccttttcagtggtgttatattacacatccgtaatacaactagccttattttttagtttttgaattcagttttgggttccccctacatcctagttggttttaattgtctgattacatttggggtgtgtgaaaaatatgtgacacattactatgatcctaagagtcaaaagtgtcactccctctttgttcctactaacctgttcccattccctcccttctttccacccctttcccacccacccctgcaggcaatcaatctctatagttttggtttgtcctttccatttcctttgttcaaataaacagatatttgtgtatactctgttatctcctgtatcaatctgagttcaattaggaagaaaaaaagaacagcaatttgaacaaaggttaaggattcaataactttaacagaggattggaataatgagggattggcaaggaagcagtaaaagggaacactaaagtatagaataatagcaaacagaaggagcaccctacccctagggctgagaaagagcacagggaagtccttttttcttcctggacagagatccagacgagctggagaaagaagttgctatggtactgcatcagtggaacttgctggaaatccaccctcaagggcactaggaaaacctgttcaggggagctgtggagggaaatggggttggcaggaaagctgctgggcgcggggtgcttcagactgcagtgtattgcaggagctgggcactggggaagctgtgtgcactgcaggatcctgctgagccagcacatcagatcaggaagcaaaacctttgagactcctgagaagtctctccattgcccttcactgacaaagcttaaggatgtgctagttggcaaaagaaaagtatttaaaaggccaaggtccatttttacagagcaggaaaaagaggtaaatttgaagatgagagccaataaactacacctggcacacctttcttacatgaaaggtggcatatactttgggactttgcttttttcacttaatagaatgtactggaaattactctgaattaatccttcctcatcctttattctagctgcaaaatattaccgtgtggatttcccatagcgtattcaacactctcctctcctacgtctgtatatttaaggtatttcaaatattttgcaattacaaacaatactgcaaggaataacaagcagacagaaacaagctaaacatcactagtaagtattgaacacatgtattttcatattgttggaggggtacctttggtataaattactagaaatgggattgctcggacaaaaagtattattttcctcattaatttctgttatctttattatttcctttctagtattttcttttcacttactttgttgttctttttttgttttctgagctggaaatttattttctttttgtttttttgacagggtctttttctgttgcccaggctggagtggagtggtaaaatcacggctcacttcagcctcaatctcctaggctcaagtgatccttccaccctggcttcctgagtagctgggagcacaggtgtgtgccaccacagctggctaattgtttttattttttgtagatacaggttctccctatcttgccgaggctgttctcaaactcgagggctcaagcaatccttccatcttggcctcccaaagtgttgagagtacaggcatgagccactgcacgcaacctgttagtaatattctatgttatgaatgtcattgatgtttcctttgtgacctaatacataatcaatttttgtgaacatgtcatacagttctcattagcagggagcaaattttatgtatacgtacctccataagatataaattaaaaagtgtcctttatcacatgtaatactttggggcttgaatactatttgtctgatatcagcatcactactcctgcttgatttttgtttccatttacttggtatactttggtctaaccctttatttttagcttttcggaatcattttattttagatgtgtctcttgtcatcccaagatttttgttttacaagccaaattgaaaatccttttttaataggttgcttaagactaatgtatttggtctcaactctatcacaatattttctaattatttgtattttgttgtaatagctgtttttcattatgaaatgcatacccttcttttccatttaatttttagaaattgagggggagttgatatttctattattgttctactggttacctttctactcacattttttaaatcctagagttacccattttcttatttaacactttactatctggtgtgtcaggttttttctcctctgcagtagtctttaaaacccatctattgcccacacattatccatttttctccttccatcattttagttgcaatactgtactttgttgcaatacccaacggttacacaaatcttccaccctcatcctctctgtattagtccttttgctgaaaattttccagtcatcaattggttggataaagctcattctcttgtatattcctcagaaatggccagcaggtacagaaattacccaggttttcgttatgtcgaaaactctttttctataaccttgacatttgagaacattcagttagatataaaatccttcaattcacaccttcattgagctttaaaaaaaaacactgctctatgttgccttgctttgtatgtcagtttttcaacatgtgatgctttttgtaagtttgcctttgtaagttatatgttctttttgcacagaagacttgatgatttcatctttatctctgaaatctaatagttgtactaaaatatatcccaaaagtcaataagtctgggttaatttttccaggtacctagggaaccctttctagatttagtttttttttcaatttctggaaacttttgctggattatgtttttaaacatgaattatgttccatttctttttcttcttcagggactctgataatatgaatattatgtctttgcctatctacctaccattccctactttctcggattcatcttacttttttctttgtcattttcaattctcttcgttgtttttatgcctttcttcattgcctcttgctttcatttcagtctattttcccttaggtatcttacaatttattcacttatgaggtaattgtctttttcttccatttcttccctttgtttcatcaactcttttttcatttctcctttagtcatcatttccattcttattaatagttttaaaaattctaagccaaggtaaacatttttataccctcaaatgcttatttgagtatattcaattctgtttggagtacagacttataggctttctcttttttttttttttttgagacagagtctcgctctgtcgcccaggctggagtgcagtggcgtgatctcggctcactgcaagctccgcctcccaggttcacgccattctcctgcctcagcctcccaagtagctgggactacaggcgcccgccaccacgaccggctagacttaacaggctttacctgtttccgagtggaacaggtagtctccaaagttgatctgtataaacagttatttcctgattatctgcaacaagctctcgttagattttatttcctcttgctcatttttgtaacatctggggcacagtgatagtttacaagattcccagtttgatggtgctcttttctgtcattctagccaacttcagatatatgagagctgtttgacagttttttttttttttttttttttggagacagagttgcgctgtgtcacccaggctggagtgcaatggcgcgatctcagctcactgcaacctccacctcccgggttcaagtgattctcttgcctcagcctcccgagtagctgggactacaggcgggtgccaccacgcccagctaatgtttgtatttttagtagaggtggggtttcaccatattggccaagctgctgttgaactcctgacctcaagcactccaccctgtttaagtttttttaaaaaatcatttgtggttggtttggtggaataggagttttgagttctccaatttcatggttcttttgttttttgtttttgcaggactctgtaagttccttttgttaacctttaaacagtacatcctggacctgtaaacagtgctttcttggtcacaaaagtgagggggatgggcagaataatctaaaatttctattgtattaaaagtaatgttgctgaagggctgggcgtcgtggctcacgcctgtaataccagccctttggggcaaggccggcagatcacttgaggtcaggagtttgagactagcctggtcaaaatggtgaaaccccatctctactaaaaatataaaaaattagccaggcatggtggcacacgccagtaatcccagctacttgggaggctgaggcagaagaatcacttgagcccaggaggcagaagttgcagtgaggagagattgagccactgcactctaacctgggcaacagagtgagtgagactctgtctaaaaataaataaataaacaaataaataagtgatgttgctgaagcttttggaatgacaagtaagttttagcagcacccatgtattaacaattatctctcctattcctaggaattaaaaccaactaagtagtcaaaaaaaatgtcaaaactgccaaagctatgtagtttgctatagattaagggagcaacatgtatcaaggaagaatcaatatctaccaactacctttggtcccttatatgcataaaacgagctctttcatttgatgtgggaaagaaaaagtaccagaaatttattttatgtcataataaagaaatgatgtacttatgttttatttttataatataataatgtgaaattattggtgaggaaaaggaaggttcagagaaagataaagcatagagatacaaatttaggcttttgccacaagtctaatttttttttggcaggaccattaaggttaacaatggtcatgtattaaatacactagcttcacagtatatcaaaataaccccagttgaagaataccgtactgatttacattagattatatataattctacccacaaatcctgtttggagggactagaagaaaccaaagagatctagttgacctagtagtgcaaagtagtcaagggaaataatgtttaagcagtcttaaaattactatttaacatggcttaacaaaattactataaatcaatgaatacattattaactatagcaaaaaagagtctgctttaatatgattatcatcaacgttcttttttcagtctatctctaaaaatcacttgcctgagtcttctgaaagtttcatttattccactcattctacaaatatttgttggctccctactatgcaccacagttctaggaattggtaatatagcagtgagtgtggcagatgtaacttaaggaactttcaagtgtagctaagaagacagaaaattaaacacgtatattacagatgtgatgagcatttcaatagggaagcatagggtgctacatgagcatacaagatgacctaaatggagtccgtagtcctttagctaagacttgcaggatgagtagaagtcaacaaggtcaggagataagcaagaatgactgttctgggcaaaggcctggagtgagagagcatattcgaggaactgaaacacagtgcagtgtggctggaacactgcagagagaaagcttaaaaaaaatcagcaaggtcgggccaggtgcggtggctcatatctgtaatcccaacactttgggaggccgaggtgggtggatcacgagaggttggccaacatggagcctgaccaacatggagaaactccgtccctactaaaaatacaaaattaagcgtggtggcacatgcctgtaatcccagctacttgggaggctgaggcaggagaatcacttgaacctaggaggcggaggttgccgtgagccgggatcgcaccattgcactcaggcctgggcaacaagagtgaaattccatctcaaaaacaaaacaaaatgaaaacagcaaggtccactccttagaggcctttgtgagccactacagactcaggacttcagcctaagggacatcaaaaggttttaggcaagggagtgacaatcagatgtgcattttagacaaatacaactaatcaatcaacaatagttacagagcaccaattggagcaaggcagtatagtaggcttgagaacaatacacagatgggagtttggactctcattgagccttcaaggactttagaaatgttaagagtttaaggcagtataaatgcatctgtttcctaagggaaagatgggttgtggtaatctggaaaggaatctttgggcttttaaaaaagtggtatgggcaaggtgtggcggctcacgcatgtaatcctagcactttgggagaacgagttgggcagatcacatgaggtcaggagttgaaaccagcctggccaacatggtgaaacccgtctctacaaaaaatgcaaaaaagttaggcagccgagggtgcaggcaccggtaatcccagctactccggaggctgaggcaggagaatcgcttgaacccggaggcagaagttgcagtgagcagagatcacgccactgcactccagcctgggcaacagagtgagactgcatctcaaaaaaataacgtaacataacataacatagaagtggtatgtttcagatgggagagaggccacatgcatcctgagccatctgaaagagaaagtggttgaaaataaatctggaaaggcaaatttgggatatatgtggaaggcttcaaatgtctagctaaggagtttgaaatttttccatataggagatgtagggccatagaccatttttaagcaaaatggcatgctcaggcgacagcatgatggataaatcagtgggagaaatgactgtacttatcaaagacacttaagaaccttgcatagtgctccaggtgttgctgctgtaaaagtcagcagtagggaccaggggagcagatttagcagttattatgaaagaaaacccaagtagagttgaaatgactgcctgaatatttgagggggataatagcgtaggatcaagaacgacagaacatagctgaggtagtatgaaataagtggactataaattggaaattataaatttcactattacatgcacaatttctctatattatcatacaacagtgcctctcaaagagtggtaggcagaccagaattcatctatgacctatttgttaaccaatctgtacagaaaatgacagtaagcatttagaaacttccattatcattgaataattttgtctattgaatttaattaaaaatttgaacttatattgtgtttgtcttttttaattccatttttctagtaattctttttatagtattttatcaaagcataaatctgtcaaagattaaaaatttttaaaaacaagaactgtcctttaccacaaatagtttgaaaaacactgtcagagtatttaggttgccccccagatctaagtagattacctctataaacaaacattcaaaaatattaaaaaataaacacaagtttgaatatggactgaatattatagattatgtatttatggttttcttaggtataataataccacaataattatgtaggagaatgatacttttagaagctatatgcttatgtatttacgggtaaattatcatgtctaacttactgaatgggggatagcaaaatgaaaaaacacacagcaggcatcccatacacacggctaaagtaaatatggtcaaatattaagaacagctgaatttaaggggtgggtatacagacaacaatcaatactgcactttcaacttttcaaaacataatgttgaaaaaatgtttaaataaataggtcataaaaaccaagtcctccataccccaaagtcaccaggtcagtattctccggaatgacttctggatcctcaccgtcctcaaggcatttcagtttatcaaggctaaaacaaaaaggaaaagcaatactttaaggtcgactctgcatctggttcacagcgagttagggttgttttcctaaatacattactgaattacgaagtcagataaaatccagcaggcggctcagagaggccagaacttaagacaacgatttctgtgattatattttataatgaaaaggccgatgaaggcagccagtactgttaaatggagaaagagattaaagttatttttatattttcatccccaaataaggcacttttaagaaatatttcagtaacagaatacccggaaggtccccaaaagaaaccagttagtcggggttttaacactcctctgatgaagtctcccgcagcttcagcattactcaggttcctccattgtcaaagtgtctgtcaatggcaggtacacgtcgctgttgccctgattgcttttctttattaacaagcactcttagaataagcaaatggaaaaactagtctttgatgcagctgtcttgtccctttgctccaactcgtagaaactgtgcattcgggtcccaggacttctcctggtgtcccaggaaggctccagcgggttgaaagctttaaagggtaatactcctagcccaggtctaaaccacaggcccttctcagggatgagtcccagaggagcgcacgagcaaggctgcaccctgtttgaccccaagctgcaagagcccctttgctccgcactcacccgcacaccgccctcagctcagccgccgcctccaggctgcagtccagatccctggccaccgcggcatcctcccggtcggagtcagctgcctggctcccaggcagagcggatgccggcggctccctcagcgacaagtccccggccccgcgcagacggccccgccacagctccccaaaggcgcccacatggaaagcgcgcgtatttagctcgggaagctcatactctggaaagttgcagccgccactgccggagactgggtcctgcctgccacccaccccgctacacgtagggccacctcggcttccttcagccatgttcgccccactccttcccctgcaaaagcctgcagatcaaggcctcgcagagcgtgatggaagttgtagttgcttggggcgcccggccggcgagcggcgaggcggcgcgggcagggcatcagaaactacatttcccggcaggccatgggcaggcccgccccagggcgcggcaccgcgaggctctacgtgcagggcgcagcattgttctccgacccgggcggtgcgggaaccgttgcggctgtcggttaaccgcagcgggtggggctgggtttctggtccccgagttacgtagcaactgtctctgcccggtagggcggcctcgccaggcgcttaggccccgttccttgcggctttcggactaaggggtgcagggctttttcttgactggggttcaaggactgctctgctgcctgattgctttagagcctaagaaacaaggagggcgagggccgagaccagggacacgaccagccctccagatctggttctttcacaagctccgcagaggccccatgttggtgtgcgtgtgcagtagtgtttcagagcgtctgtgtatcacacgctacatgattaaccctaatgtatgtttttaatgtttttaaaaattacaacaacctttccggatagggcgtatcaccccgtgttgctgttgaggaaggatttacctgcggggaaaatagaagcaggatcggaactcagtctggcttcagatggagctctctccatttctcagaggccctgaaggatacagcaggacatactatttatttattagactgtaatcacatgccatataattcacccatttgaagtgttcagtgatttttggtatattcacaggcttgggcaaccatcaccactatttgagagcatttttaccactcgaaagaagaaacttgtactttttagctatcacccctgatcctcccaactcctccagccctagccaaccaagaacctactttgtctctctagatttaactaatctggacatttaatataaacggaattatatggtcttttggtggctggcttaatgtttacaaggtttgttacaggtagttaggcatgagcagggcaggagagggctcttccctcacccactaggaatgtggggtgatgcttaggcatttatcacattgcctctaaaagtgataaattggcagccggtgccagggagaggccatttcctgatggctcacacctgttgcactaaagtgctcgttgaatgcaggtgacagggagaagcaacttcctgggcatatgcattaagagacaaaatcggggagtatgacctttcagggggactctatcggaaaagggaagaaagcctcagatgggcacgcatacaacttcatacatattgcgctgtgctcacttcccaagggtaaggagggcactgcgcatggaggcagcccaccctaagggaagaatcatgggaaaggagccagcctataaagtcctaggatcgaggtcaatatcacagttgacctcagtgacagcttgggactcttccgagcgtgctttcctttctttcctaaaggccttttaaataagcttccactcctgctctgaaacttgcctcagtctctttttgtgccttattgcccctcggtcaaattctttcttctgaggaggcaagaactgaagttgctgcagacccatacagatttgccctggtaacttggatacctgccacctgtaacaggttcatccattttgtagtatgtgtcagtacttcattccttttttggctgaataatattgcattgtatgtatatgccacattttatttatcaaaaagtttttaccttttggcgttgctatgaacattcatgtacacatttttgtgcaaatacgttttcatttctcttgggcatgtgcccagtagtatacagtcagccctccctatctgtgggttctgcatcctccaattcaaccaaccacatatcaaaaattacagtattcccaggttg

SEQ ID NO: 15244 - DNA, 17003 bp, Human
tgcaatgagttattgtttacaaagcacctacaaaaatacctagcacatagtaagtgctatgtatgtattttcctttattattatattaccttcttcaatccttactacatacaacctcttgggcaggcccagcctcacaggtgtaccacccgtgcagtcacccaggaccccaggctaagaagggcctgtgcttggtttaattctctgctgctatcatcttgaaattcttaataaaaagggatcccacatttacattttgcattgagacccacattttcttgaggtaggtagtattattgtcccctggtattattgtggctttggacaaatagcatcctcagtgttctcacctgaaaactatggtgtagttacccagtaattacaaggtccttgggggaattaaatgagatactgaatcagcagtgattggcacatgtaagttctcagaaatggtatatattattattattgttaccatttctctttataaaatagctaacctaatattaccgtgcttctataaattcttattcttgcttgcaagcacaagaaactttcagtgcagttaaaggtttactgaaagtacagaataaaatcataaaactgacctctggcaaaattaagataggtttatggagggaaaaggtcacatatttactgttggagaagtaccttattaaaatctgaggcttctgtagatcttaaaactgaagaagttttttgttctatagacagactagagaagcattcaagaccttcgagaaacttttcaaataaataatattatcaataaaaaataggctcaatacaaaataaagcaaaacactgaagactacatcaatccaaatatttattcatactgaattttactaatgtaacaaatgaattaatggagtaagacccctaaagtataaaggcaaaggaaaatgtaagaagaaactaccggacaccacaattcatttgcaacatctcaaattcagatcattatgatttttgttaccagtaagatactttatgcgttaacattagttgtatcgtagaaggtaaatattttgtagactttgatgacatgtataaaatattattttttcaaaaataatttaaaggtcaaaataacatattcttttataatttgctttagaagataggacagaaatctgtctctatagaggcaagaataaggccttgcaaagaaaattggagtacagcatttgttttgacaaaaatatataattaacggaaagttattttatttcacttttacagaattaagaatataatatatgttctttccacaatagtatttgccaatcaaaacaaaactaatgaaaagcctctggcaatcagaagttcttctgatttatttttatatccatcctccaaattttaatttgttaggtaagtacactctggaaagataatctgatgataggaaagtcaaagcttgaatttctgccttcattttagagtctgccattatttccatctgtcaataaaagtaaaatgtactcataccagagttcttagttgcatttctgtcaattcaacaaactagtaatctagaattgctttattctccaaaaccagggacaatagtcttaagggtcagccagaatattccagagctgctacagctaaaaatatctggagtgagagtactctgtatgctgtcttcaataattagggatagtctgaaatctttatgatttcttcttcctttttttaatcccacaaactatgatacagccatcaagaatgtgtatataaccatgataaggatacaaacaggccagctccattcactgatctcatctattagcattcatatgactcaatttcaacaactatttactgccaaacaacacttatgttagtcgtgtcatataaaatttcaagagggatattttcaaaatacgatgtgaatagccactactaaagtaaaagacaattaaacatgcaacacttgagttgtaaaaggaaacatacttcttttctccaaaatggttggcaggtaacataaggtctcctcaggatactgtcaagtttcatttggtccctttttgtcagtggaatcaaactatctttaggtacatttaatctggaaaaaagtaggtgaaaaaaatcagtaaaaaagtgtttctgtaacttgaatgtcctgtattttgcctgtatttatggtactacttcaagaaactcagaaataagaaaattagtacagatctacctcttacatccaggattgaagggatctgtcatgtcttagaccagcaagttttcaagttcatagtggaagtttgtgtttccacagtaagattctaaagtttttgttttccttcatgtcacactcgtgggatgatgacaggatgacaggaagactgatattggttattaaacaaatgccaatagcactaccatcaggtatacagataccagggcagcttaataatgtacattaagcctctcagagcttcacactcttctggcagtgagctccaatatgcatggccaacggctgagattcactgagggactttaggttccattgagtatttaattcttcataattcatttgaagattctgggccatggaagttagtgtctcacttttatcattttacacacacacacacacacttttatcactttacacacacacaaacacattcttacctatctagttttaaatttgaaaaacgtggaatataactttatcatggtatgtgttttaaaaatagaacatgagaggtcctggatttatggtgtggactaccttttgaagtcacaaatcctagatttcccaggagagtctttttcaatgtgtccataattatgaccatttgccaggggcagttcttggataggggtgacaatttgattgaaagggaggcctggaggatttcccttgcagcctggcttctgtagctaccatagtgtttttcctttgatcgtatattcatttggagtggctttttagtgcactgatagaatttatgagatgcagctagagtttcttgaagctattcaccttactaattatcagatcatatgtcttgaatttgtgttaaaattgtttttatacaaacagatcacccccaagggattctgaccatgacacacatacactaaattgaacacgttaatccagtggagtgtgaatattcaaaaataaagaatgaaatgtttcctcttggaccctcattttataggaagtggctgatcacccaaaacctgttcacattccatatttaggaaacaagcaactgttatcaaggattgctcaccacttaaagaaatccaataaacatgtttaaattcattcttactgaccaattacaacaataaaacattttaaaatatcacattagcagaggtgaaaaaaaatgttaatgccataagctgagggacaggtggactcttactcttcagagaaagcaagaaacttaatctatccagacaacagtcaaaccctgattatggggatcctctttgacccaccagttcttctgggaattcagcctaagggactaactaaggatgtgcatagagatttagttacaagagactgcatcaaagcacgacctatcagaatagagatttggaaaccacttaaatggctatgagggaatggctgaataaacactagcacatctagagttaaaactcagcaacaaaagatgctaaaataagaaatgtactttattgacatggaaaagtgatcacattattttgttgtgttttaaaaaaagcagattataaaataacagagtatgatctcagttttgtgaaaaagttatggctatgcacagaaaaaaaatctacaaaggtaaggctgctgatctgtaggtgatatttaacttgttgcttaatatttttttctataatgaacatatataataaacttgccaaacttgaagttcccaaattttaatactcttaaaatgatatttttcttttgaagttaaaaatttaaatctatgacaaaaattgattcatatggcaaatgatgttgtcaatggttacaatttaattggatttactatattgtacttttttttttttggagacagagtcaagctctgtcacccaggctggagtgcagtggtgcgatcgtggctcactgcaactgccgtctcccaggttcaagcaattcttgggcctcagccttcccggtagctgggattacaggcatacaccaccaccacacccagctaatgtttgcatttttagtagagacagggttttgtcacgttgccctggctggtctcaaactcctggcctcaagtgatccgcccaccttggcctcccaaagtgctgggattacaggcgtcagccaccatgtgcccggcctacaatgtattgtacttttaagtataaaaagtgtataaaatgtcttaaccataaaagtaaaacagaaagttttagctagctgaaagtgtaacacattaaccaaattcatgtgttaaatattttagtagttgaaacagaaacattaatgaatttaattcataattacataatcataagtcatcgtggacaatataaataaaaaacattaagagctttcccttgtagtgactttttaggcttattgttacatatgataatgaactgtcattttaaatatcctagttctgctatactatctaaccttttaagatcagaagggagaagaccaagccatctaatagctggaactgtgagatgatgagcttcaaaagacatagactaaaataaagaacaaaagtatattaggtgaggctaaattgtagaaaactagcattcttgtttttcagtcaaatttttcacttattaagaaggacaagtactaaagctggcttcacatgcccagagcccacagaagtaagaaaaccatcaggggctatgctaagctgggcttttagtgaaggtgttaaaacttctctgggttaagtgcggtggctcatgcttgtaatcccagtactttgggagaccaaggcgggaggatggcttgagctcaaaagtccaaggttgcagtgagctgtcactgcaccaccgcactccagcctggatgacagagtgagaccctgtctcaaaacagcaacaaaacaacaaccacaacttctatatagtgtttctgtattaattttctaaagcaaactataaatgaagccctctgacctacatttcttattgttcatgattccccatcttacaccctgctccaccatccttttcatctgctataaatttcaccatgcatcagaatgcttggaggatcccacccctagagattttggctcagtagttctggatggggactgagatttgcatttctaagaatcttccagatgatgctgatgctcctggcttaggaccacactgtgagaccactggtatatggtaattgtagacactggtggtgacatttattgtttccatttctccttatggtgggagaaaagggattagaaaagtcagaattcaaggctctatataatatttcgagtatatttggtgatcagacagcgttgttgtcaccccagagccccacagttccttcagtatgccaagagagtgcaggataataatgctgcttgcccacagctaatcccactctgtcatctgtgtttgcactggtcatactgggagctggagtcacagccaccgacacacagattgctcctagaataggatactaggccctcaggtacactttgggcactctcagcctgcttgggggtgattaataaatgcagaaatcacctcaatgaatataaaatgtctaaataataaaaaaggaaaactgcttttctatacttaccatagatccatacttatagatgcacattatttctatgcctgttaaaagaaagttaactataaaattagtctccttacatattacaggttaatttgcactctcaaattttatctatctataattttaattttgtggacatcaccagtgaaaaatttatcattctcagtttaatatgacaaagtaacgataaattgtgtcaaataattatagaccaaattttaatgtaatcattttcttttaaaatgtttcataagtgtcccgagagtagaaaacacaactacaggctgggcacggtggttcctgcctgtaatcccagcactttgggatgccgaggtgggcagattacctgaggtcaggagttcgagaccagcctggccaacatggtaaaaccccgtctctactaaaaatataaaaaattagccaggcatggtggcatgtgcctatagttccagctactcaggaggctgaggcaggagaatcacttgaacccaggaggtggaggttgcagtgagccaagatcgcgccattgcactcctgggtgacagagcaggactcaatctcaaaaagaaaaaaaaaaaaagaggaagaaaacacaacaacaaatatgatttagttatgactattgttgtaaatagtccagtgataaattaccatgtggatcagcatctacaagagtgaaaacaggaacatgaaatgtatcccacagtttcttgactaaaagtcttgtgtttagatcaggaactccctttccctaaaaggaagatgaaaattaagaattttaacttcagtagaataaaatggttacaattatactcttattaataatttaaaagttaggctggacgcagtggttcacgcctgtaatcccagcacgttgggaggccaaggtagggggatcgatcacctgaggtcaggaatttgagaccagtctggccaacgtggtgaaaccccgtctctactaaaaatacaaaattagccaggtgtggtggtacacgcctgtaatcccaggtactcgggaggctgaggcaggagaatcacttgaacctaggaggcagaagttgcaatgagccgaaatcacgccattgcactccagcctgggcaaaaagagtgaaactccacctcaaaatcataataataatagtaataataaattataggttatgctcatacaacggttagtactctgcatgtggccacagcaaccctggttcatatctgagtcacagcaccaaaaaaaagggttacatcttcctaccttggatttcaggtgctgaaagactggtgttgactgtgaaaaaaaaatgtacattatatacaaacagactgaaggactgggaattatgccagtcctaggaaatggtcctaaggaaatatttcagcaaaaacagaaataataaacatcctacatatttaaagatgctcactgaagtgttatttaaaatggcgcaaactaatataaatagccaaaatatctaacaacagggatgtggagaggcagcatagtacagcggtgatctgcagcagttgcggggctaggcagcctgagctcgcatctcagctctgctacttcttagcagcatgaacttgaatgagtaacaaaaccactctgtggtttgatgctctgtaacaacatatgagattattataggaattaaattatttaataatcataaagcacttagaagagtacctggcttaaatttagggtttaataaaacttaaatggtgggataatattatgaagtcattaaaataataattatgtagaaaagtaaattgaagagtgttacaacaatgttagagaaaagcagaaaaccaaatgaaacagagagcagaggaagagcgcagagtagccctagagattcagaatgggcttcgggtcacagctccgagtttgaattccctctctgcccatcatcagtggtgtgatgttgggcaagtttcttagtctctttaggccatggctttatctataaaatcagcataaatatgcctatcacaccaagtgatggcattatagcaacatggatttcaactattcaaatccagtcctggttttgaatagccatagagacgtggtaaaataccttcctgcattccagtaccccattattaaagtgacgatgatgttagtacctacctcctaaggccattgagagcctatacaagttgacatgtgataaacaccagtaaatgtgaactcttactatgtcaagtgcttagcaggggtcctagctcatcgtgagtatttagtgtattttcataatgttctttgggaaaaataatagcacatgaacacagtagaggagtcaaacagggttaaaggacctggtgaaaaatggctcttcctaatatggccctcgagtcccagcctcttcttgagaggcatttgcgagagatgtttatggaggcagtgaggagcgctgccctggagaggaggcggaatggagtcttagaagggctgaccagttccacagaggcatccagatttggagtagaagtatcagacaaaaccaaaagtttttgaactggcaaggagggaaatgacaagtctggtgtggcagggatgagagataattgaagtcaggggcctgtctggaggctaccaggtggttgtcttgtgtaagaatgaaaggggaaggattaaggagaaagggctgaaatgaaagagattcccaaggccaattcaaaaggacttggtgaccatgggatgtgaggagtaagtcaaactgactctgacgtgtggacctcattgcagtgtctgcactgatagccacaggacaagtggcaggaacactcagcttttcaaggaagaaagcttttgagtgtggttttagaaacatgaacttatcaaggttacagtgctctatgatcatgccatggtacttcggcctgggcaacagagcgagaccctgtctctattaaaaaaaaaagaacttgaggtgatagccagctttgaggatgtttaaataaacacattggaaattcccgttctatgatcccaaaggatgcattatattgaaaacaggacattgtgtagataatattgtaaatcctcttaccaatcaccataacagtatacattagtcttggaattgtagtaaagttagataatataccgtaatcatgatgcaaggagacaatttgttgcaaaagttgtcatctaggagccgctgaaatgttgcatctttttctacaattaatacaaactttgcatctgtaactaaatctgtgaagttaaggctgataaattgaaagcaagagtatttcaatttaatcaccaactaaattaaggtgccatatagataattcaaaagcagctatagatacaacattttagtttgtaccttcaaacatataaacacatctattcatatattcagatatctgtctcttccactagatggtgagctcctaaaagagtactaaagaagggaccatggtgtgttcatcttgactgctacagggcctaacttgttccttacacattatgaaggcttggcttaccaaaggaattaatgaatgaatgaacattccaaaagtttaaatagttttcccacttaaaggatactccgaattccttgaatattcgatggcacagcaacagccttttaaaaaaaaagtttttatcttacataaaaagcaaaataaccacatttttagtttatcacaaagccctctgtttttatttttctttgaccataccagtcatcagagacttcttcctctgttaaaaaatagtagaaaacagctttacccctcagtaagaaaaccggcacatgactcacagcaattctcccaacaggggtactaagtttagtactgtgggctctctttgtatcaaagcccagcaaatagtttagtattaaaaatattactttcagaaccagaaaattttatgaacattactaaataacatgctaaaatgaccaagccacactttatctgaaaataatagtgcatttttaagagttatatttgtatgtttatttcaatctgacatttgacaattagcataatttgaaactatgtaatgtacagttctgtaaagcatattcctatccatctttcagttttattttgaaatcttaagctctaggttacataataaagcaagaaataaaattatgcttcaaaactgaaggagctagaagagttaaagctgtgaaaacttcaatgatgcttcttaccgttgcaccacaggtacaattcactttggtgccatcttcctcgatgtatcttaagttgccagcaattaaaccttttgatgtagataactgcaaaaaataatagacatatttgaaacctgcttcacgaatatgttttatgctattaagtcactccttgtgttcatctgctgaattactggcattttcacttggattgaaatttcagagatgaaagagaaaatatgtaagggatttaggaattaaaaatatttggtaattcatcagtttggtccattcacccaaaggaatatattgagaatctattacttaaatttatagtgagaaaaatgcaagcatcaaataatagcaaaagaagactatattatgttttaaaattatgttttgtctgggcgcggtggcttacgcctgtaatcctagaactttgggaggccgaggcaggtggatcacgaggtcaggagatcgagaccatcctggctaacacagtgaaacctagtccctactaacaatacaaaaaattagccgggcgtggtggcaggcgcctgtagtcccagctactcgggaggctgaggcaggagaatggcatgaacccaggaggcagagcttgcagtgagttgagatcgcgccactgcactccagcctaggcgacagagcaagactccgtctcaaaaaaaaaaaaaaaaattatgttttatacaaacattttgttttaaaataaaatgttttgtattaggtactacttactatatgtagactcctccttgacacttttaacatgcaagaaatgtcattgataatattgtcgacgacagtctggttaccaaagagttgactgtcagtgtaatatatgtccctatgaaaatttaaaatacatatttttaattaactatattctttttgaatatgacaagtattacagtgttaattgaagaaagctttaactggatgaaaacacaacatataaagaaagtaaattatgagctatagtttagtcttatgtaacttttcaaagcatataataaaagttaatccaactatttctcacattacattttgaagagtaatttactagaacaatatatttaccttttggttgcataagtgttgctctgtactaatttataaatcatggacaatattttaaggattagagctggaaaataaaattcaacaaacaagttactcatcatttctcttactgattcaaaagatactgctatcaaggattttaacttaattttagttaacatttaaaaaattatctttccaaaatgggagggttaagtacagaacaattacctgcagaatcagttaaaattaattgctctatggatagcaaaactgagaggataattatgcactgaaccatataccttgaaaaatgtttatgttgataacctacttccatagttattgacaatgaaaaattatagaaatttattttatgtatgaaagtgatctattaaaaacaggtaaaattatttaactagcaacaaataaaattgagaagataacaaaatttatttatcctttattaccaaaagctaagaacaattaacttacaaaatttttgagctgattttggtgaatcacttttgatctttctggtggtgcaatgggataccatctgaagacccacagaatcttcaaacctgtcattttgtttaaagcaaaggaaaaaagtgaaaaagacaacttctaaacaccaaacaatatatacttatggtcttctgcacatcatttaaaacccacatttcttctcaatttaagcactgaagctttaggatcaactggtttgagagcatagatcattccaggtgataactaggaaattaggtttgtgacatacagaggcactaagataaaccatttaacataaatgagctaacacctttgattagggggtgtgggagtgtgtttgtgtgtgtgcatacttttttactgggaagacatttttagtgtatgtaaaatgttttcaaatatttcacaattagtactttactcattttaataacctactcatttaataattttactcaatttaataagctttgaaatgtttcatttctgatttacctgcaaaattacattacataaaataacaattttattaggttaagttgaactgccaagcttcccctaaaggtggcagaaggcaccaggtggatatgtcaggtgtaagctgcttcaaagctagataaaatccatctttcaaaacatgactgaaaagtatacagcttatattacttatatagatcataaaacaacagtgatgaaggagactcaaaattcctttcattttgtttctgtatctcttaaaaaatatgagaggctggaaaaaaccggtataactaggttcaagaattctgataaagctgtttgctgattttaccctttttggacacatgatttagcaggggcagaagatctgtcaggagaaagccttaaatgtgctctatgttcaggatacttttattttggtctggtatcaggattggttatatttcccctgagcaagtggtttgcttttgtggcatatgtgagaattgcacccatgacatctccccctctgactgctagaaagcttagctccaagtatggtgcctattcttagcaaaattatgagactttatcacatgcatttggaattctaacctcttctggtgctccattctgttggtgctagcattgttttcctttgcctcatctttcacacctacttctagtttacataacctctctgtatggtatgtatttcgtaaacttcctaaatccttttttttggcaaggtaaaggcaataaaatgaaaaaaatatgaccagaactctaattcaaataattttaataatgacatagatattgcatttaaaaaataaaaatgcaaaatgcccactttatgttttcccagcttgatctgttgtctatcgtgaatgcaggtgcttcatttcttgccaagcttgtgattatgtcttggataatattttctatagatgcaagaacctcagaactgaaacaataaacagagcatgattccatcttaatcataaattttgactttttaatatgtaagattttcccagatcaatactaaagtaactttttattttattcttttttaagactaggtaattggggtggggttttaaaaaaagacaaaaaaaaagactaggtaatccatgtcaataattatctctcccattaaacctttactactgcattaaaacaactgtatttacaaataaatttcatttgcttgtaattttacttctcaagcaattaccaatggaaggtctcccttttacattaatgactaaatttacaactgtaattttatcatattaacctactgtaatctagctgaacttgaatacaaactagacttgacatactactgatatatgttttaattaaaaagtgatacaatattggctttgaatttctttcccaaaaatgcaatgcaaaaatttcaaaagaaacaccttttgtggtcgcacattaccctagttgatctcatgccttaaaatcggctcttttgaaatttagcgatacaaaaaggaaaacgtttaatcactaccctggaaagaataaattgtgagttctgcaacaaacggttgacttggcagctattacgccactctacagcaaaatgcgaagactaagcccagttttctgtcagctgactgttaatttcacaagccatcagctgcaaaaaatgttgttctgttataaacaccatgagcttattgtctaggaagagaaatcaaatgcactctagaaaacgggcaaaatgttgagagttttaatttccacaggaacttcagaatttttactgaaaacttgtgtttcagaaaatgaattttaaaacatttaatctattctaatattgggaggtaaaaactgacccaaatactcatttttcctagtttggagaaaaaaagtgttgcaggataatactgtaaccaactttaagatacaatcagattcgtctacatctgcgatattaacaagggacttgccactctccttttccctcactctcccaagttctccctcaaaataaattcttttgtaaaaattggtttgtttgtaggtttttcagattttttggtggttggtttgggcttaaaaataaaaggctgaaaaactttgctcaaccaagaaagcaagtcgaggaaacaaaataaagtatttttaagtgaaaatggtcaataacgtagtcatgttttctgtggttaattctaacatggatagctggagggttcctgtaattgattttaaataaatcatttaaaatatgtacattctctccacttgcaaaacaattaaacatgttgtcttattataaaccacttaaaatgtgttgatgtccttgttaattctgagaaaaccattcgcttactgagagaagacatacaacactcattttctttctaaaaaaaaaccaaaaaataaaaaccaaaaaaaacccttaaagtttaaccaaaaattttatcccaaaaaacgtttaaaaaatacaaagctaactgtaccccaaactccccaacctataaggatcttaggaaaccttccaacccagctgcagggagcctctggaacgttctagaaggggaacatcctagaagccacagaaggggggctgccacctggctttcttttttgagttcaaaataagggttcaaagcaggtcacgggtactcaggaaggatctttttgggggttcctggctggcccgccaaggggtgcctcctcagcctcaacactaggaggcagcccggggccaggaagagcgcccgacttttctacagagtggctgcgtcgcgcctcggcaccagctcctgtacctggaggccaggcggcttcccccagttgggggctccctgccacctctcctcagggcagccagcagggactccctgtgtcggtccaaaacgtcgaagaacgaggcctcgggccccataggtgcaaaggccatgagggcagacggctgccagaagctccagaagcccctgtcctaggctgcgcccttggggcgtggctgcgtgcctttcccgcgctttctgagcggccggcgtgcccacgccacacacccagaggcggggctggacaggcgtatgcgtagagcacggcgtggagtgcgcaagcgcagggctctcaggcgcggtcccacctgtgaggccctgaggcgggcgcctccctgagtgtgggtcgcgcaggcatcggccctgcgtggctgagctgagagatgtttgtgtggcgtgctgcggatattggacctagagtcccttgaggtgatttaattattttgggggttggctatttagggacagcaatatcagcgatttttcattaaaacacataatgatgaagatccagctgtgtgggataacagttctcggcaatgggttcagctgtgattgaggtgaacgcaatccctgtccttactaacgtttcatagcagttgaatgcctccaaagccctttgcactcaggtccctcttctaattcccttaagaaccccaggaagttcctaacgtgtcatcctaattttgcaggtgccaggaaaggtcagctcagagcaggcaggcctgggttaaaatcccagccctcgcactccgtagggcagaccaatttggcaaagaaaatccaggacaaccagttaaattagaatttcagataaacagcaaatccttttttttttttagagtaactacgtctcgtataaagtttgggatatacttttactaaaaagttattttgtagccttgcacagtggtactcacccgtagtcccagctactagggaggctgaggcaggaggatggatttagaggctccaggagttgaaggctgctgtgcgctaggattgtgcctgtgaatagccactgtactccaggctgggcaacacagggcgatcccttctcaaaaaaaaaaaaatagttctttttttttttaagtgaaaggtctcacatatttattactgaacccagccaaccaacgcattcatcacagattcagagagaaaaaatatattctcaataaaacatgtacaactctccagagagcggtgacattttcagcttgatgtggtaacatgactgtgaccttcagacagcataaatatgtgtgccctctcatgtgcaattccttataggcccagctcggttcttcttcaatgtctccttttggagttgtacctgattttattatcagttttcatccgaatccactggggacgattttgcttttgtttcttggccaggaattgcttaatcccaaaagtcttgtgggaaagacatggcgagaagtggagtcaagcacacaccacgatggcagagaaaggaatgttatttcattgtttatgtgaaattcaaacttaactggcatcttgtattttatgtagctcctctccctctataccatgtcatcccctgacagacttggtgagtggtgcctttcccccacttgctccaagccttctagagcagaagataggaattctgaagcccaaggaaaggagtcctgactttgggaaggaggagaggacagtggagcgagaccctggaacaaggtggttccaaggcctttgggggcctggtcctgcatgggtggggtgctggggcttggccccagaagagctacttgggagaactgttttgttctttccgttcctggtaatttgataattttccaactaaaactagtttcccatcataaataatgcactccctctgttcacagggatggttgcctgtgttgatggctgttctgcatgtaccaagcactgtgttgatggctttacattgctgttatcacaaatacttcctcactgcctaccttgcaccgggcaaggtttattaccgaggacacagctgtgaacaaggcaggtaaaccccttcctcttagggagctcggagcctaaaaggaggggagaactaaaggcaatcaggtgaactttttttttttttttgagatggagtttcgctcttgtttcccaggctggagtgcagtggcacaatct

SEQ ID NO: 15245 - DNA, 41578 bp, Human
tgctgaaaactacaaaacactaaacaaatcaaagacctaaataaatggaaagacatatcatgttcatagattgggagactcaacaaagtaaacagcaattctccctaaattgatctacgggtgtaatacaatttcaatcaaagcaccagccaaatttttctgtatccacaagctgattctaaactttatacacaaaggtaaaagaatcagaatagctaaaacaattttgaaaaagaataaaactggaggaaattatactacctggttttaagacattataatgctaaattaacaaagtgtaatactggcaaagggaaagctaagtaaatcagtggaacaaaacaggcccaaaatagaccctcacaaataaagacaattgatttttaacaaaggtgcaaaagcaattcaatggagagaagacagtcttttcaacaaatagtgacggaacaactggacatccatatgcaaaaaagtaaaccttcacaccttatacaattaactcaaatggatcacagatctaaatggaacacttttataaaacaatttttagaaggagaaaatcttgacctgttaggcagagtttttagacatgacaccagatgacccataaaaggaaaaactgatactggacttcaccaaaattaaaaacattgctgtctgaaagacactgttagaatgaagagaaagacagactggaagaaaatacctgaaaaacacgtatctaacatataatttgtatccaaaacatataaagagccttcaaaactcaacataagaaaacagcccaatttaaaaatgggcaagagactttgccagatacctcaccaacgactccatgtggcaaatgaacacatgaaaacatgtacatctttagccattagttaaaggcacattaaaaccacaaggagataccactacacacctattagaatggctaaatttaaaaaaactgacactatcaaatgctgggagtatgtggagcaactagaactctcacatgttgcttgtgggaatgcaaaatgacacagatactccagaaaacagtttaacagttttttaaaagttaaacatacatttaccatatgaccctgcaatccactcctagcaataccctagagaaatgaaaacatgtccatgcaaaaacctgtacatggtatttatagcagattgattcataatcacagaaaactgaaaacaacctcaatgtccttccatgggcagatgttgaaacagactgtggcatatccacataataaaatagtactcagcaataaaaaaagaaattatccatacatgaaacaacttggagaaatcttaaaggcattatgctgagtgaaaaaaagctaacatcgaaagattactaactgttatgatttcatttctagaaaagattagtaattgccaggggtaaggagtatgatataatgggatcacattaggttttttttctgtggcgggggagcgatagatttgttctacatccttactgtagtggtggttacatgagtctaaaattcgcagaactgtacatcgaaaaaaaatcaattttaccatacactttttaaaataataaattaatttccttaaaataaatttaaagaaaaaagccaaattaaattttaacaggcagtcggactcttgcttttcagaaactatagacttaaagcactagatcaaaacaattacgttcctagaaataagcatacttctgagtacaattaaaaacctcgacaataatactttatataaataccctttccccaaaacttttaacattttgctaatgcggtctaataaattagagaagcaaagggtgagttaactcactaatcaaaaggttgttttctcataacagcctttatttaagtagaagtacaggttatatttgtaaaaatactgaaaaacttcttagggtcaatgaaattacctagatgttaggagatacataaaaacctagagaagttaacagcccttttcagaccctactgccacttcactagctcctgataatgaagttcttactctcacacgctctcaggttcttactcctgggaactgccgatggctcctcggatctccgagtaaagttaattctgtagcaaccagtgtcaatggaacagcacaatttggctcattcatattccagcactctatgaacaagaaactagggaagggtggggtcgcgggtaaagagtggtcgcactgcagggaggagtctaaatgccagggtggagctgaggactctcttcgccatcaaacctaacctgagcacttcacgcccttactggtgtctggcccagcccgggtcgccccttccccagtcgggacttggggcaggcaaaaagccgaacgttcggccagactggggacgcagcgccgccctcgctccacccctctttcccgcccaccaggcaattccaggtacccaccgctgggagctgggagggggcgccgggctggcgctgccgcccaccttctctagctggaacttgggatcggtgctcagggaggggagagccggcgctcggcggtccgaaccgggggatgggggagccgggccgggaggcccctgccctcgatacccctgcccactccggagagtaaggcacaacccgggaccccggggagaagctgagtcttccccagtggagccggacgaacccccagcccctggagagggcgagtgagtgcagcgccgctgcaccgcagcgcgagccgctactcaccgtcccccaccggccgcggacccgccgcccggcgccaccggctcctcctggtcgcggcgcaaccgctgccgccgctgtctcctcccgacgcgccagctctccctgcggggccgagcggctagttcgcaccctctttcgctctcttaagaatgattatgatttttaaacgaactttattagtagccagggctcagattgagtggctcagcagcagctccgccgggggtggtggggcgcgggagtctcgactcccctcatctgtggacccgccgcgctgcggagcatgcgccgtgcttcgtctgcgcatgctctgtgcggacccgcggccctgccccgcccctgttctggcgggtggctggcggcggctcagctttccaggcgcctccaagggagcccgggagggcagtggggagatcagagacgagcaggatctcctagatcgtgaactctagaaaagagaaatcggccaatgacggtccgcatgagtttcgcctacagagttatcacacttccagtgtcctcaaagggcttgccccgcttcggacacctaccttattttcttgaccagatgacatcttaagtggccaagtgagcaaaaaaatgtcgagcaaagtcgaaaacgcactcacacagcctgcaggacaaaatagaagcctgagatggttaattattcagagaagcgaaccaaaaacgaaaaggttccgcaaaagcaatctcaactttgcttcagttgtttttatatttcaaaataaaatagaatagaaaaaaaagatggaaaataccaagtgttggccaggatgtagagtaactgcattcttctactttgctgctggaatgtaaactggaacaactcctttgaaaaacagtttgggactgtctgcaaaaggtgcataccctatggccccgcagttccacgcctgcatatagagcaaagagaaacgaatacttagggtgcacggacaggcaggtatcagaatgttcgtagctgcatttattgtaataattccttaatgagaataacccaaaagaccatcaacaatagaataaattaatgaaattacacagagttcatataatgaaacactatacagcaacgcaaaaaagcatctgcaattacaggcaataacgtgaatcaactggggaaacctaatgcccagcataaaaagacaacaaaagtacacatggcataagtccatttctataaactacaaaaacagaagaactaagaggctcaaagttagcataatggttaccttggtgggcaggggatagtgactggaaggagttagcgactagaagaggggcttccagttagcaactggaagaggggcttccttctagtgaggttctctccgttgattttggcgctagttataaatgcgtgtccatttgtgaaaattcaagctgtactcttatgcacatttttctgtatgtgaattataattcacacttaataattttaaaaattagtggagattattttacctataatagcaatagtatttgtaagaaatttaatatcaagtagctaacagatttatctctaggatttggttggcagtatctcttaaacttgagtaacgtactgatgccctttctgagaaaagaaaaaaaacaattaaaaagttggcaaatgacttgaatagacatttctccaaagaaggtatacaaatggccgatgagcacatgaaaagagactcaaggtcactaatcatgagggaaatgcaactcaaaaccatgagatacaacttcacactcattaaaatgatgattataaacaaagcagaacagaaaataaatatgagtgttggcaaggatgtggaaaaattataacctttgtgtgctgctggtgggaatgtaaaatggtacggccactatggaaaattgtatggttcatcagaacattaaaaatagaattatcgtatgattaaataattccacttctgagtatatattcaaaagaattgaaaacagggactcaaaaaaaaatttgtacaaccatgtttatagcagcattattcacaatagccaaagggtggaagcaacccaaatgtccatcaatggatgaatggatgaacaaaatgtagtatatacatgcaataaaatattattcagccttaaaaaaggagggacccaggtgtggcgaggtatccctgtaatcccagctacttaggaggctgagatgggaggatcacttgaatccaggagttcaagaccagcctgggcaaatcctgtctcaaaaataaaagagagagagggaaattctgacacatgttatagcatggatgaagcttgaagacattatgcctagtcgcaaaaggacaaatgctgtatgattcaacttatataaggtacatagagtagtcaaattcatagagacagttggggggtgggaagtggttgtgggaaaggaagggcaggtgggaatggggagttactgttttatgtctacagttctagctttgcaagatgaagaaagtctggagatagatggtggtgatggttgcacaacgatgtgaataaacttgatgctcttgaactttatacttaaaaatggctaaaaatggtaaattttatgttttatgtatatcttgccaaatttctttttaatgggaaaaaaaaaaaagaaaatcttagagggtctcagggagtacttctgggatccaaatttgagaaaaacttcctgaaagggggttcccccaaaatcatttctttcctccccacttttccatttccttgggattgttggacattgaaggagatccagaatatgccaccccaaaacatgccactttgacacaagcattatttggagttgaaggcaattaagaaacagcagaacagaagaaacactctgcttttcctatttctgcctaaaagcaggacataaatttccctttgtgaagttgttcctcctccccatcccacactaggaggaggagattcctatcaccagagcaccaacttgagtcatatggcaaaccttgcaaaataacccttgtcttccaatagtttccctcatatagtttactcggccacaatttaccaccttcacaagtcccacccctttttcctttgtcttatcacttctccacaatttatcaccttttaaaaaaatggtatataagctcttaggcctaactgctttttggggttttcacttcctttctgtgaggccccccatgtgcatatgaaataaaccttttctcctgtttatctgtcatttgtcaatttaatttgcaggcttctgctactgaacttacaagagtagagaaaaagtgtttatcctccctgcagacatgctcagtgcaattaaagtctactttttatttgacttgaggctgctctcaaggacacagcagagattctcatgctctcactgaaggcagtgaaataatgaaagcctgcatggaaacctggccttttaaatcatgtagttgtgctatagtagaaatagcaacagaattaacctaaaaggttttgaaagaaattttacctgcagtgactagaaatgagtttcacaaaattattttaaggaaaacattctgaaaagttagttattaagtcattaaatgattgtttgaatctagtacctccactgatccagcaaaaaatgtccatttgttcccttgctcgttctttcattgtgtctgactctaatgaactgaacagtgtccaaggatcatgaattgtagctgagtagaaagaaaaacagaaaaatcagaaaatattttcttccaagaaagaaagctttgaaaattttaccacttagaatataagtctgcatatacatatgaatgcatatgtggccatctggaaaaaactagtagaaatcacagtatttggctagacaataataatctactgttcttcagattcaaacagatcatgctggaaaaaaaattttttctagtactttctaggcagacattagagtactgattcagtttttctgttgcttaataaccttggatcttagtatcctcatctatagtaaggagttacccaccttacaaggtcatttatccattaaaaaaaatacatattgtgccaaggactgtgctgaacattgggtattcagtaatagacaaaaggcagatggtttgtgtcctctgggagcttataatgtgttaagggagaccaaaaaagaaagtatacaaatacacacatatgcacacatatacacaaataagtgattacatacccttagacattatgtgaaagtaaataactggtatgatggaagcatgtaagagggagccctaatttatgttggagaaccaagggaaggcctttctgatacagtgatttttaagctgttatctgaaagataaatgagtttggtaaagaatagacagaaaaagcctttaagcagagacagcaggaagtacgatggcctgaggcagcaaacaattcactgggtttgaataattgaaagggagccagtgtgcaggagtgaggtggaaagcggtatgtaaaaaataaagaacagtggtgagggaagcaggggccagatcatgaagaccttgcaggtcatattaggtaatttggattatatctcaagtatattgggaagccattggaggattttttagtgcacagactaggagatccactggacagttttaaaaaattcctctgactgctatctagggaaaacatagagtagtggaaaatgggagagcaatggaaggccggttcaggcaagagatgatggagggttagactgagatggttacaggggtgatacagaaaagtgcatttgtttttaatcttggaagtagaacctataggatttggctatggtgtaggaaaaagacggaatgtaaagagtgacttgcaggtttcttgaatgactgccttgctgagattggtcactaagggactagttataacccctcacagtgtgagtcggggaataatctgttcattctaaattcctttttgttttgtccttgattgttcttgtattatggtctagtgtgttccagcatatacacttctagatttagggcccttactaacaaagaataattagaaaataaaaatcttttttttttctttactgcccaagtctttctcatatatatatttacttttgttgaaatactcttagtatactgagagacctcctctctaatggaaagggctggactagacaactctctgacttttgagaacttcgctcatggtaaataaggaaacgtctgtgtgatattcttcctcacacttctgttggaacatttgttcacctcgcttcagtgatctgatgcattttcaagagcttattcacaatcaagtttttgtcatccattccataatttaaattcttctcagtaggctgggcacagtggctcacgcctgtaatcccagcactttgggaggccaaggcaggaggatcacctgaggtcaggagttcaagaccagcctggccaacatggtgaaaccccatctctactaaaaatacaaaaattagctgggcgttgtggcgcacgcctgtaatctcagctactcaggaggctgagacatgagaattgcttgaacccgggagatggaggttgcagtgagccaagatcatgccactgaactccagcctcagccacagggtgagaccatctcaaaaaaaaaaaaaaaaaaaaagaataaataaattcttttctcagtgctctcataaaataagtagaaggactatttgattaaccttatttgtacatataaataaagtaggtaaaggtcacataccctacaggtagttttgatacaagaatccaattctcttaatgggcagttatgaattcaaactcatccacttgcccattccctggatttacaattattaagtcacaaaaaagtggtgaggaaatgttctacttgtgctaatacttgtgcatcaaatacttgatgctcatgacagaatatttttacctcttaaatataatcttttcaacattaatcagtaattgaggttttgtgcttaaagttattttgcaaccaggactaattcttaattttttaaccacttctactcaacaaatatataaaacactttaaatattgatgcatctcctggtttttggtttttatttcttgatatcttatagaagatctacaaaactagagttagaagccagaaagaagcctcagatggtgataaataaaaatgttctgtcttaatgctgattttttcagtaatgaagtggtataaactcattactttcatgaagcttcctaggtcatgaaaataacattgttgtagagcttccatgtgcatcaggtatgactgaatagtttgatgcacttgcaaatcacaaagtgccttcctttgaaatgtgtaaggcaggttgagatgcagcttctcagatggatttagtccctcctaggactagatgtctccttgttgcagctgaattctcatttcatttacccataactagaaacacctcatgaacacctattttaaacattgagttgccatcaacctgagggaccaaagaaatggattgagggcagggagtagttggaaagagcagggaattgatttaaagatgagacatgtgcgataatgaggtacaggcactttgtggggtatgggagggccccaggtagacaggagctggcatatggcttacagtcatccagccaacgttattgggctcttacaactcaggcttcggagccagaatccctatatttgaattccagctgtaccacttactagccgtgttaccttggacaagttacttaaatctctcagcgcctcagtttcctcacttgtaaaatggagataatagtagtacttcctggagttattagaggaatttaatgagttaccatacgtaaaagcacttagaagagtgtaagccctcaaaagagttagtagaagtactagtagtatttgaaagttactagttatatgggaatggaagggacagaaatgtctccaaacggactcatctctaagtggtgaaatgccaatggcattgccaatgatatatctttttctcctccttgctagagtttttcttcagctttactgctctgcagtgtccaagtatggattgtttttattatatctacagtatttagtgtgctacttcaataatgtctttcttcagttctgcaaaattctcagccttatatcttcaaatattgcctctaacccattctattttctttttctggaactcctattaagagaggctgatcctaaacccctcttataattttcatatcattatctttctggctttattatgtgaaatggccgatcttccagtttaccaatttcttctccatctatttctattctacagtttaaatttacctgagtttataatctcaatgaactacatttaaaattttccacatgttctctgttttgttaaaatttcttttctcctgtagtcaaattattgtattcattaggctttttaatctttttttgcattactttaattctttttttatttatttattttttttttgagactgaatctcgctctgttgcccaggctggagtgcagtggtgcgatcttggctcactacagcctctgcctcccaggttcaagcaattctcttgccttagcctcccgagtagctgggattacaggcacatgccaccacccatgcccagctaatttttgtatttttagtagagacagggtttcaccatgttggccaggctgatctcgaatacctgacctcgtgatccgtgcaccttggcctcccaaagtgctgggattacaggtgtgagccactgtgcctggcctgcattgctttaattcttttgaacataattattttagtccctttgctattgttccattatttccaattcttttttgttgcactcgatgactctccctcatcatgcctcctttggtggtttttaatttaggaatgtgaagtcatcttcatgagggctgccttttctatgggacttctatatgcttagcccctgtacaatggcttgatatctgcttttgatatttgcttttgtcaaagccagggcttcagaatgttcaaagatgtgggaacagcatttaaattctcagcttggaatgcccacatcacataggtagcataaattcagaaaacatgtccatccatggtgtaggttttgggccttgattcctcccagaaacatttccccattcaggatcctgggggatggtaatcttccttgtcgcttccctgttctccttgacaaaatttttctagctcccttttcactgaattggtgcgtattctagtgccttgtttttatgtctgtgtctcacttccagccttctctttcatctagaccaggacatctcttcaatcacttgggagcattcaaccttctgttttggtcctcaggtggggcactttcttggcctgtcaggaccactggggattcccctttctttgttttgacataggctattgtattttttgttgttgttacagtttatcttagtgtatatgtttatctacgcttatcaaggctgtgcatatctagtgggagggttgatatcagttcagttagcatcgttacaggaacagggagtcttgctttattttttattgcaaattaattctgatctgagacatcacttgccaggggtcgtaagatacccaatgtcagtctttaaattaaagatttccttctcttttccatagttgcacaagacttgtcagaggcttgcacagtttggaaaacttaggcaaagaccctggtactcaattgtgatcatcactgtgatgtgaattgcccatgtacattgagtctatttgaataaatctacatcctttgtgcccagtttggttataagtatcttttacctcaactcccagggttatggaggttggtgttcatgtctccaccactgagaagctgaagcaccttcagaggctgtactgtatctcctggtaaagccaggcacagatacctgtagtttttggaacctgctacctccatcagtctctaggaaactaattacattttttcaatcctaaggatccacctcttgagcagaatggtgaggacatttgaaatgtgtaggtacattttttggttatcttaatgactagggtatactattgttatttagtgcctagaaaccagggatatccagtgaagctttccagaaagtccactggagacttttctttgagaaacattgtcttttccatccatatgtgagatggtccaacttaatcctcttggaaagaccatacttaaaaaagtttttacttttcccctagggaaggtgtaatgagctcagacctttttaaaaatacaatgttaggtttctcttcctgtggtagggaggggaaagggattactttattctacttggtaaatacttatctcaaaaactcaccttgaattacaaataatgatgcaaaaacaaattacaaactgagaaaaaaatactctcaatatatgacagataaagggctaaatttctttaatatacaaagatctcttacaagtcaataagcaacaaataggcaaaaaccactcacatccagatactgaaatgaaagataatagcctattgacatgagtatatttaatatcttcacaattcagaaaatgcaaattaaacaataaggatataattttccttgtgtctgattgacaaattgaacaggttaacatttaatatggggaaggatgtgggaaaacaaatattttgttggaacgtaaatggaattaacccttttagagagcaatttggcaaaatatatcaaaattataaatgtgtatttccatgtgtaacaattttatttacaccattttctatgagtgcttgaaaatattagtatattccaggtagaatccctaagggaaaaaaaaaaaaccactagtacaatgaacttaattatcccaaacgctagggaaaatggatatggaatttatggtctgagcaaagcattcaatgcttttcttcttttcatcctaagttatagttggttacttccaaatataaaggctaaagctttggcattaccatgttttcagagattcagaaattcttctattaaagaagataatctgtcttgaatttcttccaaagatttctttttttcaagagacattatttaaggaagatagaatgaatgcaagacaaaacaagttccgcaaaacaaaacaagcgttccgttgttgtattaatgatggttatagacatcgagtttcagagccacgttgatgagtccagattctggtcctcaaatttgtaagtttaaaaattaaaattttagggactgggcgtggcggctcacgcctgtaatcccagcactttgggaggccgaagcaggcggatcatgaggtcaggagttcgagaccagcctgaccaatgtggtgaaaccccatctctactacaaatacaaaaaattagccaggtgtggtggcgcgtgcctgtaatcccagctgctcaggaggctgaggcaggagaatcacttgaactgaggcggaggttgcagtgagctgagatcgcgccactgcactccagcctgggtgacagagtaagactccgtcaaaaaaaataaaaataaaattaaaattttaccaagggatggttaggtaccaggaaaccaaccatctttcaagagccttatatacataaatcagaatgctaatttattaacctgtaataggatatatagcaagcatgataaccagatttaaacttgtcacaaaacaccttctctttcttacaaatagcagactcctccttcttgccctctccctgttcttcttccctgaatgttttctttttgttgtgcacatacagttaggacaccaaattgtaagtcagaaagttgttgggtgagcacacagttaaaacaaatggaattggatgcttttgggatggatttccagcaaactgagaagtactaaggaattgtccttccacatattagaggtatttcttcctaaaaagctggccacagatcaagaatcagaatactctttctctggctagtacaggagaaatactagcaaagatatattttctaattcttctttctctagtttccatgcaaaccatcatattcctctgtatgaaatcatgtacccacagacatgttggagtttggtcatagcctagtttgcatttatgttttaaattgatatctccagcaagaatttcagatatattcttgccttactgaacttttgtctcagggaagttttctgggatgagtttccataaatggggtaatgtcaagtattttatgttgcttctttcccattcctgaaagtaagaattatattttcatttattcatccatcatacattgagtgctgtaatttgtcaagcattatgagtgatacaaagatacataaaacattgttcctgaatatatttaatctttgggttttatctagactatgtactattttaaaaattaaactagcttttataattctaaaagttacaacttgcactggtaaaacttcaacctctacacaaaatgcgtaaaatgatcactaaatgtctaccctctccgtatgcacttacctgatgcctgttccactcctaggggtaacatcttgttaacaatgtctttcctccttccctcctccccctccctccctccctccctccttccctttcctccctccctcccttccttcctccctccctccctcccttgacaggggctcactccgttgcccaagctagagtgcagttgtgccatcatagctcactgtaaccttaaacacatgggctcaagtgattcgatccttctgcttcagcctccctagtagctaggaccacaggtgcacagtactacagcacaactaatttttaaaattattattttttatacagacaggatctcacaatgttgcccaggctggactcaatctcctgggctcaagtgatcctcccgccttggcctcccaaagtattggaattacacatgtaagccgccatctctggccctctgttaacaatttcttatttattcttccagaattttagtgtgtacgaataaatagatatatgattttctgccaaatgctacatacatctatatgtgataagtaattctcaatttgaaggatagactaaatttctttcaaacacagacttagctctttagatgaaaagtcattaggcaggaatggaggtaagggctggtctaaggtctctttggtgtctggattcactgaatttcaatgatgatacagtaaaaaaaattgtaaaagagcaaaaacaattaaaaatagatgtgtagttatatttttcttcttacatagacctaacttatgaaacacaaaagggtatctactccaagttgtgttattttcaaattttcaatactagctcatttagtattgtcattgcactagcatcactgttggtattctccagcgtgtgagatattaattaaactcctgtttagaaaagttgaagataacagctactaactgaggattattaattttatggctttaataataattttagtaacttgtgtctgctgtgttttatttttattttattttattttattttttgagatggagtctcgctttgtttcccaggctggagtgcagtggcgcaatcttggctcactgcaacctccgcctcccaggttcaagcgattctcttgcctcagcctcccaagtagctgggactacaggtgcataccaccatgcccagctaattttttgtatttttagtagagatggggtttcactgtgttagccaggatggtcttgaactcctcactttgtgacccacccgccttggcctcccaaagtgctgggattacaggtgtgagccaccatgcccagccctgatgtgttttattaattttttggaaatgactgaagtttatctgtaacaaatcggtattgattcgaaggccagtcacagtggtttatgcctgtcatctcaacgctttgaaaggctgaggccagaggatcgtcggagccaaggagtttgagaccagcctgggcaacatagccaccccatctctaaaaacaaaataaccgagtgtgatgacacatgctacttgggaggctgaggtgggagggtcacttaagccctggaggtcaaggctgcagtgaagaatgatagtgccattgtactccagcctgggtgacagaatgagacccttctcaaaaacaaaacaaaacaaaaacaaagtgaaataccaggcacggtggctcatggctgtaatccccgcactttcggaggccaaggcaagcagatcacgtgagatcaggagctcaagaccagcctggccaacatggtgaagccccatctctactaaaaatgcaaaaaattagccaggtttgctggcacatgcctgtaattccagctactcaggaggctgaggcaggagaatcacttgaacccaggagggggagattgcagtgagctgagatcgcgccactgcgctccagcctgggcaacaagagcaaaactccatttcaaaaaaaaaaaaatgaaaaaaatgcttaaatgtaggactggattaatgaaattcaaagacacttgtgcttcatgcaaacatagtgtcactttagcatctgtgataggcaagataatgccccaatctcttctaccaccccaaagttgtccacatcttatccttgaaacctgtgattatgtatgtaccttgcatggcaaaaaggactttgcagatgtggttaagaattgtgagatggggagattgtgctggattatccaagtgggcccagtgcaagcataaggagtctttataagagggaagcaggagggtcagagccaaaaaagtagatgtgacacagaagcagaggtcagaaagaggggtggagaagagagagagatttgaagatgttgtgctgctggctttcaagatggagaagggggctacaagtcaaggaatgcaagtggcctccagaagttggaagagccaagcacaaggattctcctctagagcctccagaaagaaccaaccctacttccactttgattttagcccagagagactgattttggacttctgacctctagaatgaaaaagtaattaatttgtgttgtcttagagcactacgtttgtagtaatagttatagcaacaataggagactatatcgtaagctgaatttagtatgtctcctactataaaatctacctttttccttgcttcactgacttggtgagtccacctaattctgatgcctaaagtcagatacctgggagtcattcttgacactactgtcaccattcatgtccaaatctgacctgtcattcttccttccctgtagctcactggtccatgttctcttcactcacctagacaagtgtgtaatagcttcccaattcattattattattattattatttgcctctagcctccaccttttattcattctacactttgttcccagaatgatctttttttttctttttattattattatactttaagttctagggtacatgtgcacaacgtgcaggtttgttacatatgtatacatgtgccatgttagtgtgctgcacccattaactcgtcatttacattaggtatatctcctaatgctatccctcccctctccccccaccccacaacaggccctggtgtgtgatgttccccttcctgtgtccaggtgttctcattgttcaattcccacctatgagtgagaacatgcggtgtttggttttttgtccttgtgatagtttgctgagaatgatggtttccagcttcatccatgtctctacaaaggacatgaactcatccttttttatggctgcatagttttccatgttgtatatgtgccacattttcttaatccagtctatcattgatggacatttgggttggttccaagtctttgctattgtgaatagtgccgcaatgaacatacttgtgcatgtgtccttataacagcatgatttataatcctttgggtaaataccagtaatgggatggctgggtcaaaaggtatttctagttctagatccttgaggaatcgccacactatctttccacaatggttgaactagtttacagtcccaccaagagtgtaaaagtgttcctatttctccacatcctctccagcacctgttgtttcctgactttttaatgatcgccattctaactggtgtgagatagtatctcattgtggttttgatttgcatttctctgatggccagtgatgatgagcattttctcatgtgtctgttggctgcataaatgtcttcttttgagaagtgtctgttcatatcctttgcccacttcttgatgtggttctttgtttttttcttgtaaatttgtttgagttcattgtagattctggatattagccctttgtcagatgggtagattgcaaaaattttctcccattctgtgggttgcctgttcactctgatggtagtttcttttgctgtgcagaagctctttagtttaattagatcccatttttcaattttggcttttgttgccattgcttttggtgttttagacgtgaagtccttgaccatgcctatgtcctgaatggtattgcctaggttttcttctagggtttttatggttttaggtctaacatgtaagtctttaatccactttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgcagatgtgtggtattatttctgagggctctgttctgttccattggtctatatctctgtttttgtaccagtaccatgctgttttggttactatagccttgtggtatagtttgaaatcaggtagcgtgatgcctccagctttgttcttttggcttaggattgacttggcgatgcaggctcttttttctttccatatgaactttggacagactttaaaccaatgacgatcaaaagagacaaagaaggccattacataatggtaaagggatcaattcaacaagaagagctgactatcctaaatatacatgcacccaatacagcagcacccagattcataaagcaagtccttagagacctacaaagagacttagactcccacacaataatcatgggagactttaacaccccactgtcaacattagacagatcaacgagacagaaagttaacaaggatatccaggaatggaactcagctctgcaccaagcagacctaatagacatctacagaactctccaccccaaatcaacagaatatacattcttctcagcaccacatcacacttattccaaaattgaccacatagttggaagtaaagcactcctcagcaaatgtaaaagaacagaaattataacaaactgtctctcagaccacagtgcaatcaaactagaactcaggattaagaaactcactcaaaacctctcaactacatggaaactgaacaacctgctcctgaatgactactgggtatataatgaaatgaaggcagaaataaagatattctttgaaaccaaagagaacaaagacacaacatactagaatttctgggacacatttaaagcagtgtgtacagggaaatttatagcactaaatgcccacaagagaaagcaggaaagatctaaaatggacaacctaacatcacagttagaagaactggagaagcaagagcaaatacattcaaaagctagcagaaggcaagaaataactaagatcagagcagaactgaaagagatagagacacaaaaaacccttcaaaaaatcaatgaatccaggagctggttttttgaaaagatcaacaaaattgagagaccgctagcaagactaataaagcagaatgatatttctaaattttctgcttaacagccttgaataactcttctttgacatattattgtcaagctccttagtatgaccttgcctttgtcgtgctgtctagtcacacgtctctctatatcccacaatgtattccctgtttttcttttttctttttttattttttttttattttgagacaaggtctcactctgtcgtccaggctggagtacagtggcatgatctcagcccactgcaacttctgcctcctgagttcaagcgattctcctgcctccacattctgagtagctgggactacaggcgtgcaccaccatacccggctaatttttgtatttttagtagagatggggtttcaccatgttggccagactggtctcgaactcctgacctcaggtgatcagcctgacttggcctcccaaagtgctaggattacaggtgtgagccaccatggctggcgtgttcctcttattctgctacattgaatttgttatagttcccaatacgtatcatgctatttaatgtctctgtacctttgaaaatgctgttttctttcctggcatttttttctcctctccttctagttttaccacttcttttatattttgtaagaatttgtttaggccatgtgtagtgatgcatgcctataatttcagcactttgggaggcaaagggggatggatcacttgagttcaggaattggagaccagcctgggcaacatggcgagaccccaaatcccatctctacaaaaaatacaaaaattagcagggtgtggtggcgcatgcctgtattctcagctactcgggaggctcaggttgggggaggatcacctgagcctggggaggtcgaggctgcattgagccaagattgcgccacttcactccagcctgagcgacagagcaaaaccttgtctccaaaaaaatttgtttaaatgccaccatccacaaggagccctcccttaagtgccttcccctgttttcttctagtgccatgattatatttatatcatactgcttcttaatctgcaatgtgaattttgggctgcttcaaataactaatatttttgagcacctacaatgttatgcaccatgctaactctaactcataaaatagtaatcaaaaaagacatagttcttgccctcatacagctcagagactgtagggaggacagatattaagaacataattataagtactccaaagaagagatataaattatatataggtattagcaggaggatctaggggatcaataatctgtttttttttttttttttttttgagacggagttttgctcttgttgcccaggctggagtgcaatggcgcgatctcggctcacactgcaacctctgcctcccgggttcaagcgattctcctgcctcagcctctcaagtagctgggattacaggcatgcgccaaccgcgcccagctaaatttgtatttttagtagagatgggcttctctatgttggttaggctggtctcaaactcctgacctcaggtgatcctcctgcctcggcctcccaaagtgctgggactacaggtgtgagccaccacgcctggccagggtcaagaatctttaggctcagacatttctgtctccccagtagaccacgagcagcttgcattcagggaggagactatgttggtcctaatgggaagctacgggggaagataaaatgaaagagtacacaaagaaagaggaatactcaggacccaggaaacaggagaccagcacaggtgagaggtagagagaagtcccaggacagcagctgtgtgtgacagagaaagccacaagtcctgattggtagaagaggtagaagactcctgaatggctgtctccaaggagagataattgatagaatacataacatgtttgaaaaacatgttgagtaaagacttacatttctagaatacagtatacggtaaattaatataagatagaaaactaagcaaataacaaaaatattaagctgcgcacagtggctcacacctgtaatctcaacactttgggaggttgaggcaggaggatcacttcaacccagaagttcaagaccagcttgggcaacacagcaagacctcatctctactaaaaatagaaaaataaggcggggctcagtgactcaagcctgtaatcccagcactctgggaggctgaggtgggcagatcacgaggtcaggagatcgagaccatcctggctaacacgggtgaaactctgtctctactaaaaatacaaaaaattagctggcatggtggtgggcacctgtagtcccagctactcgggaggctgaggcaggagaatggcgtgaacccaggaggcggagcttgcagtgagccgagattgcgccagtgcactccatcctgggcgacagagcgagactctgtctcaaaaaaaaaaaaaaagaaaaaaagaaaaaagaaaaattagctgaatgtggttgcacgcacttgttgtctcagctactcaggaggctgagactggaggatcacttgagcctaggagtttgagattacagtgagctatgatcacatcactgcactccagcctggatggcagagtgagaccctgttttaaaaaacaaaaaataaaaaaagcagattctcctcttcatgataggaagttgatagatgtgtaaaactgaaaactttttcaggaaactgctgaaggaatggcaagcagaaaaaaaaaaactttaaaaaatagcagtattagcaaggatagaaatggctgtaaataccaaaagaaaccgaaaaaagtgttgaaagtctttggaaacaagaattggggggagggggaggagtatggaattactagattactgttttaatactaaactatgcagaactatgtattttttttttttttttttgagatggagtcttgctgagtgcagtggcacgatctcggctcactgcaagctctgcctcccgggttcacgccattctcctgcctcaacctcccaagtagctgggactacaggcgcccgccaccacgcctggctaattttttgtatttttagtagagatggggtttcaccatgttagccaggatggtctcgatctcctgacctcgtgatccgccctccttggcctcccaaagtgctgagattacaggcgtcagccactgtgcccggccagaaccatttaattttttaaactatgaatatgtaaatagataaagacattacattaaaattttctgtgtcaactgtaaagtgactgataaaggctcactattattaataatattaacaataataagttgtttcttcagttagtttcgtacaatgttctggtacaaggtaatgagatcacacatcaatatctggaacacagcttggcatacagtaaatgctcagtaaataattctttctttcttccagtatctttaaataaaaatacctaaaaacttccttcatgttaaaacacattaaaagcaataaagcattaaaaatttcctgccaataaaatgtagatttacatttattttgtgtttgaaaattgcttttaaataaataaaacagaaaacagtgagccattttgatttttttaatctactaacaatgttttgtgagggaattattgtaatttaaattaggttatttttaagaacaataatttaatactaaaaaattatgttttgtggctaaaaaatggaaataaaataacttacaattgacttaaattgcgtcatgtttttccaaaccaatatgatggttaccaaatcagaaggaaaaacatgttaatcatagtgtaagcttttttcctaatatggtataaacaattttaaagttcttactgtatgacgtctcagggtgtgtatttacttaactctcagaggaagattagtaacatatcatgtgcctctttttctctttttttaaaccagtgttgctatctgggctttatttggagccttgaaaagtccaggctccttacattataattaggcaatgatgtaatctgatctggatttgtatctgaggtaatcacaggcagtttcacagtgatgtttgccttgagttttgtgcttcaggagtaaattttcatggaaaagaagaattttctagaaattctgttttaaatatcttttgtgaatttcacagatgttctcaaacaatgtagtattacttgttccataaacccatgttctccaattcgatatcaactatcaatatcatctaccaaggtcagccacctatgaaggataagtggttcttagaaggttcctaatgttcaatctgctctcatttgcaatctataattcttcattcacatcttcacacattctgaatgttaatattgcatagcctcttagaatgcaaatggcaaaaacatacaaatgatgatggtcattcactacctaaccctttcccctcaataactgcctggtatcaggaaaagggagctttaatggggaaagaagaaggataaggagtgtttgtgtgctactgatggttggtggctattgaaagcctgagttcagaatgggaggctgtgtacatatgagaaagggggaagaaagatgaggaaaggaatgatgttggtccctaagataaagattaagagggtatgttaattggaatattgggacagatgagaaggttaaatcctgttttatttatttacttgtttgcttatttatttatttgagatggagcctcggtatgttgcccaggctggagtgcagtggtgcgatctcagctcactgcaacctccgcctgccgggttcaaatgattctcctgcctcagcctcccaagtagccgagactacaggtgcacaccactacgccccgactcttttttttatttttatttttagtagagatggggcttcaccgtgttggccaggctggtctcgaattctgacttcaggtgatcatcccgcctcggcctcccgaagtgctgggattacaggtgtgggccacagcgcctggccaggatttagtttttcatacaaatctgtttcaaagattcttccaacatttcctgtaagttgccgaggttgtgggagaacctgaaagtagcttctgacttctatgtaattcaaagggcctaattatgcattctatgctgtagctttaattatacctgttaaagtatacccctggctgacagatagaatggactcctcatggctgaggtgctcaaaaacagaactatgcagccatagctggacgaggaagcagtcacatattctgttctcagaaagatgtagaagtatcactggatctccctttctgcaatcaagcctgtgacgtctgagtttgggcttggaaaacgaccaatcagagctcacctaccgcagccaatcagaaaccagccatattgaccgatcagaacttagctgcaccaaccaatcagaactaagcaagtttgaatcctttatttgccggaagctgggcaggaacttgaaccctctctttgtttaacgaaatgcaccttcattttgcaccaaaggctgtatctcccagtttgcaaactgttcactggaataaagtctctttcttccaaattccttttcagagaacttttgttcacataagaaaaaattaattttaaaattgtcttcctcattaaaaattggttcagctaaggctttatatgaaaatagtgttcttttccattgaatacaattttgttggctgggcgcggtggcttacacctgtaatcctagcactttgggaggccagggcaggtggatcacctgaagtcgggagttcgagaccagcctgaacaacatggattaaaccccgtgtccactaaaaatacaaaattagctgggcgtggtggcgcatgcctgtaatcccagctactccggaggctgaggcaggagaatcgcttgaacccgagtggcaggggttgaggtgagcccagcctgggtgataagagcgaaactccatctcaaaaaaaaaaaaaaattgcttaatttctgttttcatgcctgtgggtatttgccctgcaacactgcagcagttttcaaaaccaaagtttctgaactccttgaggaattctaaaaactccctgaaacgttttattgccatgtctctatgcttttatttcgtattaattatggaacacgtttgctaagtcacttcctgagcataggcagctcctctcactctgctcaggtcagtgagttagttgatatgtgtgcagatgcctcaggtacaggctgcagggatggctcccggcagggaagaactgcccttcctccacgagtcccagcactgccctacattgaggccttcctctctccactgtttctgctgctgcatttgcccccaccagtctaggcttaggtgcaggcctacccaccttggagccctatggtgcccaggatggtcccaaggcatgttaccaggccaggtcaccaggatgccgggttgcttgatgacttccatgctgctgttgagcatgctccatcgtcctatcatattaagctaaaaacacaagatcaaagataaaattgttaattattccaagatagtgtaggtctttctgagtgcaaggctgtgcatgaagctcatacacccatgatgcatcacctgcctacctcttacatgctttatgggttagttatatttgccatcactggaggtgccagtaaactcgcaaggtagcctttgtgtgaggtttggtaaccaaattgccaagttagctcagggaactgcaactcatgtccacctttcatccacttaggccttgctgtcttccctctttcaggtttcagttttgtagattttgagcctagattctctttctccatctcttagagcacaacctaagatagcattttgatagtctaagctcctggtctggtgtaactgcttccactcagaaatacttcctcttctctggaaaggaagggatcaaacaatagctcagtaagaacataattatcagatcaggagtgcctgcagatgtaaaggttctgatgccagaatatggaggtggagggagtggtcttgggatagtgcaggggatggggtttggggcatgagagtgcacttggattacctgattataaatggcagcacaatgaatttttaatataaagttacagctttaaaattattgagaaagattagttgattggtgtcactctagtcatagaaaacatacaaatctaattctgattttgtgccaacagactattatttttgtgcttgcacacttattgtatcacatgcatctctatccatccatttatccacatatctacaaatcatatatctcaacactgtaaaaaactccagttccttataaattactattttattttctcttattctaagcttccttcctgtaacttatttaattgttaacaaaatgtgttatagaaacctgtgttacttgttctgcagcccatttacgggggagaagatattatgtttccttggtctatgtttcaaaggtatcaactctctttgttcctgtataactacttacatttgaagtgaaaaactcccagaggccaacagaaaatggctatgaaactagaaagaatactattctacctacgctagtatataagtttcctaagatgttagtgaaatacagctggagaagtgcttcagtttggctcagttttgttttggcccaactcttaccaatagctcctctccaatctccaggagatacgccgtcctatcggtgatgggggaggagcaggagtgaaagacaggatggtgttgcaacaattcaaaaccccagagcgcacagttacccccaatgcactaatcagggtgtaggtactataacttactaagcctgtttaataaatccatgcctgtactcaggtgaatggggaatggtgagagaagagagaacactgtgataaccaaccagctcgaacagggaggggcagccagcccaccgttgcaaggagagctgggcagatgtctatcaagataaccatttctgctgcctgctgattctctcacctgccagtttctgcatctgcccatagagtactcatgtgctccttcctgtaccagatgatctccctggacttaatttctttttttttttttttgagacggagtctcactctgtcgcccaggctagagtgcggtggcgcgatctcagctcactgcaagctccgcctcctgggttcacgctattctcctgcctcagcctcccgagtagctgggactacaggtacccaccaccatgcccggctaattttttgtatttttagtagagacggggtttcaccgtgttagccaggatggtcttgatctcctgacctcgtgatccgcccgccttggccttccaaagtgctaggattacaggcgtgagccacaccgcgcccggcctggacttgatttcttgattgcctgcacctagagtatccatcgtctttcctacgtggctgggcaactaggtttatccctttcaggctagccctccttcattgccataacatctaggggtgacattgactgagttgtatatgattattcatcatttctcgggcctagatagattgtgatgagttttagggcttgtcaaatttcaaggctctgtttttataccacacataattttgggaatttgtaaagtgcttaataattatccatcaatgagtaagctttgaaggaagattaaaaagtattatgaaataaattacagagttatagttgaggcttattcagagcaaaattatttttggtgtattttgagcactaggtaaatgtcaaaggcacccatgagaaatagcaaaaactgctgtaatagtataaattctcatttatagctgctgcagaagagatgcaaatgttctctatgtggttgctctgtgtgaggaggtgtttcatgggactatcaaaatcctatcttaggttgtcattttggacactaaaaattttcaagtaataatttaaagaatcttgaggtttccttttgatatggcctagaaacctttggcaactaatttctgtatgactcaaaggatttcccctagaagggaatcctactatttgggcttttaaaaataaactgtcattctggatacatttgtagccctgactagtgggtgagcatgagtttcattctgaaatccagaaagaataatgagactaaaaaaaatcaagacactgagtacagtatattagttaatatagcatataattcaatgtttgctttagaattttgaatttagccaaaaaataattggatcaggtactaatgatcaaaatgagatcacgtgaggaattaaggagtgtacataagatcttggattacatgttacatagtcatgtggcgtaaccaaatgtatccaagtgtatttacatgtgactttgaattataatggcagagagttggtcaaggaagaagagtacccaggcacccagcaagttaacactggaaacagatggtaggagcggtttcaaattgagccaacttatttaaattacaaagagatcttcaagttcattttgctatccatagaaagcaataaatcacacctattaacttacctaattgtctttagctagcaatattagattcagtctcatactcctttaactttcatttaatagtgttattggttgagggtgggttgttgtccaggttcttggtgtttcgaacaaataattgaacaaaatgcacaaacaaagcaaggcagcaaaagcagagattcattttaaaccaaagtacactctaaagggtgggagtgggattgagcaactggcttaagagcataggtaacagaattttctggggtttaaataccctctagaggtttcccattggtttattctatgcaaatgaagtagtggcccactaccagtctgattggttgttggaggggaccaatcagaatgaagagtaggcctgcaaccagtctgatccattgcaggaggggaccagtcagaggtagtttcatttttcaacttcccctcggaaaaaggaggggctgaaaagggagtagcctctgatatccagtcagcatgaatgagccttaggctccctgcctccagaccctattctcctgcctcaatagcagtttgagataaaatgcaatgtttgaaagctaccttacagtgagttagtgatttccgtttaatatccttaatgtattacttcaaaataacagaatttattgaacaacacacaagtcaatttgcttattagcacattgttctctgcagaactgctggcgacctcattgccctactttggaaaccacgttaatatactggggaaacagatttagttagctttgaaccatgatcacaggacaattatgaaaacatgcaaatttgaaaggctagactctgacaccacaaatttttaaaataattctccaaaaacatttgcatctaggatgtgacatgcttaaggagtgaaaatctaaactagcttttcctttccttccctgcttctgcaaaaagcatattttccccttcacatttgctgagcaatttttctttattatgcatattaggtcagttgtggaagaaagaagtctttttctagtaggattacttgtttcaaagcttagactagcttagattgagggtaagaatagcatagaactgtccagtctgagtagggccaagtttgccaagaggggttataggttatctaatgtgacataaagaatacccaggttaggttgggcgtggtggctcatgcctgtaatcccagcactttgggaggctgaggcaggtggatcgcttgaagtcaggagttcaaggccagcctgaccaacatggtgaaaccccttctctactaaaaatacaaaaattagcctggcgtggtggtgcgtgcctgtaatcccagctactcaggaggctgaggcaggagaatcgcttgaacccaagaggaggaggttgcagtgagctgagaccatgccattgcactccagcctgggtaacaagagtgaaactgcgtctcacaaacaaacaaacaaaaaaagaatacctatgctaacgtgctggtcaaaggcttggagctacaaataggatggagactggagatggcacactgagtttaaggacctagacctgagggaagaatttaaatggaatattgtgactgcaaggtggggtgttggctctgtcatgagcctgacacccatggcattactacaccctgcctgaactagttcttggccttcctgctgttgggaggaccagtatctaaatgtgtatcttcctgtgttagtgcaagttccactgtggcttagattgttcatctggtggtttggagcacacatcctgagagatgaacgaatggaacaattgttagtttattgacctagtcctgtgtgcctggacactgcaccagacaattgatataccttgactggtttttcattccctaagtctttaattatttggttttacaaatattgctatttcttcaatatgtgaacactgattcagacaatatgtgtcatttttctagtgcttcagatttgaaatctgggagtttattcattcacttactcagcaaatatgtattaggtatttactagtgtcaggtactgtgctgggcattgggtataaaaagtaaaataaaagaaacatgaccactatcctcatgatacttataatccaagggaaaaaattgacttcaaataaacaaatgcctacatagatatagatatataagattacaaattaagcagtaatttataataaatactgtgaaagaaaaatcggggggtatgaaaaacatgatgacgtaatttagattgaggagtcaaggaagacaactttctgaaagtgacatttgtgcagagacctcagaataggcaacagttagttagccgtatgaaaacaaggagtaaaataattgcagacagaaggaagggcatgagtaaatatcctgaggtgggagatggctcagtgggttcaagatactgaaagcaactggaacttggtgggcgagcaaaaagtggtaaaagatgaagtagtatttgactctttcccgttttcactcatcacatcaaattacaggttgagcatcccaaatcttaaaaccccaaatcctaaatgctccaaaattaaaaactttttgagcactgatatgacatccaaaggaaatgctcactgcagcatgtcaaattttgggtttttagatttgtgattctcaactgatacaacgcaaatattccaaaatctgaaaaaaatcataaatctgaaacacttcttgtcccaagcatttcaaatgaaggatactcaacctgtagttgtttttatttctctcttataatcttcctcccagccatgtcttcttttctgtttctttcctacccccaaactcaggctcctattacattgaagctaaatttctgtgtcagatttgtaactgagttatctgcctccatttcgtttctctccttgatccatttacagatcatatagacaagatttttaaaaaaatcatacttttatcaataaatctaaagttcaaagagatatttaggggagacatatagtctaacttactgtattagttgaggtaggtgaaccgcagttacaaacaactcccaaatctcagtggcctaccacaataaaggttcatttcttgctgtgtccgtctaatgcaggttggcagggatgttctctgcctgtgcagtcatttggtggctcatgtctcttccatttagtgggtcagtcatcccctaggtttttgactcttctgttgaatcagtctcaaatttctagaagacaaaatctgactacctagcttggatcagatgatttcctttggttctattaactgacatgggggaagggtaagttatgtacatcaaacatgggtgcagtagtcattcttgtgggttggggccatttatacagaaggggaaatgagctgggcagatcccatcaaaagatgtgttattcaggcagacatttttacttcatatattagatctttatatatttgaagaaaatcatccagtcttcttatttcccacaagctttattattttctcatgagaatgcatatttccgctttcttaggggcaacatccaggttattacagtagcttatcaactttcctaaaattcagctgtaaacttccttccaatttcacctgttgggtgaattaactacactcttaattaattattctcaagttctgaattcctgcatggcttgattcaatcaatcaagcaacctttaaccttgcttgtacagttgcctagcattaattttcagcttttcaaactccatatcttgccccattgaagatgaagaccatgtcttatttgccctttgaattaatcacaatataatgctgactgtattccttccttaattgtattcaaaaacttaataatctctccttcctcaggaatactttcatgtttacagaaggaaatcttcatttatctcttgattctgtgataagcattgtccttaattggtctacagaatgtgtcatttactctcaagaaatgcagactccaagttaccatgtattgaggctcgctatgtactgggaactctgttatgcaattttatacgcattatttaatcccacaacaagcctatgagatagttactattattatttccaagatcacacagctaatctaattctggaactttagtctcttgagtttccaagctcttgccttctttttcttttttttttgagacgcagtctcgctttgtcgccgaggctggagtgcagtggcgcaatcttggctcaccgcaacctctgcctcccgggttcaagggattctcctgcctcagcctccaaagtagttgggattacaggcacacgccaccatgtctggctattttttgtgtttttagtggagacggggttttgccatgttggccaggctgatctcgaactcctgacctcaggtgggctgcctgcctcggcctcccaaagtgctgggattacaggcatgagccactgtgcccggccttgctcttgccttcttaattgcaactctgtactgacatgcatgttaataaattggccaaactggcattctcactgcagctctgttcttttccaatccttgaacctctcattatggatgcctcatctcatcctgttgccttttccactgtgggttgtattgatcagaaagcagatctgtttatggaaggaaagaaaggtattgggtttagtagttattagaaatagaaatattagaataaagacaacattgaaagaaacagacaagagaaagaggatgaggttccccatgtttacattcctgtgactcaagagtgcagagagccaagaacaaagctgaagtttagccagggaaaggagagtgttcaactaaaattaactctgtaggcagcattcccagttgtttgagtttcaggatcccctcctcaatttcctaagaaaaacaacatgcaagttaaaaaaaaaaataaacagtagttaggggcaaagaaaccggtgtaattagggctaaagtgatctgtggtatctctaaatggtagctccatttagagaatgatctcagaggcagttttggaagggtttggatcagagcaaggaggagatcatgagtgcaagactataaactatggtctataaatcagaaagtttatactaaattcagaaactttaatgcttcttggggactgtgggcttgttaatatgctactggcctgattttggttaagtctaaggataaactggaaaatcattagtccatgtggctatatctgttctacctggtactgtagttgtgcagagggctgctcccacccttcagcactgagatcatggagctcgttctcttggtggttttcatgattgaacctggattaatagttactaattatatatatgtataactatcaatagtgtaatcatggttattatgaaatattgatataattattaatgcaactaactactctccctatattctctggtctctagtttctatcaaggaagactgagcccacacaaaggcttaggataggaggagaatcaacattcagggctgcctctgaaacccttgtgctattgtaaacagattcctctattcctccagagaaagttggaaagtggaaaagttgccttttgcttcttagccttaatgctccttctagtttttggctttaattgaaatcccagtctcacaggttaccaaagacattgttgtcatgatgttgtggtgatgatgatgggtaggtggtgagctgttgctcagctgtctgcactacaacttctaaaccaagaattgtccaactttagtgaacatcatcatttggagggcttctgaaaacacagatttctgagctccatcctcatttctgattcagtgggtttggggtagagcctagaatttcatttctaacaagttcctaggtgacattcatgctgctggcctggcaactacactttgagaatcattgttctacctcattactgattaaaatgctcaacttcctttgcaacccttggcaataacctataccatgcactctccaactaacagcccagtcgccacatatatacacttttggaagatattatggcaacaagtccactgtttcctttgctactccaacttctctataaccctaacttccactatttccaattctcacacttcctcaccacaacttcacctactctttgagcacaaggacagttttgtggcaggccgggtctcactaacacaggcctctgtaacaactgtttcagcactgacggagtggccaagttaaatattaaaagctgatcgagctagtgcccttatacaaaggctggaatgtaacaaaagcccaccaggagttttgctcaggcctttcctgggccttgaagtgtgacaagataacaaatgaattcttaacagaggcctgtttaggattaaacaagttttattggaggtctgaagaaactccccagacctccacaaacaagtttattgggggtctgaagaaactccccaaacctccatgatttagcaggagacaagataagggtaatcacccagcacctggacccattaggattaagtaaatttacggaggctccagaggaaggtcttcaggattcagatcttagttatagattagaagaagttaatcacttatgtcttcagatgaatgcacactaacacacagacatatagcttagaaggtatataagctctggaaaactttgtaactttgagttggcctggcgatattttccaggccttttccctgtacccagttacagaaataaactgtcttctttcccagttcgtctgcatctcattattgggctgcgagaataggcagcctgaccctcagcttggtccggaaacagtttggtcacctcaattcctttatttaattcaccttttgatctcttcttggcttctaggccttctccatactgccgaggatccatagttgattattagaattactctccattgggccgggtgtggtggtgcacacctgtaatcccagcactctgggaggccgaggcaggcggatcacgaggtcaggagatcaagaccatcctggctaacacagtgaaaccctgtctctactaaaaatacaaaaaattagccaggcatggtggcgggcacctgtagtcccagctactcgggaggctgatgcaggagaatggcgtgaacccgggaggcagagcttgcagtgagctgagatcccgccactgcactccagcctgggcaacagagcaggactctatctcaaaaaaaaaaaaaaaagaattactctcaatttacttgcatccctatatttccatcctatttccaatgatcaatgttaggtcattgccacaacctgccttctccatttttacactggttggggagggagtgataaagttgataagaatgtaaacacaaataaccacaatatacagcaatgtcccatttaaatcataagcataatacagaaattcgtgaacttgtaaaggcaggaaagagaacatctagttagaatgatcataaaaaaacttcaaggctattatggcagatacaaatatgaataagacactactagacttttttaagcccttaagtataggaatggcataatttatattcatttcactgatagcaccaagcgcttttcaaaagagaattaatgaattatgtctcctctagtgtgattctttatctattacacagtgcagtgtgaaatgccctaagggggcttaaatgctgagtaaacaaatttttaaaagcaatttagacacgcacacacacacacatacacacacacacacacacacacacattagatgtacaagcatagaaaagtcttggaaggataaatactgtcttgctttatccatcagcatactgattacagttgtgatgaggtaagtacccacaccttttgtaatgtaaaattgtgcagcaaaacagcaaaaataaaatattacttgggggaaaaagacaattaacttgtttttggccaaaggtgatagaaacaataatacttgcatttcctgaggccctaccatatgtcaggcatatgccaccttatttacccctcaccatcaccctacagggctatattatgtattatcttcattttgcaattgggaatagttattgtatttcttccattataagatcaaatttaaaaatactttaaatcattggaatgtgtatgcatgttatcatttatggtgtcttagacttgataaaataacgtaagtcacattattataaatcattagatataatattctaacttatggtttaattggctctaaattctgtgcttttcctccattggattgcgttatcttttctaacaaaagtagacttttgctccttctccaagttttctttctctctttctctttctcttacacacacacacacacacacacacacacacatgccatgcaggcacacacacacagtttttcctttctctttctctcactttcacacacacacacacacacacacacacacatacactcttacatcttagtccaaagtaaaaatatcctgcttatcagatgctctgccttattttcaaggcttatgcttattttgagtgtagccatggtgaacttcatctatctaactgatgtgctagtctagtctcctacctactgctaaattactcaattaacctattttgttcaattccattttagccacaaccctttagtttcagttgccttgacattggggaaaaaaaccctaatctttcttatctatttggttaattggccaaattaattctgacagatatcacataggtatttttgtttttcttggggcagctagccaccctgggccagtgcttctcaatctgggcacacaagaaacaactggtgtatcttcttgaagcaagagttctccttgaagatttacttgaagagaaagttgaagcaggacactgaaaaatgtagatgaaaatctttgaaagaagtattttttatcttaaaagaaaaaagaaaatattatgaaacagaataaaatatctgtaggcattttttttttttttttgtgagatggagtcttgctcttgttgcccaggctggagtgcaatggcgcaatctcggctcaccgcaacctccacctgctggattcaagcgattctcctgcctcaggctcctgaatagctgggattacaggcacccaccaccaagcccggctaattttgtatttttagtagagacaggatttctccatgttggtcaggctggtcttgaactcccgacctcaggtgatctgcccgcctcggcctcccaaagtgctgggattacaggcgtgagccatcgcgcccagactgtaggcatttttaaggcacaactttaatggaattttgaactggtggtaaactactcatggtaacctgtggttgaaaccataggctttggggcaagactgaaacctagctcctcccttttctaactgtaccctggggcaagttgcttagcctttttgtgtctccatttctcatttgtaaaatgggaataatatcatctgcctcatagagttatcatgagaattaagtgaccagtatatgttaaatgttggaacagtgggtcgttcatagtgaattctccctaatgttagctattttcattttcatttatatttctagatatcccaagggttattattttgtcctcctcttttgttaagttgtctcagagcaaaagtttgagcagccctgccttagtccttccccaggattctctccagtatgctgcacttggttctcatcggctggtcttttgtaatgtttcaggaatgcactgttttcctttttctcttctctgtctcttttttttccagcaccattaaaaacaaagagtagctgttttaggaatttgggaagtgaagaaacaagacattcgactgtgagtttcacccatgtttaaaacgaaataacctaacaatcgggagtggcgtgctaccgttaagattttggaggtagagacgtgaagattttcagtcgcaactccctttagaaccatggcttgaacccgtaaagtatgagggctgcccataaaactttctcttctaagatgtgggatatgtgtagtctcatctagttatggctcatctgggaatggattttctgacgcaaatgaggtttaaaaaaaaaaggcatagtgtctctttatttggttaacactatttctgcactttgtttttccttgtcagctttaaaaggaagagaacaaaagccaaccaccctgccaaaacttggcagtagaatttcagtgagtgaaaattctccacctacagtaatgtttgaagtggttgcacagtgagggccccccagcccccaccccaacccacccacccctccactgcaggccattcttgacctgttaggacaccatcttatgcaaagttaagaaagcccaagagcctagaacccacagaaaaaggccagtgtaagactaagggcatctatcccctgttcttttttccctgttccatctgatattatctttggctcaatagtcctagaactcagaaggctgatactccaatgtaccctagaattgctagactcaactctaccatctcctccgctcccagaacctggactcttggagggcagacagcaggataggagcagcctcaaggacgggaaagcaatggagactgacctatcctttgctatttccctttgccaccaatatcttctagttataggatttttgcacctagaaataaaatatacaaatattgaccataacttacagtaattcagtgcttctaagttcccatgtaccatggcaaacacatggatatattatagcaacatcataaaacagacatgattatttctataccaaggataaatctcaggtttagaagaaaggttggaaaaattcttgaaggtcacaagccagaagtacatggcactgaaacagatctgactcttgagtccaagcctattgtattgacttgctatcaatgcataacaaaccgcatcacacaaaaccagtagtatctttgagtcatcttgggggttggctgatttaagctgggctaggctaggtggctggggtagctctgctctatatgcctctcatcttcctcctgggaccagtaggttgccctggacatgtgtaagaagaaaattggaaatatgcaaggtctcttaaggcctaggcttggaactggcacactaatttctgcctcatcctgttcgtcaaggcaagttacaaggctgagactaatgtcaaagagcaaagagacatacctcatttttttttaagagataagggtatgcctgttgattaggttgtactcaaatgcctgggctcaagggatcatcctgcattgctgggactacaaatgtgcaccactgtgcccaactgagatatacttcacctttgtggggtgtagtggatgctgaggtgcacttcctggtccctttccagaaccaaggcacttactttctcagctgctaggaatattgcttgctgatgatggctcaccaagtccactgactcccatcctttcacctccaccctcgccctggagtccccatcccactgcccaccaggaattgtcctcagctgaagggcactgctttgcccaagggtgcccctatggtcaacccacattcaaagactagtcagatgtgagtatgaagtctgacctcttgcctcaattcaagacatctctgaagagctatcctagcatcagagcttcccataggattgggtgaggcctgggttgcaattaaattagtcccatttttttctgtgtcaatcttgcttcccctattcccttaaaatggctgtttccaagagcattcctcaataattactctatgaaatctaaccttcaacatgagagggactccaaagccaatggtgaagggcaaagatatagtataggaaagaatcaaaaccaataacgcaatctaccacatctttgcatttaagaagtagattaaactgcatcccaggtccaaaaacaaaagcatatagtggagcagacagaatctctgtctgacatgtcttaatgtatatctaaaccattgatattggaccttgaaatatatttgacttggaaaaggcatgtggtcctgaagagttgtgggcaaatggaaactttgtaaattgaattaaattccaaatgcatggtgggggtttggtattctaaagtgaaaaatgtggtgaattattttatgaataaccattttaataacattgatttttctatgatgagttttacatatcagcaatttatttcatttttatgaacccattctatttttaaaataattctgtgtgtgtgaaattatagcatgatgtcatacgtttgttttttggtctccaatccttggtggatttcctttgcataaattttaagtttacatgaacctgaaaagattccagggactctgggcaaagccatgggtgcatggttgttggaaatgggtacaatggatataagtagccgggcagacaaacatcccaggagaagaaattttggccaggtcatgttcctttgtccagtaaaaaaagcaggaggagagaaaatagataatttactgtactcagggatagggattgataaaatagctacagcagaaggaaaagtcagcaggaaaatc

SEQ ID NO: 15246 - DNA, 113042 bp, Human; identical to SEQ ID NO: 12343

SEQ ID NO: 15247 - DNA, 5870 bp, Human
cccaatctccctgcccagagcttgagcctgccttctcatggtctcagtcatgagaaccactgacaagtgctaacctaaggagggatgtggttagattcgaattttaagtagaacaccctgtgctctgggtgatgagtggatcgcagggtatgtggagatagagagcaagagagaccagctggaagggtgttgcaacagttcaggtgagaaacgacttcaggccgagctcagaaggtattggtggagatagcaaggacttgatccttgatgggggtagggaagaggaggaagaatgaggaatgattgtgaatacacagatggcaatggcggttttcttaactcaaagagaaaacacctaaggaggaaacacagtgagtgttgctggggttgggtggggaggaaggaatgctaagtgccatgatgtgcagatctattaaacttgagtgtctctggacacttcagtagggaagtccctgataaatccttaactgcctgcagtaaaatagcttcaaatagcttgagacagcctgcctaaaatgctgtggtcaaatagttaaaagtgagcaatttgaagaattaaaagcagcgcttttcccaggaaaggagagccccaggtcctgatatgattgatggcagtaaaggctatggaaatgtcagggagccaggtagcaggagggtgacacctgcagtgactgggtctgtatttctccagcttagtcagtagttttggcttccatgactgctgctggtccaacctttacttactttaataacgctgtcactttccctcagagacaatctggaacacctcctcttcccaccttgcccaattctacttctattgctttgctaaagtcttcctcagccaagtaggcagaccataagactttttgaaatcatgagattttctaagagagaaaacccaagaagaagagccaggaaatgtttccagggaagggactagaacccagatggagcccccaagctttcctagcatcttcccagtccccctcctgagaggagctgagtctggagcagaagtgtagggtgggctctgccaggggttgagtgtggtgttgtggtggaaggtagtgttggactgagatgcaaccagaacaacgtatccccttttcatggctggcaagtgttgttttcaagtacatcaagtgaagctgattttttttgggggggggtttgtttctttttcaggaactgttagatctattgagtggtttgaggaccaaaatttaaaaagagtctgtcctcctttgagaatgggccgtgggagtctcttgcagccattgacccatacacaggtttttatgtggtgtgatagaagaaaatgctaaagagaatataggatcccaagacttccaggatttattatgtatcattgtacacactcactgattcagcttcaatactggggaagtaaggattcctatagtaacaatagtccctcaagtagaggccatgctcacctgaggttgggattggggtcattggggttggcactggacaataattccctctctcccccaccctcaccccattaaagagacatgtagagggacagagtcaagttcacagatgagacgggccacctagcggacccgaaataagtggagccagtggctctctcttcccttgtatgagacgatctgagggcctctggacactgcgggtggttatttatgtttgggtggccactgcacctcctgcttctgctgctggtgctctacaggaagcaatacttctccctttgtgggcagggctggttgaatgtcttggacctggcctggagctggggcaaacacaggctgctccagctgccccttctgctgctccaggtccttcagctgcccctcctgctgctccagatgttttagttgtccgtcctgctgctctgggtgctctaggtgcttttcctgctgttccaggtgctttggctgtcctacctgctgctctgggagctccagctgtgcctcctgcttctccaggtgcttcacctggccctcttgctgctctgggagctccagttgcttctcctcctgctccaggttctttggctgccccacctgctgctctgggacctccaactgcccctgctgctgctccagatgcttcagttgtccctcctgctcctctaggtgcttcagctgccccacctgctgctccaggtgctccacctgcctctcctgctgctccagctgcccctcctgctgcaccagatgcttcagctgcccctcctgctgcaccaggtgcttcagctgcccctcctcctcctccaggtgctttggctgcccctgctgcttctctagctgcttcagctgcagcacctgctgctctgggagccccagctgcccttcctggtgctccaggtgctccagctgcccctcctgctgctccaggtgcttcagctgcccctcctgctcctccagctgctccagttgcccctcctgctgctccagatgcttaggctgcccctcctgctgctccaggtgcttcagctgccccatctgctgctctgggagctctggctgcttctcctgctgatccaggtgcttcagctgcccctcctgctgttccaggtacttcagctgccccatctgctcctctgggacctccagctgcccctcctggtgctccaggtgcttcagctgtccctcctgctgctcagagagctccagctgcccctcctgctgctcagagagctccagctgcccctcctgctgctgtgggagctccagctgcccctcctgctgctctgggagctccagctgcccctcctgctgctctgggagctccagctgcccctcctgctgctctgggagctccagctgcccctcctgctgctctgggagctccagctgcccctcctgctgctctgggagctccagctgcccctcctgctgctctgggagctccagctgcccctcctgctgctccgggtgcttcagctgtccctcctgctgctctaggtgcttcaggtgcccctcctgctgctctgggagctccaacagttgctctttcttcattcccagttgctcatctctcttgactagctcttgatccagttgctggtctaagagcttcttctcttcttccagctgtttgtttagctgctgatccctttgtgttttctcctgcttaagctgctgctctgggttttctgctttctgatattcctcatgctgttcccagtgctgttgctgcagctcctgctcctgtggctccttctgctgttgctcacattcttgctcaggcagtccctttacagcagtcatgtgcttttcctcttgctttgatgggacctccactgggagctcgacaggcaccttctggcatgggggaggcagtggagttggctgtttcatttgctcctgatgggtattgactggaggaggaacagtcttgaggagctcctgactgagggcaggggagagggtcactggcagtgtgtgttgctgggacatcttagaagctactgtcaacctgaaagacagaagaggtctgatgcacaggctgaaggcaaaggaaatagatgaaaccttgggaatctgcagaagtatctggttttttagcatcccctcttcccttgggcagggtactgttctaccacctctggactatcatttcccaaaagcagcagagagagaagggtggaaatgtggaggggcagagaaaggtcctcctaggagcctccttgttcccaggtgagagccaacaaggagatctgtctgcagggctgttctgcaagggtgggtcaggtgccagctcactgtctgctcttgtctagtccttgtgtccaccctcatcgcttcactgaccaaggagcagagatgcgttctgggattatgtcacagtgaggagtaaggccttagggaatgaaatgtctcttggagaacaccaagtcctagaaaaccaataggccgtgccagagaggacctaagaggtcatggtgtgacctccagactggagccacaggacatgctctaggcctcaatctcccattggaatgctgtgtgtttctgggcatgtcacttagtctcctgggatttggttttcccccctgtaaagccagcaggttggcctattcaaccccagggctgctttctctcctgaccttctgaggtttagctgcagtccttgtgtctggggtggggctgcgggagctggaaggttgctgagagttggaggttgttcttccaagtcttatacttctaagttgagttttcctgtcccagctctgcctaggtttctccaaatagaaaggtttccccattctgccatccctctgtgcagcatagccaaaaggtagaagctcttccctgaacctctccctccataaagaaggcaaaatgatggtctgtcaaaacccaagaggtttaggaaagaagttgaatgctattcccctcctcccttccataattctctctcacacacaaatccaaaaatatggtcacaagaaaagatgggacataggatgattactctctgttctgcacttctgtgccaaggcacttttctctcagtactctgactcgagtccccctagaatgaaagtccagctgaatccagccccagagtaatgcccacccccacccaggctgcccacccccaccacatcgtatgctgttggaggtcccgagtcccaaccctggttctaccatccgacacttaccagactcacagtaaggctgaggcagaggctttggtggagtgctgagctgagcaggagtcagggcactctttatatcattctgcagcctggcctccctccaggttgaaggtgatggacaggtttcaccactctagttggtcaacttcctctaaccccttcctgactcaccacaggcatcttaagcagcaaaccctttagggccccatttcccagggacacacagctcctgcctggccagaggattctggtagctcaactattcctgtgatgcttttctgacctaggcacagggagctgagtgaggcatcctactgttttgtgaccttagtcaaacttctgctctgaatctcaatttttccactttcaaaatgagtttgttctcattattaggccgaaagattcactttcaagggcatgaaatggaaagttatgtgtctttcggggatgtccaggctgggttatatgtttgaagatagagtcacttcccatgaaggggtggtatttctggggtgttctcttgggccacaagcccttcctctctcagaatatattttttaactccatcctatgtggaaataaactctgtctttggtggagggagtttgactttaggccaagtagagtcaagtagaaggcttctaggagtcctctgctgctgccacttgctgcccagcctctatgcccgaggctgcagttagagaagttctcaggaatgccatgctcataagaactccaaagcacggcccactctaggcaaggaaacaagattgaatctacacaatataaaaataagtattgctttttataatgacaaaccaaactactttcttaagtacttttttaaatgcatgaaggtataaagatcagaatcaaatcatccatttcctgttgtaaatcatactctagaaatagcttaagaaatctttcagagtggggatttgagcacatctctcccccgtgccaacagtgcaccagcacacttgaaataacattcaaactcactgccgtggtttaaaagaccctgggtacctggcttctgccttcttctggggccccaattcatgtcaatctctccctgagaggtatattcttacctcactgagggccttcggttcctgagatgagcccagagctctccacctgggggcttggcacctgctctccttctgcccaccggcccctcccc

SEQ ID NO: 15248 - DNA, 28283 bp, Human
  misc_feature (1)...(28283): n = A,T,C or G
nnnnnnnnnnnnnnnnnnnnnnnnnnnnnnnnnnnnnnnnnnnnnnnnnnnnnnnnnnnnnnnnaaaaaagaatagacttggggccaggcgaggcagctcacgcctgtaatcccagtactctgggaggccaaggcgggaggatcacttgaggtcaggagtttgagaccagactggccaatgtggcgaaaccccgtctctactaaaaatacaaaaatagcaggacaggccgggcgcggtggctcacgcctgtaatcctagcactttgggaggccgacgcgggcggatcacgaggtcaggagatcgagaccatcctgactaacacagtgaaaccacatctctactaaaaatacaaaaaattagccaggcgtgttggcggacgcctgcagtcccagctacttgggaggctgaggcaggagaatggcgtgaacccgggaggcagagcttgcagtgagcaagatcgcgccactgcactccagcctgggcaacatagcaagactccgtctcaaaaaaaagaaaaaaaaaatagcaggacatagtggcaggtgcctatgatccctgctacttgggaggctgaggcaggagaactgcttgacccaggaggcagaggctgcagtgagccaaaaacacgccactgcattccaacctgggcgaaagaatgagactctgtctcaaaaaaaaaaaaaaacaacttggctgggagcggtggctcatacctgtaatcccagcatttcgggaggctgaggcaggaggatcacttaaacccaggagtttgagaccagccccggcaacatagtgggaccccatctctattaaaaatagaaaaaaatgccaggcgtggtggctcacgcctgtactttggaaggctgaggcaggcggaccacctgggtcaggagttcgagaccagcctggccaacatggcgaaacctgtctctactaaagtacaaaaattagccaggcgtagtagtgcgcgcctgtagtcccagctactcagggagattgtggcaggaaaatcgcttgaacctgggaggcagaagttgcagtgagccaagatcgtgccactgcactccaaccaagacaacagagtgagactccgtctcaaaaaaaaaaaaaaaaaaaaaaagaatttaggagtaggccaggttgtggctcatgtctgtaatcccagcactttgggaggctgagaagggcagatagcttgcactgatgagtttgagaccagcctgggcaacatggtgaaaccccatctctacaaaaaaatacaaaattaggccagcatggtagcctgcacctgcagtctcagctactcgggaggctaaggcaggaagatcgctcaagcttgggaggcggaggtggcaataagccaagatctcatcactgcactccaacctaggtgacagagcaagaccctgtcccaaaaaaaaaaaataaaagaataaaaaaattaggaataaagaggcatgatttctgtcaattactcatagatggttcagaaaaaaaggtatagatagaaaagagaatgacagagcaaacacagcaaaatgcaaacaaatggtgactctagatggagtatttgggagtttcttgaattattcttgcaatttttctgtaaatttaaagttatataaaaaaaaaaaacttttttttttttgagacagagtctcactctgtcgcccaggctagagggcagtggcgcgatctcggctcactgcaagctccacctcccgggtccacatcattctcctgcctcagccgcccaagtagctgggactacaggtacctgccaccacacctcagtaattttttctatttttagtagagacggggtttcaccgtgttagccaggatagtctcgatctcctgacctcgtgatccgtctgcctcggcctcccaaagtgctgggattacaggcgtaagccaccgcgcccagccaaaatggaaaaaaacaagtggtaagagaaaggaacacgggtcatggtccaagccccctctcaggacgtccatgccaaagcaggtgtatgtaccaacaattgtgaagcagtcagcaggtaagctctgtaatctgtgacagctatataaccctccccctaccccaccccacttacctcaaaccccagcgctttgtccagtaggaatctggattccaggcactaatcccccagacagcatgattcaaaacacataccccaccaggtcccaagccctcccaagtttacgaagggaagtgaggatactttaaaagcattttcctctagaaacattacaaacacaaaatatacaaaaaaaggattttgttttaaaagtgacttgggttataatggaagaaaatgtcacactagggcccaaaattactacattgagctatgttttcttaagattaaaaatagattctatcttcccttcccaggaaccttccctcctagaggaaaaaaaacccaaatcagatcattaccaagttaagaggtccccagagctaagggcaaaatgtgggcacgctgcatccagtgtttcccagtatccgattccctactattggttcccagtctatctcacaatgatgtcatcaactatctggtcctcccctttgacttaatgcaataaaagtaattcaagggccaggcacggtggctcacacctgtaatcccagcactactggaggcagaggtgggcagatcacctgaggtcgggagttcgagaccagcccgaccaacatggagaaaccccttttctactgaaaatacaaaattagccaggcgtggtggcacatgcctgtaatcccagctattcgggaggctgaggcagaatcgcttgaatccgggaggcagaggttgcggtgagccaagatcacgccattgcactccagcctgggcaacaagagcaaaactgtgtctcaaaaaaaaaaaaaaggtaattcacatggaggtaaaataaattccaacaccacactaggacacaaatgaaaagcaggtctccttcccaggtcctcaggtgagcagactgagtttcttcagtagctctccacaaatgacacattgaatgtatatctctaaacacataaacaagcacatctcttttaatttcattcttaaagttcaaatgaaatcaaattcttcaaaactgttccttttttgccgggcacagtggctcacacctggcaagcagatcataaggtcaggagttcaaggccagcctggccaacatggtgaaaccccgtctctattaaaaatataaaaaattagatggtcatagtggcacgcacctgtaatcccagctactcaggaagctgaggcaggggaatcgcttgaccctgggaagcaaaggtttcagtgagccaagaccgcgccactgcactccagcatgggagacagaatgagaatccctatcaaaaaaaaaaaaataaataaccgttcctttttctaatttagcagaactgagagacctcagccccagtgggtagatccttcttctcattcacacctattgtgtgtggcacatctaaatgtctaagtatcttgcatatcttgctctccagggtgttctcacactcatccttgcattcttcttagaacatatctaaggatataatcctagatgtggaattgctgggtcaaaggatatgtacattggaattgttagatttggcaaaatgtccttcaatttacaccctcacctaaagatacaaacgacttttctcttattttcactaacatttaagtattgtcaaactctttcattaataacataagatggaagaggaaggaggtggggcagtttgaaacaacatgagacagcagtttgccctgcccttattgtttgattaatgggcatggtgggcagcaggtgtcataaattcaatctgggagtaatggtacttaatagttagccagaatgataatacaggagggtgagcatctagacaactaatgaatcaaaacatgatgctatgtttttctagtaaaacttgagtacctcaggaaaattgctatcaagaatttatggggctggccgggcgtggtggctcacgtctgaattcccagcactttgggaagccgaggcgggcagatcacgaggtcaggagatcgagaccatcctggctaacatggtgaaaccccgtctctatgaaaaacacaaaaaattagccgtgtatggtggcgggagcctgttgtagtcccagctaatggggaggccgaggcaggagaatcgcttgaacccgggaggcggaggttgcagtgagccgagatcacgccactgcactccagcctgggtgacagagcaagatcccatctcaaacaaaaaaaaaaaaaaaaaaaagaatgtatggggctaattactccaaataataacaaatatgtagtactgttgttgattccatgtggtttcctcccaggtatctctctgaaccaaggcacctcctgggccaaccccagaagaactcagggctcaggggtagtgagaacacagatacaagtgctgagcacatgaagggcagaagagggaagctagagagtaactttggttctcaagtctaacctttatattgtagtttcactgttctggaaaacattaacattttctaaattcatattaccaaatttaagtttgttgcctgttgtcctactgaagacagggtctgggaggaatgcaggagcccagctgttctgtagcttgcaccctccagggtcttgacgtactgggggaagaaccgtctgtcctaggccagtgcagccatctgggatagacagtcgtgtgcctaggcaaagaggaagaaccccatctctacaaaaaatacaaaattctcaataattaaaacatcaggccgggcacggtggctcatacctgtaatcccagcactttgggaggccaaggcaggtggattgcttgagcaatccaggagttcgagatcagtctgggcaacacagagaaaccccattactactaaaaatacaaaaattagccaggcatggcacacgcctgtaatcccagctactggttaggctgagacaggaaaatcacttcaacctgggaggcagaggatccagtgagccaagatcacaccactgcactccagcctgggcaacagagcgagactgaatctcaaaaacaaagcaaaacaaaacaaacaaaaaaaatcaaatactatatatctaacagttcactcttaggtatatacccagaagacaccgtcaagaatattcatatccggctgagcgcagtgtctcacgcctgtaatcccaacactttgggaggctgaggtgggcagatcacccgaggtcaggagttcgagaccagcctggccaacagggtgaaaccctgtctctactaaaaatataaaaattagccaggcgtggtgatgcacacctgtaatcccagctacttgggaggctgagttaggagaatcacttgaacccacgaggtggagcttgcagtgagccgagatcatgccactacactccagagtgagactctgtctcaaaaaaaagaaaaagggccgggcgcggtggctcacgcctgtaatcccagcacttcgggatactgaggcgggaggatcacaaggtcaggagatcgagaccatcctggctaacacggtgaaaccctgtctctactaaaaatacaaaaaattagccgggcgtggtggcatgcgcctatagtcccagctaccagggaggctgaggcaggagaatggcgtgaacctgggaggcggagcttgcagtgagccgagatagtaccactgcactccagtctgggcgacagagcaagactccgtctcaaaaaataaataaataaataaataaataaataaataaataaataaataaaagaaaaagaaaatagtggtataaatctctcttgcagaacattcagccctcccctcaccaccctggcttctgctggcagtctgacaccactcctacaggcagttccagagcagtgcctccccaggcctctcccagagcacagcccatgcctccctgactctggaattccttacattctcctcctaaaggacaaccctcagaaagcttggattcaaaacaagaaaacaggctgggcatggtggttcacacctgtaatcccaccactttggaaggttgagatgagaggatcacctgaggctaggagtttgagactagcctgggcaacataacaagaccatgtatctacaaaaggaaaaaaaaataggctggcatggtggcacatgcctgtagttccagctttgcagaaggctgaggcaggaggattgcttaagcccaggaattcagactgcagtgagccatgatcatgccactgcactctagcttgggtgacagagtgagaccttgtctcaaaaaaaaaaaaaaaaaaaaaagaaagaaaacaaaaacaaaacctgatctaccacattaggtctaagcaacctaagtagacataaagatgaaaaatctgaatttggcttcaaaattatttatttacaaaaatgaaattaaatgtgaaataatagcaaaacaaacaaaagtaccacaggcacatgttaagtgtcccagtactagagaaaggcttgataaattctggtatattacatgacatttctagggcaacttccacctcaaagactcaggccacggtttcagggtcattacaacaaagataaaggccagacacaacaaaggccttttgtctccaaaaggttgcagtgagccaagatcgcaccactgcactccagcctgggcgacagaacaacactccgtccttggccgggtgcggtggctcacgcctgtaatcccagcactttgggagcctgaggcgggcagatcacgaggtcaggagatcaagaccacggtgaaaccccatctctactaaaaatacaaaaaaattagccaggcgtggtggcagatgcctgtagtcccagctactccggaggctgaggcaggagaatggcatgaacccgggaggcggagcttgcagtgagccgagattaagctactgcactccagcctgggcgacagagcgagactccgtctcaaataaaataaaataaaataataacaataaaaatacaaaaattagcccaatgtggtggcgcgcatctgtaatcccagctactcgggaggctgaggcaggagaattgcttgaacctgggaggcggaggttgcagtgagcagagatcgtgccattgcactccaggctgggtgacaagagcaagactccgtctcaaaaaaaaaaaaaaaagcagcaatggcttcttgagctcccaaccccttggcacccagtgaccacagcaaactgggcacagagaccacagtaagcctgacactgaggcagaggactgtgcctttgggtacagcccacaatggaccccattcttcctggaagcccatagcaggatggaagtgaggaggccaggacattcctccaccccctcacacagatgtaaagggcacaggcagctcagggcagcagagccctccacaggaagaaagcatacggagccatttttatcttcagctattagaatcaaaaggagactctcttctccaaaataacagaggtaccatctgattaaatcaggtaatcaggtggcctacataggatatccctctctagtcagcaaagtccaactagaagggaaaaaggctcagggctctgaagagacaggggtccccacaggacctgtcaggttagggctggcactacaagcagaagaaccaacgtctcctgctaagatttctcccctacatgaaagaatctggtcactttctaactacttttaaaattggaaaaagcacatcctcagacttgcaaacacaatgttttaggaccatactgttgacccttctgacaaaatattattctattttctaggtaagcaaacgcaacagctggtagcacaaacccaaagcaggagagagttagacaggaatcctactgttatctatttgtgactttaatgaattctatttttaggtctttaataaagagcctctcttctactctcttcctaccaaatttctccactcaggcaattcaatcgttccaacactgctcaaaagtctaaaaatataagacacttctgggccgggtgtggtggctcacgcctgtaatcccaacactttgggaggctgaggcaggaggatccagcctgggcaacatagccaagaccacatcgctacaaaaaaatttaaaaattagctgggcacagtggcacgtgctagtagtcccagctactcaggaggctgaggtgggaggattgcttgaccctaggaggtcaagactgaagtgagctatgattatgccaccacactccaggtaggcaacagggcaagaccctgcctctcaaaaaacaaagaaaacacaatttcttcaatcatacctcacataagaggtagaacttactcattttctccaagacttagaatccagtccctgctcaagggctactcatcagactggtctccaatataaaaaatcctagacggcaacgtatccctgacctctggcagactggacacagaggtgacctacagtccaggcatggtggctcacgcctgtaatcccagcactttagaaggccgaggcaggcagatcatctgaggtcgcagtttgagaccagcctgaccaacatgaagaatccccatctctactaaaaatacaaaaattagccaggtgtggtggcgcatggtgtatcattccagctacttgggaggctgtggcaggagaatcacttgaatctgggaggcagaggttgcagtgagctgagatcacgccactgcactccagcctgggcaacaagactaaaactgtctcaaaagaaaaaaaaaaaaaaaaagatgacctaccagcccaagcaggagtgtttacaggacatttacagtaatcacatgcatgttttatggaaatattccatagtaaaatcagggcccagaaaatggatgttatcccaggttctgattaatagccaaataaaaaggaaatcttatttggaattccattattgactggatcatttttcttggcaaaagctagctagagaatcaatctatccctggagaacaactgagctaattaacagaggtgtttatgacaaccaaggcagaactggttcacttctgccctagacagccttgggaatcttaagtaaatctcccatcaacccctaggatgcctgggggggaaatcttcacagcacagtgaaaaggctaaacacagatacctacaaaatcaaaagaatttgattccaattccactactttgttttaatacatttacaaactcttccctcggtatccatgagggattggttccaggatatcaaaatccacaagtgctcaagtcccttatataaaatggtgtaatatttgcatcataataaggacaaaaacatgtaagcaatagaatctacgtcataattaagtttaagggaaggtactgtgactggatggacgtacacataagccagatttatgtttctctccacccaaacatctcagtggagtaaagaataacaaggcagcattgctgcaaacatgtctcgcctccccccatagggcagtttttctcctatctcagaattgaacaaatgtacaatcaggttttacacggagacattcagttcccaagggcaggcaggagacagtggccttcctctatctcaactgcaagcggctttcctcttttactaatccacctcagcatagaccctttacaggtgtcgggctgggggaaggtcaggtctttctcattccacgaggctatatttcagactatcacatggggagaaaccttggacaataccccgctttcaagagcagaggtccctgtggttttccgcaatgcactgtgtccccagtttattgagactagagaatagcgatgacttttaccaagtatactgcttgtaaacattttgttaacaaggcacgtcctgcacagccctggatcccttaaacatcttcctgtatactttaaacatccctggattacttataacacataatacaatgtaaatggtatgaaaatagttgttctaacatttaggaaatgatgacgatgataaaagtttattcatgtttcatacggacgcaaccatccttttttcccaaatattttcaatccatagttggaggaatccacagatgtggaacctatagatacagaaaactgtgtaccgattaggagaaagaactctataagaggtgcttgtttgtagattctcatacctcatatacaaaaacaacatctatagaaatgaagagtaaatgccaaaacaggggaatcaagctgggcactggctactgtttccctgaatacgacatatccttccaagtgcttcattcatccttgagctccccacaactggcacactcccctatacttagggtatccaagggccatgactgcctcagcaagaatgaatctgtggctcctcatgtccccaagggcagggaacactgagactaggtctccacatggctataaaaatcacaaatccatgcaagtcacagaaaagggactacagaaaacgtgcacaatacttaaaaataaaaatcagtacaaatctgccttacttgacattgataaatgtgcttctacaaaactgtaaatcacaattcactttttttttttttttttttgaggcagagtctcactctgtcgcccaggctggagtgcaatggcactatctcagctcactgcaagctctgccttccaggttcacgccattctcctgcctcggcctcccagagtagctgggactacaggcgcctaacactacgcccggctaattttttttttttttgtatttttagtagagacggggtttcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgctgccacgcctggctaattttttgtattttagtagagatggggtttcaccatgtgacccaggctggtctcgaactcctgagctcaggcagtccacccacctcagcctcccaaagtcctaggattataggcatgagccactgcactcggcctatttctttttttctttttttcttttttttttgaaagtcttgctctatggcccaggctagagtgcagtgttgtgattttggctcactgcaacctctgcctccggggttaaggcgattctcatgtctcagcctcccaagtagctaggactacaggcacgtgctaccacacccagctaatttttgtattttttttagtagagatggggtttcgccatcttggctaggctgggttcgaactcctgacctcaggtaagtgatcctcccgccttggcctcccaaagcgctgggatttccttttttgttttttttttgagacggagtctcgatctgtggcccaggctggagtgcagtggctctatctcaactcactgcaagctccgcctcccgggttcacgccattctcctgcctcagcctcctgagtagctgggactacaggtgcccaccaccacgcccggctaattttttgtatttttagtagagagggggtttcaccgtgttagccaggatgatctcgatctcctgacctcgtgatccgcccgcctcggcctcccaaactgctgggattacaggtgggagccaccgtgcccggcgataaagtttttaataatcaaatgccaggcctcctttcctatgcatcgacggcagtctaagtggtccctaagtggtccctccaaatcccaccatcctcaacactaaccagacacaagcaactctgtaggtcactataccaggtagtcaacaaggaatttaaatccttggttatgcttggtcttctggcccatgcattccagaatgtagctcctcccccatcatggcaggacatcccctctgtactaccttttcagtctctcttttctgatggctccttctccctccccacctctcctctgttagctgacttaactgccagaggtcctgaccccctccctcttcctgccactccaccagcaatatctttctaaacacaggtctgggtcacaccactctactgattaaaaggctccccagactcctgcaccccgcatacaaagttggaactcctgagcacaaggcaggcccagagctcgcacctgccaagctggaggactcccaagcactattttaggtgctcatgtacatgtggttccctgtgtccaggccttgatgtcccccactaattcctgctggccctgaaaaccacagctcaggaattccctctctcctcaggctactatgtgagcacgcttagcgggcagacactattaatcatgggttccccggtccccactgccccctaaactgaattccttaagggcagaagcagactcttttacatgggtccctaggatctaccacagaatttggcaggtagtgaatcaaaatatttgttcaaatgaataaatgcattttgcaaaatcaatttttaagaacagtgaggatttgcactgtgcctcttttaacaaaagcacatgtcagcacaagcttttatatcccatagggtcttcacatgatggatccaactccctactgaaatctgatttctccaaaatacaggacacaggccatgagctcttcttccttagttcacagcaaaaaaaacccacaaaagttcaactaaacttctccatactcaaactatggatttttatgcctccaaaatgtagtacggttgaattcttttttagaacaggaacattccaaaataatgtctctgaacttaactaagcatagaacctgataaaactgcaataccccatctacaccagactttgcaaaacacctgaaagcacatccagctctttatctggaattatgtcctataaacaccaccttcccttcacggagtctggcttctatgccaggagtcacttctactcgcttatttagggaagcagcaggctagaatcttaagttagactctgcgctatgaaggtgctgtcccaggctcttgcctcaaccagtcaaaacttcatcgtcaccattaaaactaattctgaagcaactcgatttacaaaaataagaacttttcaagttatagagattaaaggatgcattttaagttaccagttgagtttgtaggaaactaacttagaatttatggcaaaaagattccaagccgagacgacattttctgtggagacactatccaaatacactcgcaggtgaaccaggtctgccaaatacaaagtgaaaaggtagtaagtaaacaagcttccaaaggagctcaagtaaggatgacggaacccaccaaggctctgagcagctctgacagagcagtggcggcagcggtgcccttccctgcctctagcggggctcgactccccacagtcggaatccggcccaactgggccacaacccctattggaagccagggaggcggcccgcaggcggctcacgaccgcggccaaggcgcaggctccacgttcccgggagcgcgggccgagctaaggcctggcccatcgccgcggcgcgcggcccgggccttgcagccgaacgctccgagcctttgcctgcgggacccagagcaaaggggcggctccgcccgggcggcaccgcctcctcacccacaaggacgtccgcggccgtgtccccgccccgggccgaacagcgagcagcagcaggtgttccgcggaaggctcagccggcagcagggatgggggcccaagcagccaggcacagcggatagggcgggcggtgcactcacccagcgccggcgggaggaccgcggcaggtgttcgctcctcctggccccaggacgccgccaccgccgctccccggggattcggcgcgaagctgccgccgccgccaccgccaagcctaagaggcgcgagcgccgcgccgcagccttcgcgcgagcacgtaccgggcggtgagagggcgctgagcgcaagggcggggcgcgcggccggagcctagcaaccgcctgacacgcgagtgttgcagccaatccagcggccagctccgcgcggcgccgactggctgtccgcgcgccgccggcttctgcctgcgtcggccgctccgcagcgcgccgcacccgcgcgcaagccccgccccggcccgcacctctctgctcattggctagccactcccccgccctaaaagtcacgccccattatggaagcctcgcccccacggccagggaagtccgtcccgggacacaccccggcggtcggtcccggtcactcggagccttcagaaccagtagtgtgggggaggggctccccgcccaacttcaggcctttgggcctctaagactaatcaagggacagtcaggactgcgaactggcccagcaactggccacccgtcgactgcgttcagccctccttatttccttcgaatgcaaatcaaggggtatttctaagccatgagaacaatcaggaagcgttctctcaattgcaaaggatgaaagccttgctgcccggcccttacacggatgggagactgaggccagggacaggaggagcgggaagctagctcatctcctagagcctcgcccacagcaggctggggagtcggaaagcgcctcaggcctaaccctcgtcccctccccctgcctggaacactggaatccgacgcctgctctcctgcccaaaatagctctaactcgcaggcgctggtcactcactcctagtggcctgcattcttttggtgggggaagaaataagagaggggggttgctgcctggaacattcaaggggagggtcctaaggtagctctagctctccccaggacttaacctgcagccccccaccccaaaagccccagacttcacagttactgaaactgacagttaccggatgggtctgggaatgagacccgtggtgggctctgcttctcatccccacaccatgcgcaggatgggtccattccctccttggcctgtggccaggctggaattccaggcctgcactcttgacagcaagcacattctgaacacagaactggctgccaccagccatggtttcctccctggatcccggagagctctggggctccctggctttccctccctcctcaggagcgtctgggagatgcaagttgcagagataagaaaggaatgccccatctcccaaaaacatacctttttgcaattatctatacttcagtgtctcggctccaaacctcattcacagagacaagaaaaggaaggggctaggtgctgtgctcccgcctgtagtcccagcactatgggaggccgaggcaggtggatggatagcttgagctcaggagttcaagaccagcctgggcaacgtgtcgaaaccccgcctctacaaaaaaagtaccaaaaaaaaaaaattttgaccagccgcggtggctcacacctgtaatcccagcactttgggaggccaaggcgggtggatcacctgaggtcaggagtttgagaccagcctgaccaacaacgtgaaaccccgtctctactaaaaatacaaaaaatagccgggcatggtggcagacgcctgtagtcccagctactcgggaggcggagacaggagaatcacgtgaacccaggaggcagacgttgcagtgagccgagatcatgccactgaactccacctgggcaacagaacaagactctgtctcaaaaaataaaaattaaaaataaaattggccaagcggggtggcacatgacctgtgctcccagctacctgggaggctgaggtgggaggattgcttgagaccaggaggttgagactgcagtgagcgggtgttcacaccactgcactccagcctatgcaatagagggagaccctgtctccaaaaaaaaaaaagggggggctaaccatgcagaaaattatttatttgggtttctaagcaaaatatattctattctctcattcactcctttggctctgagagtgcaccacctaccccaccaccgtgcactgctttgcagccatacgttctgctgcatattttagtgtctgactatatagttttacatctcaggtctgtaattccagcactttgggaggccaaggagggtggatctcttgagcccatgattcaagaccagtctggactatatagtgagacaccatctctacaaaaaaattttttaaattagccaggtgcttgagctttggagattaaaactgcagtgagccatgatcacaccactgcactccagcctgggcaacagaatgagaccctgtctcaaaaaaaaagaaagaggccaggcgtggtggctcacgcctgtaatcccagcacttcgggaggccaaggcgggtggatcacgaggtcagaagatcgagacaatcctggctaacacggtgaaaccccgtctctactaaaaatacaaaaaaaattagccgggcgttgtggcatatgcctgtaatcctagctactcgggaggctgagacaggagaattgcttgaaccagggaggcggaggttgcagtgagccgagttcacaccactgcactccagcctgggcaacaagagggaaactctgtcccccctcaaaaaaaaaaacggcaggaggcttggctgaccagacctgaacaagccacttaggaggcctaaccacctcccaccagaacccaaccagcccccactggagtccataccaaagatgacacagaaatagctgtcttcatggtcccctagactggctaggggctgtaaagttaaggccttgttactctctttagttctaagagtcaaagcctttaccctcagtgggaactgcacagcctactctagagttcagcacaaggtccccagtaactcaccttccaaaccccagcagagcctaggccactccaggccaggtttggtgctcacaaccagttggagggcagaaccaaaaatgaggtctgggccaggctcagtggctcatacctgtaatcccagcactttgggaaactaaggcaggtggatcgtttgagctcagaagttcaagagctgtccatggccataccaccctgaatgcacccaagctcgtctgatctcagaagctaagcagggttgggcctggttagtacttggatgggagaagtttgagaccagactgcgcaacatgttagcaagacccccatctctacaaaaaattaaaaaattagcaaggcatatggcacccacctgtggtcccagatactcaggaggctgaggtggatcacttgagcctgggaggtggaggttgcagtgagctgcagtcatgccactgcactccagccaggtgacagagtaagatcctgactcaagaaaaaataaaaaggctgggcgcggtggctcatgcctgtaatcccaacactttgggaggctgaggtgggtggatcacgaggtcaggagttccagaccagcctgaccaatatggtgaaatcccttctctactaaaaatatgaaaattagccaggcgtggtggtacacacctgtaatcccagctactcaggaggctgaagcaggagaatcacttgaacccaggaggcagaggttgcagtgagctaagattgtaccacttcgctccagcctgggcaacagtgagactccgtctcaaaaaaaaaaaaagaaagaaagaaagaaaaaaaaaaatgaggcctgggttactcccaggagcagctactcaaaggacccatgtggtatggaatggggaggactgatcaagaggcaaagaatgaggatcttcgggcctgtcagtccccaactctcttgggccttcagcccccagtgtttcatccacatagaccctcaacctgaggattcaggaagattatctgattaaggtttgtctcctccactgaagtatgagcccttgatgctagagaccaacttgcttggccccacatagcaaccaccacctaacagcaagtggcagatagcagaggctcaattttggttttggaaggaaggaagcaagttgctactccaaaggtccatgccctgtgcaaagcccaaggcaaatgtcctagtgtttgcttggggctcatgtgacttaaactaagaccttgattttagttagaacaaatccaagggacattacgtggaccaaactttctgatggtcctaggattccagggctttttaccctggcgtgtttctgagaagctgagggtcaaggaccagtgctcatcctcagattcttcccaggggagggaggcctctgctgctgattcctctccaggcctgacagagaggggcaggggctggtgctggtcaagggtggaggctcctgacccaaatgccaggcccacaggcctgcctgaggcagagggctagcaagcagggccagccaagtcacggcaagggaggagtcccttttgtctggatttaacagaaggctgattgtttggcagctctggcagaaagaaaggactgataagttcatccgagataaactgccagtaggcgtgtttgtgggtcaccaccagccttcccagaagccagttcctccccttgcagggccctccactccagcacttccaccagacccctccatacatggctggcaaagagcattcctccagtcaactgggccacagcttccacacctgtccctctaggaacagagagtcctatggggcaggaaccccatagcaagggggactgttggttgaataaataaaagacacctttctttttttgagatggagtttcgctgttgttgcgaactcccaacctcaggtgatccgcctgcctcagcctcccaaagtgctgggattgcaggcgtgagtcaccgcacccggcctattctttttttttttttttgtgacaaagtttcgctcttgttccccaggctggagtgcgatggcgcaatctcggctcactgcaaccttcgcctcccgagttcaagcgattctcctgcctccacccccagagtagctgggattacaggcgcctgccatcacgcccagctaatttttgtatttttagttgagacggggtttcaccatgttagccagccaggctggtctcaaactcctgacctcaggtgatccatccgcctcggcctcccaaagtgctgggattataggcgtgagccaccgcgactggccttctttatttttattttatttatttattttttttaaacattctccctctgtcacccaggctggaatgtagtggcgcaatcttgactcactgcaacttctgcctcctgggctcaagtgattctcctgcctcagcctcctgagtagctgggaatacaggcgcagggcctgccaccatgcctggcaatttatttatttatttatttaatcttttttttttttttttgagaccgagtcttgctctgtcgcccaggctggagtgcagtggtgcgatctcggctcaccgcaagctccgcctcccgggttcacgccattatcctgcttcatcctcccgagtagctgagattacaggcgcccaccaccacgcccagctaattttttgtatttttagtggagacagggtttcaccgtgttagccaggatggtctcgatctcctgacctcgtgatccaccctcctctgcctctcaaagtgctgggattacaggcgtgagccaccgcgccgggccaatatttatttatttatttatttatttatttatttatttatttatttatttatttgagacgaaatctcactctgtggcccaggctggagttcagtggctccatctctgttcactgtaacctccgcctcccgggcccaagcgattctcctgcctcagccccctgagtagctgggattacaggcgcccgccaccacgcccggctaatgtttttttttttttgaggcggagtcttgctcagtcacccaggctggagggcagtggcgcgatctcggctcactgcaacctctgcctcccaggttcacgccattctcctgcctcagcctcctgagtagctgggactacaggcacccgccactatgcccagctaattttttttgtttttttgtatttttagtagagacgggatttcaccgtgttagccaggatggtctccatctcctgaccttgtgatcagcccatcttggcctcccaaagtgctgggattacaggcgtaaaccaccacgcccggcttctaatttttgtatttttactagagacggagtttcaccatgttagccaggctggtcttgaactcctgacctcaagtgatccgcccaccttggcctcccaaagtgcggggattacaggcatgagccactgcacctggcctcagcaggggcttattctttacatgtacacactggagaacgtgactgattagctaacattcaccttttattcctttattagttcacctcaagatggccggaggactgctctcattcatcccagaaatgtcgaggattccctacactagagatagggctctcagaggcccttcctgtctctgtcagcactcagcctagaggcaaaagctatattttcacctggatccaacactttccagtgtttcaggggcatactcatcagccatgacagcagggtcagagtcagtgtttgcttggtggcccatcaatgtctctgactaaagggccactgaggggtgcccaggccaatgagaaggacaggcccaaataagatctagccagctctgaaagag

SEQ ID NO: 15249 - DNA, 4450 bp, Human
tttcctcaatgtgttataataggtaattatagattttctgtattaaatgagtaaatattgtaaaacacctaggactgtgccagaacaatgataagcactcaataaatatgagctattttgaagggaacacaagggtttttcactcaacattactcctatttttaccccctagtaaaaagaaggtctttctcaaataatttgtgacttgctaaaaaagtcaacaaaaccctttaatgtggctgtgtttaagtgtgtgtgtgtgttgagtggggtggcatatgtaagatattcttgtgttgaaggacttgacacagttgacagctatcttacttttaaaagggctttctgtaaatgtttagagaataaatattttaggccttatgagccatagtcacaaataataggtaaagaaataagtgtgtcctaataatactttattggcaaaaacaggcagtgggccagatttggtccaaggtctacagtttgctgactgctactatgggcacagtgctcaaataatgagtatgtagctgggacaattgctccccagattcagtacgaatattaatatttgatctgcggcaggccatttaacctttctgaccaaagtttttcattcatgagttagaataaatgctccatgaagcttctttatgactctactaactcatagtatgcaagggcctacaaattgattccatgtagcaaaactatcactattctattaaggttcctaaactttcctctatttcttctaaataaaatcctgtttgcctatttaggttctcctctccaatttttcctgactgttgattttgagattttataatgcagagtaagaacgaagggttggtgtagaagggtaatgtcaacatacttgtcagggctggggaaaatagttttgtgaaggtttccaaagtaagaaataaggaaacatctataatatgtggggaaagcagaaggtaaaaaaagtagtaatgctctgccatatttactcctttcactgtgtttgaaaaatgaaaagagacaagtttattttgaaatcttttccagtttttattttttattgatacataatgtttgtccatatttatggggtatatgtgatattttgatacatgcatacatgtgtaatgatcaaattcaggtatttatgatattcatcacattgaacatttattcctttgcattgggaacattttaaatattcccttctagctattttgaaatatacaatatattgttgttaactacagtcaccttactgtgctattgaacactggaattcctatgttgtatgtttgtacccattaacctacctcttttcatctccctggccctccatacccttctcagcctctggtagcaatcattctattctctacctctataaggtacacttttttagcccccacatataagtgagaacacgcaatatttgtctgtctatgcctggcttatttcaattaacataatgacctccagttccatctatattggtgcaaatgacaggatttattattttttgatggttgaagattattgaattgctttttattgtgagctgtgtgtctttaatcagaacatcattctgagattgtaccacatgggtaatggcttgttagatattatatatttataatcattctagtatttccacagattgagtagtgaatatgtcagcgttattaggtcttcagtggccattattgcaatttttataagcctatttttggatgaagggcagaagcttcagataacaataatagttggcagcctggcactttcatacaaacttaaaaaacattttcatcttcctaagtgaggtaaaactaatgatgactcttgaacaaagacaatgtccttactcaaaacatcagtgatttcaagttgcatcctctttagctgagttgctgcattcttcaaataactcttaatgacatctcaatgatatcttattccattgacaatgatgacaggttaaaaatttctttaaatagctctctccggtccgtgcctccaagatgacaaagaaaagaaggaacaatggtcgtgccaaaaagggctgcggccacgtgcagcctattcgctgcactaactgtgcccgatgcatgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagtccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttttaaaaaaaaatttctttaaatagctgcgtatttttctggaactgtacatttctgtaaatctccaatcaccttatgactctggttcttactaaagttttattcctttaaaaaataccttgttagtcttgcagattgtttcccaagacttcagtaggcttataggaattctaggtagcttcaatatggacatttgtcctacagcaattagtaatagtccccatttccagtatcaactcttaaaactccttttcatagtaataagcctattcagcactttggacagtgcctaacacactcagtaagtatttgtggaatgagaagtaagtgaacagtcacagagaatgacttggacatatatctgcctgtaacaagtactatatttgctaaaattcccaatcacaaggaaactaaacaaaacctaacagaaccagccaatatagtaaagtctgtactccattgaagaattgaactttcaggttggggcaaatgggatactgtttactctcaggtttcatctaggtactattaccatcatgcttaaaactcaattgggttttgtgttgagtgtgggaataagacctttgaaaacctaattaacaaaaaattcttatctcactaatgtcaccttctatctgccaggattagacaatggtttttaagtgtctctgccattttcttttctctcagtttatctttggggttcttctccagagagaaagtcatgccactttagaagattcactcttaaactttcatttgacatggtgaaggtttataatgtactggatggtaataaaacactaggctcactattgttaccaacatgctactgttaactcattttcatgttctcttcttagaaataatgcaccattttcaaatgttaaacatattgtctattatagggcaaagttctctacagataatactactggaaactaaagtagacacagatattgaataggtgattcttcattcatgactgtatcctggtactgatttctataccaaggtatttataaaggtatgctgttttcatttcttcttcaactgattcatattattattgttataaatatcacatgcagtaaacatattaatggtaaataattgaatattcacagattgaggaacagctactatattactcttatgcttcatggacaagggaagtgtattcataaagtgaataaataagatgtgatttacaaattaagtgtaatagttattctattcacttataacatatgaaaaagttatgacttgaaaagttattctattcacttataacacatgaaaaagttatgacttgaaaatatgacttgaaaatttgtctatttaggacaaatccacagttgactgaaatagacaatggatctgaaaccactatcatttaagatatacaaacttaataaacatctattgtgttcatgttatgtgcaatgtgctttaaatataaagatgattaatagtgtagaaatttagaaagacaaataaaaaattatgatcatcaaccataccaataatttcatcatgtgtaaatgttctaaacacacaaattaaaatacagaaattttcagattttacttaaaaaaacccaatactctattatatgctattgacaagaaacctgctgtaaatacatggacatagctaggttcaaatgaaaagtacaaaagaaactaatgcagtacgaaagaaaatgcaaacaccaatcaaaaaaagcagaaacggctatactaaaataaagtaggcttcagaacagggatatggagggacattgcatagtgataaatgggctaatcaacctagaacacataacaatcttaaatatatatacatctaacaacggaacttccaaatactagaaacacaaactaatagaactaaaaggagaattaagcaaatccataattatagttagaggcttcaaaattctttgctcagcaattgataaaacaattaaactgaaaatcagtaatgacacaggaaatacgaataacactagta

SEQ ID NO: 15250 - DNA, 21679 bp, Human
attttttatgataccatatgcctttggaacatgaatctggtgcttagctttatgatttcaggccaccctcttaatttcctttaacctcagttcactaatctgtaaaacagataatgtgttagtaaatacaaaccttatatacttgtagaaacaaatggaaatacacataaagggccaagtataatgctaccactgcttatggacccagattcttgtacagagaaatgtttttccttcacaggcccaatgaactgggatggaaccccatgagctacctacatgttggcttggttgtcagtcatttttccaaggattaattgaaatctacacagacatcatctttgcacatagggaatttactcccctggctacttgacaggttcagctaattgggctctcctctctgccctacaagcctgcaggcatttgagctccaggtctgctggtaggagtgaccctgacgctttcctatctcccagcacccttcccctcatgagctccctaactgcccatttcctctctctccagagtctattgggtctgttctgcctacaccttaagaaaagagctccactcttgcactgttggcgcaaattgttatttagctttttttttttttcattatttaacttttctcatgttggtcttgagggcagacattgtctcttctctgtatttcctgtggtgataacagaatcctatagtaagcacccagtagattacaattgcttttaccaggatagggctttatgtgtatcaaggttggttttttttttttttttttagacagagtctcactctgtcacccaggctggagtgcggtggtgtgatctcggctcactgcaacctctgcctcccaggttcaagcgattcttgtgcctcagcctcctgagtagctgggattacaggggcacgccaccacacctgggtaatttttgtataaggttcttttgtaagttttaaaaaatcttcacagcagtccactgaagtagacagagcattcttttagtatgcccttttagtcacagtctttctagcgcagttggagaaactaaggcctacacataagcaacatgcccattaattaattttttatttctataggatagacatttaaaagagtaactctgtcccaggggctaggaaatagagctgacaggcataatcccatcccttaaggatgaggcagatatttgaacaaacaattgtatacagcaagtgaagttttaggacagagaagtgttgaaagtgtttaactttatttggggaagatcagtgaaagattcaaagagaaagaattgctggcattggaccttcaaggacttcaaggtgcagaaggggtggaagggagggcatcccaggcagaagaaatggcacataccaaagcccagaggagtgaacagacaggcactttgggaggccctgtagcatcagcatggctggcaggagatgtataggagatagaggggaaagatggctatgactaccatttgtaagaccctaagacttccagaagcaggagactaaaagggccctttatagttccttcctcttcattcagtctgcgcatcactagtacttctttccagagtcatacacattccataaacgtcctttaagctctggatgggctcgctattgtccttgcttttttgcaccccagcttgcctgcacagaggtttgtcatctccttttcatgctgaaagaaaacagatttatcacaggaggaaactgcgacatgatagcttggaggaataaaggttaccaggtgaaacgacatctgcgtcatttattctctgtggcatgaggtagctgagaaggaataaagtccgtctgtgaccaaacacctgtgtttctgtctagctggcagggtcaccggaggggagctttaaattgctctttaaatgagtcagacctgttcccccggagagaaggctggtgcagcttgagctctgtgggcaagtctgactgggcctttctcacttttgcctgtgtttgccttgcagctgtgtaaatgagtatggaagattatgatttcctgttcaaaattgttttaattggcaacgctggtgtggggaagacgtgcctcgtccgaagattcactcaggtaagggaactcgtaagggaactcgtaagcccagggttgggtttgtcagtctagcctgaggggttgggggaatctgtcgagatggatgaccagtttcaatgccagggtcttagctgtgagttcctgatgcaccctttgaaagctgcatctgctttgtagccaagacaaggggtttttaaaccacctcacgggagcatggccctgggagtctccaccaaccctcccatgcctcttcttgcttcctttaatgacaaaggcaagtggttttgctgtcagtgtgcagtatcaaaactaaattattggataaaaggaagttactaattaataatccccaggtggaaacaaatgaatctggacgtcaaactgaacctaaattttttaaaactctaatacaaattaaaccaatcaaactctgcctatgcccccttacatcctcccaggaaacttgagtgaatcattttcatttaggaccaaataggccaattttctaaacctcttcagtaggaatgaaatgaaaatagtgaagaattatctgaactgaattgaatggcctctctgggttgaattcaattcttatcatatgatctaagtacaggttccctttgggactgcccttttgagaatcactgctggagattatatactgcttttatatagaaatcattccaaagttgaccttttttgtgtgttttcccctgaaaaatatgaatgataccctttgtaggaccattacatacatatcttgaattttcataaagtacttgttcagcaagttggaacttgctcctctatctaaggcataggataacctggtgctgtggaaagagcactggcttgggagttgagacatgggtcttagtcctggttctgcccctggcttgctctgtgagcctgggtaagttacctccctttcctgggactgcctgttgcacatcaggggctgggtgagctccaaggccccttccagctctgacagtctgtggttttgcggaaaacgaaagagacagattgaataacaaatagctagagggcccagagtcactttggaaatgtcagggtttttcccatgataagtgaatagaacccatgctttttactaagccgtggcctggtgaaatcaaaagtaacaagctaataggcatctgggctcagtcaactgccatggagatatattggaaactccagctggttttacttctacctaacattagtcatattttctgcttttgacaaaaggataagactgcagagatgtagtaaagttttcagtccctttatcaaaagtttccttgaccttgtcttagtattgaaaggtcacttagagattattcaacccacctctctcactttatagatgaaaggtcagatctagaggggctaaatgcctgcttaggatcttatattgtgagattagatagagtggcaaggctaggattagaacccgggttccaggttcttagcctgataatttgtctcctatacattctaacttctgagaccattctctttaaaagcacaaactctgtcattagatgtgaaaatgtctccattttcaacagtaattttttgccaacaagctcttttttcttctttcttatttgtcttttatgtctacgttttacccctcccagctcctcaactccaccataaactcatatgtcagaggcaagattatgtttgtttttgttatttagcagacagttaaaatgaactggatctagctgttttttaggcacagaggttgggaacaaaatggtaggtgaaacattgggaagaattcgtttaacttcttggcatttgttgaggtgcaaaacatctggagctataaacttgaagcttgacagcttttgtatctgagccaagccaaaatagaagaaaattgattcaatatttgaaagtaaagttatgaatgtttatatttacatcttttgcaaacatgcagtagaacattttcttttggtttgaagttcagtcttttaagctaaaactttaaataattcttaattaaagatatctgagtcatagttgccagaactaataacgtccattttactttaatttctggaaattctggaatataagtgaagagggaagagaaactgggtgaagagttctttcttgacagaatttcttgctactcccaactccctccctaagcgtataggaaacattatgtaatagtaaattgcataaattatacttgtacctttgttaaaatctcatctttctggttaagtttccagtttgaagtaaagcattttgtttatttgttttaaaatggcttacatcagcctcaaactcattgaatttgaggcccagagagggtgagtggtttgtttgaggttacacagagatcctaaggctgctgcctcctggtttagtgctgtttctaccctactgtctccttgatgacttaattttcttagattatcttcccagtgtctttggctttgatcccatgtaattacacatgcatggtacattgtactgaggaaaacagtgatcaccctggggcaaaggaaaattcagaagcttcaggagatccaaaaagacagatcccaaaactgtcttattcccgcttctcatgctgagttcttatttgttttttcatattgttgcccattcccgtggctgtccatgctcaagactgataactagttttaagtatccttgattttatcttttagaaagaacctatccattttgccctgacccttccaattctgatctcatccctgtggtcgcatgcccttcaatcttatcttcgtgtctgatttttctttttcattcttaaaatcaggttcccctgccctttctcaattttctccttcacctgtctttatctccttttctctgtcctcctgtctctttcctcttctttcagcatttctctctcccactttctccctcctttctctttccctcaagacatacatacagagttgcacagggctcccttgagagtaaccagagttctcttttctaccagtcacctcagctgaaggaaggactccggtgatgggtgttgctgggggagaggagaaaatttcatttaatggaaatatttgcttagctgttcttttctattatttcttcttcagggtcttttccccccaggtcaaggagccacaattggagttgattttatgattaagacagtggagattaatggtgaaaaagtaaaggtaaggtgctaaatattcactaaggttgtcaggtgctatgtgagaggttaggggaagtactgctttcataaccatttattaaatctcctaattgaaacccacatggaaacaatgcactcagccataatggcttatttccagagttcttctagtcttttttatgggggaaggaaggaattttggatgatgtgtttacagattagaagacagaaaatggctaaggcaagtttgtcctgtctcctgtcatgtcacaagtgacataaagataaggaagaaatttctttttggatctcttgagctgggccaataagcaggtgctacctcctctaaacagcagccccatgaaagagcctcccgatttctacatttcattatgaatcacttatttaaattatcctgtctcctctcatatccttgtctctaaaaaggaaagacactaaatgaggagtatgggaaaggatacatgctctctagcccctgcttcctgcccctccagcctttgtggcttctggatgatttggtacttggaagaagtatggtgtgtccaggaacaggacaaaggagagaatgtttattgagtacctacaatctgtcagtgcctctgctgggtgcttttacatatgttatatttagtttagtccttactgtaaacctgtggggtaagtggtattatcctcgttttactggcttcagagaggttaaataacttacttatccatggctacacatagataagtataggaagggggacaggcaggatttgaacccatttcaccaaccagtacaccccactgcctttctggggtctcctctgccatgaaagaagaagggaagaaaggcacactaggcctatcacctggagcaaggaaaggaggaaggtgatggaaagaaatgtgaagggagactaaatcacctggaaggaggataaatatactgatgtttggcactgtgctctacctgccgtcagagttactgaagttccacagttggctcttcagagctgggttttatggaaagaagtgatagccaaggcctggtacagtggctcacgcctataatcccaatactttgggaggccaggagttgaagacatagcgagactccatgtcttcaaaagataaaaaattgtctggtcatggtggcatgcgcctgtagtcccagctactcgggaagctgagtgagagcattgtttgagcctgggaagttgagtctgcagtgagccatgattgtgccattgcactccagcctgggtgacagaacgagaccgtgtgtgtgtgtgtgtgtgtgtgtgtgtgtgtgtgtgtgtgttggtgacagagagagagaaagagagagagaaggctgggggagggatggaaagaaggaaggaaaggaaggatagcccagctatcagcagcacaatgaaaactggcattttagagttctaccttgattcccaacctaagcatcctatgtttgggtccatttatttgcatccttctcccatacgtacatgctctccttcctttgagtgccttgggaagagcagagaagctccataatgctcttcagcattttctagatacttgccatcacagagaagtgtttaggaggaggtccttgaatgggggccagaagctctctcagtgtctcttccagccctgactccttaaaatagctcatactgcagagacatccacaccaaatacagcagtgaatggggagctggagcactggaagataaaagcagggtatgaaatccacataaatgctaactaaaaagtgaacaaaaatagtgtggggggtgggaagaaggagctaggctgtggggacaggaaagagagacaggagtgtgctcaggaggcattgatgggaggagccttttgtagctttctgttgtcctagtggaggggaggtagttacccaaggagttgggtaaagataactactatttcatgcattttacttccagatatttgggttttccattcatatatatatgagttcatttatttgatttagtgcctactaccttccaggcactggccataaataagggtgaataaggaatggtccctgctgttaaagaacaggcttatttttctttcctgaattcccaggcataaatattccatttattctactttctgcaaaccttattttaaaaagtgcttattacactgcaaaaattgatatttttataacatctgactccaccataaggccacaggctccccaagagcaaggtttgtgtcttactcatatttgtattcacagcacactttctatccccagtacttcttcaggcttctagaactttatctataaaaagtgacagttggctcatctcccaaatccagtccaaatcaacttgcctgtgattctttcaagcccaatatataaaataaagatacagggtggccctcttcaaccacatgaatttaagggcctcattaacatgtaggcatatgaggaacaacttctttaatcctttcttagaagagggcagaactgcatagttgtcttattgtcatcttttttttttttttttttttttttgagaaagggtcttgctctgttgcctaggctggagtgcagtggtgcaatcacagctcactgcagcctcgacctcctaggctcaagtgatcctctcacctcagcctcccaagtagctgggactacaggtgtgtgccaccatgcccagctattcatttttatttttattttttgtagagatggggtctcactatgttgccatgttgatcactcctgggctgaagtaatccttctgcctcagcctcccacagtgctgggattacaggcatgagataccacatccagcctgtcatccttcttctttaacatttactgagtatcttttctcagtgatgttaaagtgtctttttgctagtagtttgcgggctttcccagagcctcataaagtcagtggataagagaatccaccagtgattcgtatggcatcacccgcttggtgagtggcaggaccactctcctgacaccctcatcagtgtcctctacaagtatcattttttccaggatggctcccaggattgaaggcagggaatccaaggtattagatttttgtagctattaaggccaagtaagcgccaaatcagtaaaaacaaaattaatgaagaggcccttctcttaaaagggtctgcattatgaaggtgacctctggtagaaaatataattaaaacatatatagaccactgaactgtatgcttaaaagtggttaaaatgataaattttatgtatgttttagcagaataaaaaaaatggaaaaaacacagaactttctcatatatattttagtctattataaattaatgagtaataagaaaaactctaagctcaatttaaaccattttagccttaagagataaatcataatagaaatagaagatttgctgtatctctttccagtcagatctatgttgatagataggagagtcatgaaagtatttatatgtatttgtttcttcaaccatctgtccatccattcattcctccatcctgtgttgtagtaaatgttttgtgccaagcactgtggtggtaaagcatccctgccccttaggaacttactatcatctagctccatctgtgaaatcttctttaataccctactaatctgttaagtagaattgaccagttcctcccttgtgattccacaatcctttgttcatttagttagccatcattcaaatgtttctaccacgtgctgtgtgctgtgttaggaaggtactgggggtgtaaggtcaaataaaagacagcctttgctctcaaagaactcagtagtagagtagtaaaccaatgattgcagtacattattatgacggtgaggcaatggagtttaagtagtggtgcagagaagagagtagacaaacaatgtagccacatgctgaaggtgagagtggttagaaagcccgtggctacagtattgaaaacatattgacaggcatgagactaacagcaggagacgctctcttcctttttaatagaacatcttgtattctgctatagttaattaactgtgtgtgtcctttctatagactgtgagctgtttgaaatcagcgttgattttattcatctttatatcctccctgtgttttattcatctttatatactccatgtgcctagcacagtaccttgcatatattaatgtcctatagatgccgaaaggcgcaaatgaattgcagagaatggtgaaaccaagttgagtgacaaaggcagtagaatatgaatatcctcaataatcaactgtcagctagaaacaggcagccccctatgagaaggtaacatatcttggcatgctcatacaatcgctgttctagaaaatatttcagtgactttaaccctcgaagctgttctcaagatgtgggaacacactgatttctaatactgaacagttcctaaatcgcaatcacaagtgttttaggggctcagtgcagctttaaaacaatagcccattattctaagacacatcctggcagaggggaaccgtgtccctaggtttgaggcagagaagagaaatagcctttgtcccagcaaaaaccgtaacatctgtacagtggcctttagcatacacaggctttcatgtgtatcatcgaagagcagctgcaactgcagatcaaaggagagcctttgtgtgctgctgattcatggcagggactacgggtcactcagcagtctctttagctaagctagtatgagcagagggtgacagcaatggattcatcctctttggatacagatgcacattttagttagtctttggtggcaacagcagcatgggagcatggaatgagtcctcaactggaaatagaaggcctggatgccatgtcctagctttgtgaataaccagttagttaagggacagtttccattaatacggggaggtgtacacttgcctacctcactggattgttgtaaagattaaatgagaccatcagtaaatatttgagcacctcctatttgccaagtgctctatttgctctaaatggaccctgacgtctccctcatgaagctttcagtttagtgggaaagatggctattaaacaaattattacaaataaatgattcaggcatgtcaggtgccatgagggagaatgacaggatgtatcgcaagagagactgtgtggggtgggggggtggggaacctagcctaatctgaaggttctggaaagccttcctgaggaagcaatcttatgtccctggacatgaatacacctgtgacctgtgaaattcgtgcaattagaaggaaagattattgtttttgttgatgttcttatttctcaaggccttgtgttttgttctacacttagcagccaccctggagaataattcgttttcagtagttgtctactctgtgcagggaaattgacaagtattgtcttcttctttgttattagaattattagttattaggacttagaactggtagataactgcagaaaaagtgaaccttcagcaggttgtgtgttattaaccactttttataaagaaataatcaaagcccaaagagattaagtgacttggccaaggtcatagaacttaagagacctgaaggaaaattatattgttgtctgccatggcatgattcctgttttctttaacaaagataataccttaatacatccatttgaattttgaactggaaaagtggtgaggttggctctccctccagttgctgattaaatgccaacagtcacagcttgccctgtatcatgccttttgtaatatggcattgtgagtaagaacggggactctgggaccacaatgcctggttgaattggttctgggacatattggctatgagatgctgaacaagttaattaatcttactgtgcctcagtttattcatgcaagaaatgggtattatgatagtatctacctcatagggttattgtgaggaataagtgagttgccacaggtaaaatgcttagaatagagcttggcacataataaatgcttgacgaatttcctatatgtatttttttaagaatgaaaaggaaactcttaacaaagaaaaaacaaaacaaaacaaaataagcccctctccctaaccagaaacacacccaacagatttttttttttttaattttcagtgcttttttttttttttttttttttttttttagggcagaaaataaccatgaaattgtttgggtaaaggtgtacccattttcaaaccaaagcaaggcaaagctttttttttctttttttctccaacctgatccttcttcacctgattcttatcttatgcctttacagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggtaagtaagggctaacgaggagggaaattgatttgtgggcattagaggatttataatcacataaagcttatacattggtgccttccaagaatatagtctttagctaataattcatgcagtcaaccttcagttcttctgcaattgaagagaaaatgaaataggtcctatcccatggtgacagtttagaaaaataaagtagaaaacattttctatcaatgtaggctctagggaagaagttggatggccatgaaagttatgtgagctgctaaaaatttaaaaagtctaattacaagatgaaaggaatggctgttctagaagaaaaatgtatcttttaagttgatatggaattcattattgaagcaattgtttattgcctaaaaggtggattttggtaattttttttcccttcctaacatttaggctgatttgagaaattctgtgtttcagaaagaatctgctaagggcaatgctgtagtttgtttcatcttgtaggagaataaaacctctatttagtatggggggaaagcacaaaacaacccttgattttctatcatgactgatatatgcattgaaatggaccaggtcattaaaaacttctctgtttgtagtggaaaagtgttagtaaccatttgatcattaacatattttcttcctagaaaggaacgttcctatatagtctagcaatacctgaattagggaaatttgagtagagatccttagaagcattgttaagttacaaattatggttaataataagctcagtaaacactttagaatagtgttataattggtatatatgtgccaggaatgatacgaggaactttatgtgtcatgatccctgatttacagatcaggaaaccacggctcaaagaggtgaagttcttttcccaaggtcacatagcatgtaagatcaactccaagccctgtagttgtccagctgtaatatgttacgttgtaacaaattgctggacttttccttcaggctgctggatgaagcatctgtgtttctatgagctagtgctccctgtaaaacccttttggacaatgttgaacctttgccataaagcatttgagaggtctgcatttgtaccttctgttttacagaaagcctttgggaacttgagtcaaagcattactacttgggattttatctaaggaaggtaaatgaagatttgaggggagacagttagttcaatatgaaagaggaattggcttaaaacacaattttactatggaaaatttcagacataaacaagagtagagaaacagtatagtgaatccccttctacacatctcccagctttcacagttaccaactcatgaccaatcttattttctcttccctagcaatgctgtccaccttctccctcagattattttgaagcaaatctcagaggttgtattaattcatgtttcaatatctgtgtatatctctaatagatttttaaaaagaaaacctaacctcagtggcatttttacacctaaaatatgttaacaattccttagtatccttaaaaacttagacagtgttcaaatttccctgatcgactcatgattttttttcgtttgtttgttcaaattaagatccaaataaggtccagaagccgggcatggtggctcacacctgtaatctcagtgttctgggaagctgaggcaggaggattgcttgagcccagcagttctgaccagcctgggcaatgtagcgagattagccaggcatgatggcatctacctgtggtcccagctactcaggaagctgaagcaggaggatcacctgagcccagaagttgaaggctgcagggagctatgatcacaccactgcattcagcctgggtgacagagccagactctttaaaaaaaaaaaaaaaaaaagccaagtaaggtccatatgttgtaattgacagctacatcttttcatccttttttatgaagtttccactctcattttttttctctcttagaattttttgctaatgcatttgtttgacctataggctttacaagtctaaattttgttttatcgccccaaggtgtcatttgatatcacctccatcacctatatttcttgcagatttatagataagtctagaggcctgatgagagtcaggatttttttggttttctttttagacaaaacactacatatatcatactctgaggggtagttctcatagaacaggcaggaagaatgcttgattcttttttgttcaccacttttcaaggtaataagctggttctccagtatcttctaaaagttaactattgacatctgtttatatttgtaatattattataaatttatagatttaaatagatttgatgggctgggcatggtgactcatgcctgtaatcccaacactttgggaggctgaggcgggtggatcacttgaggtcgggagtttgagaccagcctgggcaacatggtgaaaccccatctctactaaaatatacaaaaaattagccaagcatgcctgtaatcccagcgggaggccaaggcaggagaatctcttgaacctgggagacacaggatacagtgagccgagattgcaccactgcactccagcctgggcaacagagcgagactctgtctcaaaaactaactaaataagtaaatttgatgtatttcagtcccttgcaattattattattgatgctcccattgttccgactttgccagtgggagcttcttcaaatgggctcctgagtccttttgacatgaccccaggaatgttggataatttttttgctttctggtatgacaagtgttccagccacaacttgtgcatttcctgccccagacctggaattagccatttcttcaagaagtgctttcttttcaatgggaagtcgtatttagaggccacaaccgaggtgttaggagccctcctgatgggccattgtttttaggcctttcagtggacagagcttgtgtgtatgtgtgcatgtgtgtggtggattctgtagtatcctcaagagagttttcctattaggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaatttgaggtaggtggaaaactttttaaagataaaatacatcatgaattattcatactgatacttctatttataattcaggactgcagaaattttacttaaccacattaattttatatttatatttcctttttcctatgccaaaagtcccagttcccaatggtaccagcataattactcatttgctttatcccataatacacagatagcaacctcagaataataataccaacagtaccaccaaaaagatgattactgaaacagttcaagattgtttccttcaattctttttgtccttaggctatataccactggggttgcactgttaaattactgtatcttaagcaccttgaaatagttactctgttggcccggctcggtggctcaattgcgtgtaatcccagcacttctggaggccgaggcaggtggatcgcttaagctcacaagttcaagaccagcctggacgtggcgaaactctgtctctgcaaaaaataaaaaaaaaaaattagctgggcatggtagtgcctgcctgtagtcccagctacttgggaggctgaggtgggagaagatggcttgagcccaggaggtggagttgcagcaagtcaggatcgcgccactgccctccagcctgggcaatagagccagaccttgtctcagttaaaagaaaaaaagggttacggtctgtgtggttattccacacatgatgaacatgttcatttgtttaattttgctctcagtttttagggattgctttttaaatttaattttgaaattaattgtataattatataaagcatttttaagttcctaaagtaaaatctacaaaacaaagtatattcagagaggtctggtttctattcctttcacctcaaccctgttcctttcataggtaaccattttcttttaaattaagattttggtctagtcttctattaaaaaaataaataaaatgtgtgtataatatatgtattcatatccttccctttttcttggatagacagttgcgtattgtatatgctttttttttctgcttcgctttttttttggttaacagtatatcccagtgtttccattacatggcagtatatagaaatactcctaattgatttttatggcagcaaatactccattgggtggatgtgccatactttattcagtcagtgccctaccgatggacatttgggttgtctccagttcttgccattatgaatggcactcattttttatttatttattttttttgagacagagtctcactctgtcacccaagctagagtgcagtggcatgatctcgactcactgcaacctctgcctctggggttcaagcgattcttctgcctcagcctcccaagtagctgggactacaggtgcgtgccaccacacctggctaatttttgtatttttagtagagacggggtttcaccatattggccaggctagtctcgaactcctgacctggtgatccacccgccttggcctcctaaagtgctgggattacaggtgtgagccactgcgcccagctggcactcatattttaaagtaaacatttcagtaatcacagtcacatttgttttgttttactcgcccatctgtctggcttgacttcagatatggagttgaattttgatgcttctcagcctgcaaaaagtcaaatgctgattctttatttgattttactactgttataggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttaccttcagacgcttaaccatatgttctttcttttttctttctcttttcctctctatttttctggtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaacttttttcagtttccagtgaaaatgcatgatactcatgtcatggagtcaggcttgggaaaatctatgaaataatagtttgctgataatgatattttcttatggctttgtatagactacatcctcaaaggattttgtgcttctttgcccatagaaggctttttctccctttgtgtgcttttattaaatctgttgaattatattaatattttttgaatttacagggccaattatcttttttgatggattacttagattaggccatgggttcttcctggcctttctttttctcggtcttttaatcatttcacgtttttatctctccctgagtaaagtggcaagaaaactaaaaatgaaagttaaatgggttgatttgacaatgtgtcaagttctgatttagagtttataaggaaggtagaaacgattggccaaaataagatatttggatgaggattatttaagccgtttagatttggccagagacgccagatttagcaaaggactgggttcttatcttctttcattcatgaatatatgccttgggaggacactggtgattcccacagaattaggccaatgatttgccacattaccctttaagctagcccataattccaccagatcccacaccaagtttcagttcatgactcatactgaataaacgtcagttgtaaatgatgtttgaattggtcttcctactaaagtgaaacatcttcttttaagccaagccacatgaatgaaatagcacaatcagaaaaaaatctttttttttttttttgcatatcaaaccaatggccttctccactaagccagcaactaaaggtattcagaaaacaagttaatcaaggtgggcagaactttttgaactgtgaggaaatgttcctaagtttagatttattacctgtcatttagggcaaaaatctaatgtcttttttatttcttaatcttgtagaactctgtatttcatagtaatgagtacttagggatcattgctctattagcctctgggagagatcttctagagtttgccattcctttttttccaaaattttttgttgttgttgttgttgttttaactgcaactggttacttttctcaaccatggtcctgacatgtttatactatgatacttttgagacttcgctaaagaattaaaagctgtgaaacaacatttgcttctcatccttcagacaaaatgtgttccatttaagcagcatggttaaacactaattttgggataagggagggatatgttttctttactttctttttggatttcatttctgtggcatgagcctatttgcgtttggaaggaaagatgccttcctttacattcttcacactggtaattttttcatactgaattaagaaattatcatcccttcaaaacacatattaatatagcaacattagagtaagggagatggcatttcatctcctctcctcagtcccttgatgttggaatgttattatcatttccaggagccatactttgaaattaaaaacaaattgaggcattaccagtctgatgaaggaattttaaatgcaagccatttaaagaatacttgaaggatttggggagacttaggttaggaaaaagaggggaatacaa

SEQ ID NO: 15251 - DNA, 6479 bp, Human
tctagaatttacatgcaagggaagcgcagaccaaaatttgaataaaacagatcattgtttggggtttgggcttgagagtctatttgcaaggatggatgaaacggatttacaagcatgtaaggaggagaaggacagtccaattggcagagataggttttcataatcagggttaggcgattgcaatcatgacagctgtttgatagcttttggcaccaaaatatattgaccagctgagatatcattaatgcttaacaattttatccttatgagcatatcttggccagctaggttgcctttgaccaccaaagggtatgataatatattccaatgtaaatgccatgtgtgcatctgtgtaactcacattcatgttgatgtgttacaaaatatacactaaatataaatgcctttgcttctttggaatgtcatgttagatggtgtgattaaagaggaatagaattaaaatataaattgatttatttaaaaaaaacagttattctgggaaatgtgtgtatgtgtgtgcactaaaagtaaaagaaacctaattattaaaataatttttaggaacaaaaatttgaataacttaatagaaaaagcagtctggctgggaaaaggcagttctgtaccatatatgtgtaaaaattaacacagacaggagagaggtgattgagagacttaaacagaaggctgcttacagatcagaagaaacccttggtccagtgtcataagtctatgaagacattccagaaatgcttccagctaggttatctcctgatagtacctttaaattatgagacaaaacaagtaagggaaaaatataagaacatttttcagaatgcttcatatactaaaatttaatgcattaaaatatccagaatattttcagaacctgtaattttggtacttgctgaataaaatttataatacaaagttttattaaatagcaaaaaacagtcattcaaacatagaaaccttactacctaattcaaaatgcatgtgagtaaataattttgcctgaagattgaatttttgggggttactttcattagcatctctggattgatctctaaacctggtagtagtcatgtatttttccttcctcataatataggtacttgtttggctaccagtgattgttcctcttccctatataaactactaaaattaacatcactgttccttcttcaaagtcagagacctgacattaagtactttatatgaggagtattgttaaaaaggaggcaaccaagcaagttactccttacatctgtggaaagacttaatcatcagatagaagtcaagtaaaacactgtttgggttgcaaaagtaactataagtatgagaatctttcctacaaatatttcacgtagcctgcctccctgcctgcctgcgtgcctgcctgcctgcctgcctgcctgcctgccttccttccttccttccttccttccttccttccttccttccttccttccttccttccttctttccttccttccttccttccttcctccctctctatcttgcttctttgcttgctggtgatttgacacacattaaagaagcccatttttatggtctcgcttatttcttttccttctttagatggagggcttttacccaaacttggagaaaatgcatcacggaatattagtagtggaaaggattttagcaatcatctaggtcgggtccgtcatttatagatgaaaatctttagatggagaaaggttttacaacttaacattctacggctagttagtggcagagctgagacaaggtctcaaacgtgtaccaataactagactaatatcatttcctctatcgttctaatttaaaactacgtttcaagtcacctttccctgaaaatgttatgtacccacttaacattttcagactgaataatcagcatctttgctgttgtggttttgcttttcaaaggtaatagtgggatagctcttcaagctgaaactcctgggataaaggaatcctgggagccagcatgtaggatgtgtccatcttcatgctccgtcttcaccttgcactggcactcctccaccagcatcaccaccttgatcacggaggaaagttcagtgcagttcagtggcaagtgcatcgtggtgaacttggcaggcaaacagtgagagcaggaggtatgggagtgctgcgcggctccaggaaaatgaacagacccgcatttcccaaagcaaaggttgttctgaacaactactttttcacagccttcgtgggttatagtctaaaaagcaaacacatttccattacgttattttgaattatttctttaacacacataatgcagaagctatggactgtaaatctgaggataatttaaaaatttcaaagctttccaattttggatacaatttgcaatatgcaagtgatggtatctataagggcacagaaccacctcaattaaattttctttattgagtaaattattaaacagcctttagggaatccctaagttaacataaaaaatattttactctacattattcgtgcaaaaccttaagcaattttgtctaattggatgtgagcgattgaaaaattctaatggtaattatcttacataagtaatgtgccttacttttttattcctcacagggctttgtgcatagtaggctcccaatacatatttgttacattgatcgtagaatagatcagaacattctaggtttaattctatcctattctgcaagacctgtagtacattcaagtctatgaagttgtatgcaagcagagttacaatgcatatgcctgcaaatcattgtatattacatcacctttacctctcataactccaagcacctagctttatatgcctttcaaaatatgtaagagtcaaacatcttagttttaatttaattagcaatagaattcaaaagaagaatttcaaaagaaatttgattgcctgattcttaggggtaattttctaattgcacatggccaacagagtagtcattattatttgataattgacttgccattgctacatatccttgccttttcaggcagaatacttaactgccttgaacagtcaattgccctattctattgcttgcttaattgggtagcattactcgactataaaattttactctaccctgcatgtttttggttcaatatcttcatgtttaaggacctaatgcaagttctcaattttaatttaacatttggaatgtagatattgccagaggaagtagacagtaggatgtccctttgtcttaatagcatggaattgatcataataactacaaatcagccaacacaacatgaatcaggagaaaggtacttctaaggggaggagatatgatctcacatcaagattgattttttaaaaagctcatatgagaaaataagtgaaagaaaatcacttttttgctatcataatactagaaatgatatgacaacttttgcctgagaacctcaacgtactttgaggttgtgggatagctttagcaagctattaaagaagtccctcataaacctataaagtaattaagtatggactatggggattaagaccatcgtaaatggatatgagagtatttgggaaggagtccaatgcaccccactttatcaacaaatggagttgacctgctcatccacatattaatagagtgcagaaagatagctacagaggagttctggtgattactctaaattctcagtttcctaactgagggtacagtctgacttatatctctgagtagatcacctccaatgcaaaaataaataaataaaacagagctctgtgtcttcagtgtgaatgaatgattactgatattgacagtatcatcatatcattcttgcagcatttccacaatgccaagaaaaaatggaaaggccagaaggaaacttaatctttgccaaatcctatgatgaatgcccaaggaccaaatctgtagttaagctagagtcaggctcctgacagccttttcccctactctccatccatcccagctgtccactaccacctgcaaactcttacctgctctccccccagaacacatacctggctgaagggcactgtcctgcaggtctcccaatgtacttcatggcttttgatgggcaagatgaccccctgagaagccggagtttttctgaacatgaagtggtgccagaatttcttggcttcttcccgaagaggagatttctccattttcattccatctatcggctggatgagggactgggtcccaggtgggaagggctcactatctgagtccctggatggatgcatttctctctcaggcttcttccagaacctgccaaatctggacagcatcttctctctctgcctctggccttcccctgcagggctggtggctacaaggtgtggcactgcgacaaacagatctggcttctcctcagcttcctcatggttgcctgtgggaagctctctttgattccttggcaggagtacgggggaaagagaactctgattctggcggccatcctggtgccgtgtggtctttcctagaggcaggagtaccagcagctgaaataagaggagatgcatgctgtcaggggcccaagcttcttttgtaaatgatgaggcccaaaggagaggctcattctctgcaggactgggaaaaaggaaatcgtatatatagatacctgcctggcgggatgggaaggcaggtggtcagtagccaggcagaataaacacatttattgtttgcttgaattatgtagtgctaatggcctcctgccgtcactttggttttgtgtattttaaaaggccccagtgaaagcctgggacccagggggtaattagctaagagtttagctatgtctggggcttaaagagcagtattagcaaagacaacacattctttgcctaaatttcccatggctgttttcagaagaaggactagagtcagctcacatttgctgtgcatctgccttgtgctggaatagaatagacaagacatgttgctgtaagagaagtttttggataaaaattaaaggcatacatttagaaaaagcccaggcctttaggaaggctattcacacacacacacacacacacacacacacacacacacacacacacacgaagaagtatatcaaagttgtaaggagaagaaaggaagagctagaaggatgttaatttttttgagcaagggacatattgtttcttacttacatgcaaattggggttattgatttttgcacagtaactgagtaaagggaatatgttttcctttccacacgtagaaactcacaattcccaagttaatcctctcacattaagaatcaattaatgggtgctaaatttcacaactggtcagtcatcagataaactcttccaattgttcacatgttcctcaacaggataccacgtaatagactgacagctcatcagtcttcaatgaggatagggaaatgtctccctccagccatcctattgatttttttttccctttgaacaaagagccagacatgagaacgtggattctaagaaccaggtttgataactttgtgtgtgacgctggctagtcagtttcttaccttattgaatccacatcatctccccttgttttacactaattgatggccaggctaaataaagattgacacaaataagagtcttcggggatcaaaggaaaaattgaaaaataactatcattcaaaactatcatgaatcagcctaggatacgaaaaagaaacacgtccagaaaactgaaaccccagaatagagtccgatcagcctaccacatgattcaaacagtatttccactgggaagcaatgcaatatctgcttttatttctccccttttaattcaatcactatattccttgctttcaataacacaaatagtcctggaacatgttcccccttttttgtcaatactgattaaactttctttccaagaagtgacccactggagtctgttttccaggcatttctgttcttcttgatagccatgcctgatttctatgaaataaagccttaagtaagtccctttacccatgataatgagctatttttaacatggaccatcactttaccagaatgccatgagtggagatatattgtacttgtaccaaatatctatggaacgtgtgctagtattaatgaaaggtgctgttgatatataataaataagcatgtgtatttgccattgtttttttttattttaggaaaagggttctgctctgttgcccagtctggagtgcagtggtgcaatcatagcactctgtaacctcaaactcctaggctcaagcaagcctcctgagtagctgggactacaggcacactaccacacctggctatttaaaattttgtgttgttgttgaaacagagcctcactctgttgcccaagctgctctgaaactcttagccttgagccaccatcttgcctctgcctcccaaagtgctgggattacaggcgtgagccaccatgctatgtcaacatctttttttttttaattgactgctacttgaatttcttaattcc

SEQ ID NO: 15252 - DNA, 13720 bp, Human
ggctattcatgatcttttgtggttccatacaaattttaggatttttttcttctatttctgtgaagaatgtcattggtattttgataggaatccactctgtagattgctttgggtcatatataaataattctttttttttttttttttttttgagacagagttgctctattgcccaggctggagtgcagtggtgcagtctcagctcactgcaacctcctcctcccaggttcaagcaattctcctgcctcagcttcctgagtagctgggattacaggtgcctgccaccatgcccagctaatttttgtagttttagtagagacggggttttgccatgttggccaggctggtctcgaactcctgacctcaggtgatccacccgctttggcctcccaaagtgctgggattacaggtgtgagccaccgcgcccagccataaagaattcttaaacttgaagttggttgccattaagagcttgaagaccatggactcattgattattatagatatcattaatttttagttaggctaaaaatacacatgactgtttcaaagtatatgtaattacagaggctttgaaaaagacagtattcatgtgctagagcccaatccagaagacttaagttaaaccaatgtcaatgtcaatgtctccttagaagtgttaagacaggttggcttgttctgatgtttattgcagtttgaatggagaggcacagtgaggttaggggtaactcagttaactggtgtccagatggggccctacaggcttgtataatagtaccttatttagacaccatattctagagtatcatcatgtacttggaaattcaattgctaatatactaagtggtggtcaactttgaggaaattactcctgcttaacaaactcccagaagacagaatgccctcattttgatttatagtgacattgtgtctgtgtaggtacatccacatggaacaccaaatcataatcagaatattgcttactgagtagaaaatggcggggaagaagagttgactaggtgatcgcggtggccagggacatcaagcagagacgcttatggtatctcaaacacttactcggtggaaggtgctggatgcaccgccaatgtttgcttttcagcctccgttttctaggcttcatttctgatcaacattccttatggtcaattcagtctttttttgcctaagttgagtccttcaaggtcagcattaatacttggtctggtggccatttggtgtccttcaatatgcttctaaatattctgctctggttcttcatgtctgtttttcccatttaactttctttttgggaggccccatgtacaataccaagatttgtatatacatatatatgcataaaagtatccaaatactttatactgcttgtacatgatttaaatattcaacaatcagctgggtgtggtggctcatgcctataatcccagcattttgggaggtcaaggcgggtggatcccttgaggtcaggagtttgagcccagcctggccaacatggcaaaaccccatctctactaaaaatacaaaaattagccgggtgtgatggtgggcatctgtaatcccagctactcgggaggctgaggcaggagaatcacttgaacccgggaggccgagatttcagtgagccaagatcacacaactacactgcagcctgggcaacagagtgagactctgtctcaaaaaaaaaaaaaaaaaaaaggaaaaagaaaaaacattagctggctgtggtggcacatgcctgtagtcccagctacttgggaggctgacgtaggagaattgcagaggttgcagtgagctgagatcatgccactgcactctagcctggatgacagagcaagactccatctcaataaataaataaataaataaatattcaacaacttaagaaatggggtaagtagttcttatctgttgtttgcttaagagtatgagaatcatcgatcctcatgctattgctgatctgaattgcttttaactttttctttcagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcaggttagtacatctttcggcctaaccatgacgtaagtatagggcccttttaatttggctaccttggtaatggtagtcgatgtgtttgtgatgctttcattcccttatacgcctgttggtccttcctagccctgactaacagggttttcagagcattgaggattggcaagaaacaaaaggcactgaagaaaaaaagccttatttgccagccatgacagccttcagtttaacacacatgtattaaacatctgctgtctgcacactcttaggattctgtagattcccttaaggagtgcagtcaacctccttttgtgaggatgtgaggatatagtcactgtctaagaagcaacatcaaaaagttgctgatggccgggcacagtggctcacacctgtaagcactttgagaggtcaaggtgggtggatcagttgaggtcaggagttcaagaccaggctggccaacatggcgaaaccccatctctactgaaaatagaaaaattagccaggcacagtgttttgcacttgtaatcctcagtacttgggaggctgaggcacgagaattgcttgaacccaggaggcggaggttgcagtgagctgagatcacaccactgcactccagcctgggcaacagagcgagacaccatctcaaaaaagaaaaaagttgcggccgggcgcggtggctcacgcctgtaatcccagcactttggaaagccgaggcaggtggatcacgaggtcaggaattcgagaccagcctgaccaacatagtgaaaccccctctctactaaaaatacaaaaaattaactgggcatggtggtatgtgcctgtaatcccagcactcaggaggctgaggtaggagaatcgtgtgaacctgggaggtggaggttgcagtaagcccagatcatgccattgcactccagcctgggcgacagtgtgagactccatctcaaaataataataataataattgctgacataccaggccccaatctcataattccaagtggaaacatgtaaatgtggatgcatgaagcaaaatgagatgtgtacaaggagataaggtgaaattacaaatattgttctgaggagaccttctgaattccaagcacctgtttccctaaaggacttcactgattcatcattacataatatactcccagacccaatcgcataaaataaaatggggcttcagtatcatttttaacatactaatcttcacttggtcctataaagggctattgaatatacatgccaggtctcatgagttcattggtctgtcagaaataattgccaagggttttctaagagaaaagggctgttgaactcacctcagaaagttaaccaagctgggcatggtggctcacgcctgtaatcccagcactctgggaggccaagatgaaaggattgcttgagccctagagtttgagactagcctgggcaacatagcaagactccatctctacaaaaaattaaaataaaaaattggccgggcatggtggtacacacctgtgatcccagctactcaggaggctgcagagcgagaattgcttgagcctgggaggtcaaggctgcagtgagccatgatcatgccattgcattccagcctgggcaacagagcaagaccccatctcaaaaaataaaaaaaataaagaaagttaaccaggctgaccttaaacttccctaagtttacacttacacactgtcatggaactgttatctctgaagttattgctgaaattaaagcccttctttaaatgtagtccatttttagccatagaatgtctttacaaggcagttctacatgtttttaccctttgggtaaggtagaaatttctcgttagccgggtgtggtggtgggcacctgtaatcccagctactcggaaggctgaggcaggagaatcacttgatcctgggaggcagaggttgcagtgagctgagattgtgccactgcactccagcctgggagacagagcaagactctgtctcaaaaaataaaaaaagagagagagagaaatttatcttgttagttctcatactatcccttacaagtttcatgaagtcattcctggttctattttaagtgagtatcaagataacttaattttttttttttttgagacggagtctcgctttgttgcctaggctggagtgcagtggtgcggtctcagctcactgcaacctccgcctcccaggttcaagtgattctcctgccttagcctcccgagtagctgggattacaggcacctgccaccacgcctggctaattttttgtatttttatagtagagacggggttttgctatgttggccaggctagtctctaactcctgaactcgtgatccacctgcttcggcctcccaaagtgctggatttacaggtgtaagccaccgcacccagccaagataacttcatttttaaattgtggaatgcttaattaccttcttagaaagataacaaatgaattaggactaaaatgttacatttggtaatctaaataaaaagaaaatcccaaagcttaagttttaggtcttttataactaaaaataaaaatgtagtcaacaagaaatttccacttaatactattataccagaagataattcttccaaatgctattattctagttgttaatgctttgagccaacatcctggctcaaaatgatgagagtggttttattatgagctacatccaagattactttgtattctaatagttaacatagtagatacatatagactaacccaaaaaaatggaatcctttttttcccacttccttttctagcatgttgttgttccttgacccaactctcaatggctcacttacgtcactgttgtcaagttaatattaagtaacctataactaggaaactaatttgccagatttaaatgtcctaggggatacagcttatagaagctaagcaaatgatgattcactttcaattatctatcccatagcaactctccttcaggagtgcataacttagaattcacattctttcatcctgtcaagaaactaactaggctgggcgcggtggctcacgcctgtaatcccaacactttgggaggccgaggtgggcggatcacctgaggtcagtagttcgagaccagcctgaccaacatggagaaaccccatctctactaaaaatacacaatcagccgggcatggtggcacatgcctgtaatcccagctacttgggaggctgaggcaggagaatcagttgaacccaggaggtggaggttgcagtgagccgagatcacaccactgcactccagcctagaaaacaagagcaaaactccatctcaaaaaaaaaaaaagaaagaaactaactagaatctgaccccaaatggagctttttaaaaagaatccaaagtagtgagtagagaaaaaataattcaagcaatcataggaaaaccaatttttattatagaataacataaattcaatacatatctaattttataggtgctcatggtgagtcagagtcatctaaaaatatagataaaagttttatactgttattctggctttctctttcaggagtctgacaaatcgtgttgaatttgaacaaatagtaaaataattcctgcactgactttgcatgaaatgtgttatggtttggttttgttttttcttgagacagggtctcactctgtcacccagtatggagtgcagtggtgcaatcttggctcactgcatcgtctgcctcccaggctcaaacaatcctcccatctctgcctgccaagtagctgggactacaggtgcacaccaccatgcctggctaatttttgtattttttgtagagacggggtttcaccatgttgcccgggctagtcttgaactcctgggctcaagcgatcctccgtcctcaacctcccaaagtgctgggattacaggcatgagccactgcgctcggccatatttatattcgacatcatctctccatgtgcaagacgtggaggaaggagtcttatggcagctaaccctgaagcctctgtgagttaaaatatcgttttgttctttcccggcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtaagtgttcctctttggctcagaagttgtctagacacttagtttgaagaacaaggaaggggaaggaggaaattaaagccaaactatatttctttctctttctttttttctttaacattaacagtgtctcagatcagtagttttgaactgagctatatggacttcaggggacctgggaatctgttctcaagtgcccaagggtttttgtttgatcttcaccaaagatgatgataatttctcttttgctgtatttgcagccaaaagatagcatttttacaaagtaagacgaatttctgtagccagtatttctcacatcagtgtctgaggatccagggctgtaggggaagtgcaacatgccagacttattcttgggggcctaagaaaacctttttccattcaaaaggagtagccagcatggtggctcatgcctgtaatcccagcacttcgggaggctgagacaggaggatcacgtgagcccagcagtttgagaccaactggggcaacatagggagactccatctctacaaaaaataaaaactagccaagcgtggtggtgcgtgcctgtggtcccagctgtaaccatcctatcactttggaggctgaggtgggaggatcacttgagcctgggaggtcaaggctccagtgagctgtgatcacaccactgcactccagcctgggcaacagagtgagaccctgtctgtttaaaaaaaaaaaaatgaaatgaacaataaaaggaggccatatattcctcatagatgatagatacacacacagttgttaagatttgcagactttaaatttttcctgtatttctgcacatatgaaatgacttatttctttctagatacaaatcttatataaaatttcatgcaataatagtttcatccattgtgaattatataaatttgaaaaaaagtgttgcaaagataaaaaaaaaaaaagttatatttttagtatcccaaacaaccactgaagtttatccagaccgttaatgaaacccatttttctttgcaacatcacctttgtccagaatgaattacttggctcctagaacttaagattcaaaaagcaaaaccaaaaatcccagatcttttaatgcatccttccagtctcaagcagtatgtgggtctcattggcttttttgacttttctttcacaggtctgggatactgctttagttttctcccaactgtaaccatcctatcacaatattttggcaaaagacgttccatagtcactgcagttgcttccacaggagaatgtttcgctgtgtttgctttcgcaccaggtaggtggactacaacagcctaagtatgaatgtggatgagagacgtcactcaggtattcttgctacgctaacttttgccaacagtatggatgactttcagtgtatgtgtaatgagacgttatttacgtctcttctccagctcatttttaggatctgtcctccctaacccccactttaggtattcagaccaccttaataataggtttcaattcctaactgggcacatatgcagtggtagggctttcttgacacatgcattccagaataatctagtaatttgcaattattcacctgttatgtcctctcgtttttcaaaagacctacattcaatgtggatttagattatgctaataaacacagcattcttatctgtgtgtagatcatctcaaaacaaaatctgtaactgagcacggtggcttacacctgtaatcccagcactttgggaggctgaggtgggcggatcacctgaggtcaggtgatcgagaccagcctggccaacatggcaaaaacctgtctctacttaaaacacacaaaaaaaggccaggtgcagtggctcatgcctgtaatcccagtactttgagaggccgaggcaggcagatcaggaggtcaggagatcgagaccatcctggccaacacagtgaaaccctgtctctactaaaaatacaaaaattggctggtcgtggtggcgcacgcctatagtcccagctactcaggaggctgaggcaggagaatcgcttgaacccgggaggtggaggttgcggtgagctgagatcaggccactgcactccagcctggtgacagagtgagactctgtctcaaaaagtaaataaataaagattgagtacattcatactgctgagtataataaatttccacagaacttataacaaaatctggatccatatttcttcttgatggcttctcctgggtcttgagtccattattgaccttatattatttcttcttcactcctgcctattcaagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccatttttgaaagagaaaagttttatttggttatgcatttatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtaatttaaatacacaaaatacaaacacttgtctactttcccttgtgaattgtgctagcttcctgttcaagccataaaaaaaacttactgccgttttatatttccattgaattttagagctgccagggattagagattacctgagccagccctcttgatttaaatatgaggaaactgaaggccaaagaattgaagctaaaggtcagatggtaaattagtggtcgattcaggactggaagctgtgtctgtagtccagattgaccctggccttttttttttttttttgagatggagtctcgctctatcacccaggctggagtgcagtggcgcagtctcagctcactgcaacctccacctcccagattcaagtgattctcctgcctcagcctcctgagtagctgggactacaggcacccaccaccacgcctggctaatttttgtatttttagtagagatggggtttcaccatgttggccaggatggtctcaatctcttgacctcgtgatccgcctgccttggcctcccaaagtactaggattacaggtgtgagccaccgcacccgccaacccaggctttttctgtcaccttgccttctctcatgctaggcaagaactcatggatttatcaccttcagagcccacctgacttttggaatgatagaactaatggacttctgtaagtcatcttcctttcttaggaaaggtatttgggaatggatagcagcactctgtaaatacctaactgatttgtacagaatatttccttgtaggagggacataggtatgtttcatatcttagatcccaaatgggtctttaaagtgtttgtgattagaaatcgtaccccctgtcaaaagatacctaaaacgggccgggcgcagtggctcatgcctctaatcccaacactttgggaggatgaggcgggcggatcatttgaggtcaggagttccagaccagcctggccaacatggcaaaaccccatctctactaaaaatacaaaagtagatgggcatggtggcagacacctctaatcccagctattcgggaggctgaggcaggagaatcgcttgaacctgggaggcagaggttgcagtgacctgagattgcaccatcgcactccacctggggcaacaagaataaaactctgtctaaaaaaaaaaaaaaaaaaaaaaaaaacctaaagtgaactcaagtgaaaataatacagttccttcctaccgaagaatattaccttttcaaagaagtatgcatcgaaatgtcccaggttttaggtcctctgctaggacaggcttagcccaagaagaacaagtatattgggtgtttgtctctttctcctctccagtctagtaaagatttctgcccttaacacccatttttctttagaaacacaaaagaaaacaaggaaggcagtgaaactgagaggcttctgaatgggatggtcgcctgggtgaggggcttatgtctaggaaggatgctgttaacggacgccatgctctcttccaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttccttttttttggagtcacactacatgtacagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaccgattctcttctaagattttttattgactctcacagcattcagtgtttgaggcaattaaagttataaaaactcaccaaagattcactccaaataaataattttttaacgtttatcttctgcaaaaccttttaactctactagagacacataaagtttcccaagaagtttctactgaactttttatttacttatatttattattattattttttgagatggagtttcgctcttgttgcccaggctggagtgcaatggcacaatctcagctcactgcaacctccgcctcccaggttcaagtgattctcctgtctcaccctcccatgtagctaggattacaggtgcccgccaccatgcctggctaattttgtgtatttttactagagattgggtttcaccatgttggcc

SEQ ID NO: 15253 - DNA, 10634 bp, Human
  misc_feature (1)...(10634): n = A,T,C or G
ccccttttgtcttctagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctcagcctgcctcattcctcagtctcaggggtgtttcagagatgactgcagctatggctgctccagctggggctggccctggtattcccagcatccccacatccagctgctggcacagaccccccagacaggacgccctccacatggactcacctgcctcggataagccgccaggcactgcctccccacctcagatgttccccacactgccccctcctcacacctcatgtgccccacacacacacacacacacacacacacacacacccactccccccaccccagctgctgagcctggaccggacacctgattccctccccttgtcagctcctcccccaagcctttttgtggggaaacgagaatatttgtcaacccacagaatcatcatgagtttgcattttccagggggtttctggaggcacccaggctttgccccagaaggtgctgggaacccctaatgctggggcgatgccactggcagggcgaggctatgggtgcagctcctggagggaccctgctcagtcgcagggtcccagcgcacatgacagtgggaaccaggctgccggtggagtatggagctccaggacatgacatcccattaccatgcagccctgctgcttgggtcatcacagtgcctgccccttcagggaactgagggccaggggcaaggaaagccagtgcctcagagccctcccacctgccaggctgccatgcgcccactgagtggggtggccgggggacagccctagctgccctctccctcctccaccctgagccacggggccagggcctgtgctccagtctcagcccctttgcccacctgtgaaatgggatccctccctcgggactcctccttgagcctgcgtctgtcacagcaccccctccccctcagaaatccttttaggaatttaccaccttgctacagatgcctttaatgcctgggtaaaggagacacacttagtgaaggtgacaggtgtctgggtgaagggtgtagacaggtgtgacttgcccctggagggtgaaggaggggtctccagggacagtaacattctatgactgcgtcagctgaaggtaggaaacctccgaggcaggcagggcacaggccagtgtgtggcctgggcaagtcctaggtggccccacctgaggccgtggaggacacacgcacctcctcagggctgcctgacatgacctgaggccctgactccccaggccgcttgggcagggtgtcattcctcagtgaggggctgcctggcccgaggactgctgactcccctgtccatctgtgtgcacccaccgccctcccccgaggcccatgtcagccaggtcctgagccccactgtccttggactgccctcccagcgcccagctacccccagctccatccctgaccaactggactcaagcctggggctgagtctgtgacatcctcgaccaccagccaggcctactcttgcatctgccgcctcccgcctggtggttgccccaccctttgaggctggaacctggaggagggagaatgataagcgcccatgtctgtgcctcagccgcccatcaggcccagctctgctaaccaccgggccaaccagttcctgtgaccagcagtgaactaggtccccaggggaggggaaggcacccttgggcacgtgaggccctcctggctgccctgagtccccgcttccacactacacccacagatggccgtgtcctgcgcctccacacctgtgctgcaggtgttcaggcaaaaaccgtgctgctccctcggcttgggactccttaccagcccctctcatcaactcatccttcaggaatgccacttcctccaggaagccctcatgataccccagtaagaagagcagtttcctccaagctaccacacctgaacatgggatgctgttctgacatccagaactgtgcaggagctggtaggagatgctggggtcgagggaactcccattaccaaagctttggtgtgagggaggggttgtgggagagctggaggtgaaatgcagagggttgtgagggagagtgagtgaaggaaagaggggtagtgaggaagggggtgtggatgagggagggagatgaaggaaggggaatgagggggtgtgtgaggtaggtgaggaaggagatgagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggacacagaaggggataaaaaataccaggatgacatactatctaacaaagaaaatagaagtaataacaaatccacaaagagaggatatgaccgataggggatagagaatcaatgaaaacagaaggggtgagaagacgaagagaaaaagaataaggcagtaaaaagggaaagaacatgactataagaggtgaaaaaagaacgtgagactgaaaacagagactcagaatgagaaggaaggcaaatcaaaggggtagcacgagagagacaccagaaacagggaatgagctatgggggtgacagacgggtgaaggagggaggtgaaagcgggtcaggaagaggagagggaaggagataagggaggagagagagagtcaaggagagggaaaagaagagtgaagaagagcatgggggggtgacccaaaaataaaggagggaggtgaaaaaaaaaaaaagaggtgagggaaggaattgagggaggagggagggagggaggggtgagggtgggggtgaggaaggggtgagggaggggtgttgggggacctagtatggaacccaggagtatatttgtcacaggtcagcaaggacacagggcacttgagctcagaggccggaagtatagctggtcttgcacaatccacggtaccggtctgggagaaatgaccctgctgactacaaacacaggctgggttttgggggtgctgacgcagctttgttgtgctgctgcttccagttctgccggctcagtgccttgtgaccggggccggtggctcctccatagagggctcacaggggtcctgcccactcagtgcctctcacacctctgcacaaaccctgggtctcagcagccacagggttctggccttccttgggtgagcctggacacccaccctcatgcagacaggttcagaatctgggagggggtccagcctcttgtgcgccctactgtcccccacacctgaggggcactcgggagacagagtactgggggcatgctgttgtcaccacggcctgctggggtcatgtcacagctcagagccttggtccccccagctgtaacgttagcatgagaatggggactctggcagtcgaggaacacccaccctcccgcagcctggctgggcaagtgctggatgggggttgcagtgggaccccaaatcttgatcagatctggggaggggaccctagcactaccttgcaggggggtgagggaccaggggtgggtctccacagaccctactgcagccacaggtttggagggagtgggctacactggcctaaaactggcctgaagacagctggtgggagaacccggctgttcactggctggaaggacgaggacgtgctgggctgggggccacagaggctgcagctggtggggcagcttcctgcggtcacaacaggtcaacagcacctggagttagtgtttcctctaaagtaaagtatttgagagaaagagaagaaaaatatgaaagcattcagacctctaatttattattattattttttgagacggagtctggctcttgtcgcccaggctggagtacagtggggcgatcttggctcatgcaagctccgcctcccaggttcacgccattctcctgcctcagcctcccgagtagctgggactacaggcacctgccaccacggccagctaattttttttttttttgtatttttagtaaagaaggggtttcactgtgttagccaggatggtctcgatctcctgacctagtgatccgcgcgtctcagcctcccaaaatggtgggattacaggcatgagccactgcacccggccctttttttttttgagtcttgccctgtctcccaggctggagtgcagtggtgcgatcttggctcactgcaaccttcacctcccaggttcaaatgattctcctgcctccgcttcctgagtagctgggattacaggcgcccaccaccacacccggcttatttttgtattttaatagagacaggggtttcaccatgttggcgaggctggtctcgaactcctgacctcgtgatctgcccactttggcgtcccaaagtgctgggattacaggcatgagccaccgtgcctgacctttttttttttttttttgatacagaaatctctcactctgttgccaaggctgcagtgcagtggtgcgatctcagtttgctgcaacctgcacctcccgggttcaagcaattctcgtgcctcagcctcctgagtagctgggattacaggcatgtgccaccgtgcccagctaatttttttgtagttttagtagagacagggttttgccatgttgtccaggctggtcatgaactcctgagctcaggtgatccacctgtctaggcatcccaaagtgctaggattacaggcgtgagccaccatgctgggcccagtcctatgattgttaagaataatgcagtgccaaaaaaaaaaaaaaaaaagaataatgcagtgaagaaacaggcactccactctgattgaacacaggtggaagaggaggccctaggaaatggaggggagggctgggcgtagggtgtggcgtgggttctgtcacaaatggccaatacacccagaatcaggtgctcctccctgcctggccgtaccaggcctgggcccagcaccttgaatggaggtccagttgcctccccactcatctgacatgagctgccctcatccttactctgcacatgtggaatgaatgggccaggtccttcaaggatgaaccagatagaaagcactgccctgggagagggagcctgtagatccaacaagacttagaagacacttccagtgcttttaggtgggcaggaataagcagtgtcaaggacacgcacagggcacctaagccatgaagagacctgagcaagggatccctgtaagggagtgaggggccgagactgggcttcgggctggcacagcggtacctcttcaccttggaacaacccactgagatctatgcctgccttcacatctatcttctatccgtcatctatcaagctatccatatgtcatctatttctcatctatcagtcaatcttttcatcttttactcttttccatcaaatacaacagcttctatcaatcatctctatctaatcatccatctgaccatccagcatctatcatctattatctatctaatctatctaatcatctaatctatctgaccatccatccatcatccgtccgtccgtctgttcatccatccatccatccacccacgtatctaccatctatcaatctatctaataatctctctgttataggaaagaggttaggaaaccctcccatcacactctgcccagttggtcatctccagctctatgcgactgcccctacctgcccccgcacctcactgcttccccaacaccagcccagctcacaggacttgtgcaaaggcttccttgccctcaaaccttcttcccagacttctgcatggcccctcgccatcatcccaggtcacctactgacctccctgcccattcctcctgagctccctgtgtgtccctccatgtccccccccaccacccaacttcgtgggtgcatcttgttcactttccaggtcccccgtgagaacagagctgaatccacgggcaggactggctggagtggatacatcaggtcccaggaccccataggcgctgtcaaaccttcccagaaggtagcttggctctgagcagctcctgggcctgttttttgtctgtcccttggctgctgtgacacatgcacagggcctagcacatacaggcaagtgagtgggttctgccccagacatttactgagcacctactatatgctggacagtgctgaggacacaggctgcagataggtgatggcatctggtaggagagccaggtcagacaaaggatccttaagtaggagaagcacagacagggatgcgggtgccaagccatgcccccagctccagcagagccccttggccctcaggagacccagcaggcagaacactcattctcggagtgcctgccctggacttgggctggactcagactccagctccaggggagagtccacctggccgcactgtctctggcaacatggacagtgactccatcccaaggcaccagagcataaattgtaatggggccaagacagtgatcagggaggggcggcatcagactggtcaggacggcctctggagtaaccttagagctaagccccggccagccgacgggggcctggaaggatgctcttcagggggcagcagcacaggctgaggactgagatgggaaccccagaagtcagggtcagagctggtggagtggttggtgaataagcctgggagttggtgggcagggaggttgggggcggccagcatgggcgtctgagtaggggaggccacctgggcattgggactgcagggggtcagggcgcacacatccaactggggatggcccagggcccagcacagtcatctgggttcacccctccgactcggtcccagtgaacttcctctcctggccaaaggaggagctaagacatgtgttggccaacatccggctgctggtgtgtgaggccaggcacacagggggccctccctcctgcctggctgccagccagcccacactgcaggccatggccaaatcagggaccaagcgctgggcggcatgcatctgagtcagcgctggccacgcaacctgcggccaatgctacattgcctcctgtcaggagcacatttcgcacccaccgtataccttcgcagcttccttttcaactcagcacatctcagaactcattcccatatcaactacttttcaaaccctctatgggacaaacacaaaagtggagagagcagtgccacgagctcagcttctcggcatccacgcggtccacctactcagtagttgctgttgttttcccccgggagtgctttagagcagagcccagttagaccccctcactcaggagtgcttctgctttctgtcacttcagcaatggggctatgcagacctgatgtcagcccagacacaggactgcaggtgggggccactcatccatccgaggaacgggagctggagccaccccaagtcacggggctcagcccagatggggacagaagaaaagtgatgaggaagtaagtgggggcctcagtagtgctggaggccttgccccctcccctgtgcccctggaaggctgcttggaggaggaaagggcagaggctggcaggagatgcacaggtacctcagctggaggggccaggtcgggggacccacagcggggacacagaggcagtgcgggatggaggacggggcaggctgaccccactcccacctcaggccaccagatgctccacatccagggagatgaggggctggggctgggaggggcggtggggagaacagaatgggtagtggggggttggggaaggatgggggaccaaggagaagagagtgaaacgccagacactggcggcccgggagccaggtttccactgggtgaggggtcctgtggggcaggtgggccctgagagtccagggcctggtcccggcatggctcccagctcccctgtgcccagagaatgtccccgctgaccacaggcatcactggacaccactgcggggaagcagcaacttcaaacttggtagaggagagactcaggggcagcacctcaaggcctgtccacaggcgggggcaggaaaacagtgctggaaacatgtgagggggaaaacgacgccgctccccacctgaccctgcctgggtcagaggtcactaggggctgctgatgccagtgacctcagacttccacctctgtgcctccaaacctcaccccaggagatgtcaggagccaaagagctccccaagccaagattctggagaaggcggccctggccagaaccgtgtgcttctgacgcccctgcagggcagctggaaaggggacagggaagccaaggccggtccagccccgggaacagggagatggcatgtggagcctgacaaagagcgtgggctttattgttcattcatgattagaaaagtgggtgctgggacccccgtggagggggttgggctctgcccggtcactgctggtgcagggtatatacaaggtctacggccctcacaggcctgactggctccctcttgatggccaccaagcccaggcacttaagaccagagccagtggccatccgtagggccaaaggcagttctggctgtgcagggtccctgggttaggaagtggacagaggctggggtcaccagggcaacccggacagggcccacgggaggcagggacgctggtgctttgggagagggagagacatctccttgtccttctggaatgtcctgagacagaggctggccctggtcactcatccagcccatccacggacctgctgtgtgtccttgagtgggtcgagacccttctctgggcacaggtctctgcagctgtccagttctgaccctctgggctattgtggccagcccccatgtgccaggagggagctgcctcctgggaacagctgctgagagacaagagtggcctcctgcgtggtgcttggccgcagtcagagcaagggctggtccggggacatggtgcagatgaggccagcctgggctctggcagtctgggtagtgccatgtgcagggaggtggacacctcacaggtatggcgactcctggggtcgggcagctgagttgcagggcaggcagcatccagggtcctggaaaggagacagaggagaggctctgagcctggaaggagggagaggagaggctctgagcctggaaggagggagaggagagggtctgagcctggaaggagggagaggagagggtctgagcctggaaggagggagaggagagggtctgagcctggaaggaggaagaggagagggtctgagcctgggaaggggggagaggagaggctctgagcctggaaggagggagaggagagggtctgagcctgggaaggagggagaggagaggctctgagccaggctgtgacaagccccgagtgtcagggccatttgcacacccggactcaggaaggagaagagcctgattctgacatgagaggtgtcaaagtactccatgcctcagtttcccctctgaaaatggaatgaatatagcatggctgggttactgccaggacttagaggcctggcccagcatggggggctcgggttgggcagctgtgaccatagccacccacgaagcctgagacctctctgactgctccacgcaggacacacagcagctttggcctccgagcctctgaggacagctttaaggtccactgctgggtccccacgtggcccacagacgcagcaccctcttcccggcaggcagataactcatgcttgggagagttagggactgcattcagcacacacagcaggtgattaataaatggcctggccacatgcccaagccagggagcagctgacatctaggtgttctggaagaggacaacttaactacaaactggaggcagcatctggacagtgactcggaccccacatggggccgcccagatccaggtcctttcagaagggtgacttcaggctccacggccgggacattgggggctggcgtgatcccactgggggaatggccttgggtgtggtaggggagcttgagaggccatgggccactacgagcagcggtcactcgttggcccccgtgtggggaggggtgaggccaggtggatgcagggtgctcccaacccagctgctggccccagcgccccacctcatcctcactatgccctcttggggaattttttttttttcccgagatggagtctcatactgttgcccaggctggagtgcaatggcgtgatctcagttcactgcaatctccaccttccaggttcaagcgattctcctgcctcaccctcctgagtagctgggattacaggcatgcgccatcacgcctggctaattttgtatttttagcagagacacggtatctccatgttggtcaggctggtctcaagctcccgacctcaggtgatccgcttgcctcagccacccaaagtgctgggattacaggtgtgagccaccgtgcctggcctggggaaatttttatatatccttgacacacaggcgctctgccccaagagcactgc

SEQ ID NO: 15254 - DNA, 64984 bp, Human
  misc_feature (1)...(64984): n = A,T,C or G
aggggccagaggcaacagtaatggagtcatcaccttccttaacatgtctgcttaatattcaaaaataaatgtgatcataccactcctttacatgaattacctccaccagtccatactgtgggaccaaagccagacagcctgccagtaagaaaaggaatctagattgcaggatgcggggcggagaagagtttttaagaatggagaaatgcattccaaacccaagtagcagggttgtatttgttcaggtcagctctgagcatcatgcgtcttttttttttttttttaagacaaagtcacgctcttgtcgcgcagggcttggagggcaatgatgcgatctctgctcactgcaacctctgcctcctgggttcaagcaattctccttcctcagcctcccgagtagctgggattacaggcgcctgccaccacacccagctaatttttggtagagacggggtttcaccatgttgatcaagttggtcttgaactcctgacctcaggcaatccacctgttttggcctcccaaagtgctgggatgacaggctatagcctacgcgcccagcccattcatgtgtcattattatagtgtgcataagtgcggggaatgttactaaagtgtatggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtgacttacaaaaaacctcacaagaaggggtcctttgagtctccactccacttgaccccttgctactcacaatgtgatgagtagacaaacagtatctgatgggcagcacccaccacaggagaacttcttagaaatgcagaatctcaggacctgtcccagagctatggaaggagggcacacatcttaccaagatccccaaatgattcctgtgcccagtgacgttcgagatgcactccatagcgcattcagaaccattctacaaaccacttttgagctttccactaattgggcagaggctgcacacaccatcattgcaaatcgataggggttttgaagccctgggtgtttcctgtttctggcacagcatggcaactgtcccagcaaggggcagcccacgggagctcctttgcacacaagccctgctgctcctaaaggctctggacacacaggagacctcccagcctgcttgcggggggggcgggggggacactcgctcctaacaggtcttgtttcaggtcagagataactggattagaaacctgacttgggtccctaattgcagaaagagtgaaggaggacaaagaagaaatggggaaggaaggcacctgagctagcactttcctgtctgaggctagggcgggtatgacgggcaggccaggtgcccacacttggccggctgagaggggtacgaggcaggctgctcagggcagagaagaggaatgcaagatggaatcaggtgtacacctgtgagacggacccccaggtgggcccctccaaggtcaagggaggagatgaggacttgagtgaggctgagccagcttctggagagaggggctaccagacagagagcgagagaggcgctcagacatcagacggacagacagaggctgacggcaggaggctcagagggcccaacgtcagcccgccgggcaggctccccaggcagacagacaggacggggcccaccgcccaaggcccgactcacaggtgcgcgatgcccgccttgcgcaccgccgaagagatggctttgactgctgtgcagagcgagttgagcagctgggtcaactcgcccgtgccgcgggccttcctgccctcctccatgacgaagcgggtcagggtgttgacgtccgtgtcgaagggcgcctggtcagccatgcttgaaccgggtagagcgcggggctgcaggtgcaagcggcaggtgcggggctgcaggtgcgggcggcaagagagggcagtaggcactggccgcaggtgcggagctgcaggtgcgggcggcaggtgcgggccgcgggacctggcgggaggactgacagaccgactgccgccccgagtgtccgcagcgctcgtggtgcaactgggccaggccaggcgccggcgggtgaatcgcggaaacctttagacgcgggtcggccccccgcccccgggaacactcttgcgccccgcctaccccgcggaccagaccgcggctccgcctgcttggatcttcagacaaggtcggggatcctccctgcggtctcccaacccccgcccccacgcgccctgccgccccctagacttcctgggctgtcgccccccacacacacccctccgtgccctccacccgcactgtggagcgggactcgggccatcggactctgccagagagaaagctatgactgtttcctccaaaatcataaaacggaagttcagaaaggttaagtaacttgctcaatgccaccagctaggcagcgaaacccgcagccagtccacatggcctggctttagctctgcagctcctgccccgtgtggctgcctgcccccgccccctgcccaagccccgtccactctgcctggcctgtcacctggcccttctgtccccgctaggagacacagagtccccgtttctcacccatctgagggcccacgtctgaatccttaatccaggcctcttctcaagattcctagaattcgagagctattgagtatttgaatttccaagatgtgagtctcgcccggaagtttcccggaaaacggtcgctgacacagagtcctcggctaccacacaaaggccagagggctccaccgcccgcatcctgaccccctggtagccacaatgctgcaattgatgtgctgattcacggaacaacacctattgagcacctgctgtgctgaacactgtcctaccttccaggggtggagcctgatccaaacagacaaaactcctgcccttttcgagtgtacgttttcacagagaaacagtaaaaataaatatataaacaatagattagtttgttacataagccataagtaccatagagagaaacgaaatagaaaaggaagacacggaatgtggaggggagaagagggtgagcagaggcctcagtaaaagcttctctgagaaagggatatgtgagcaaagaggtgaaggatgcaacgcgccggtggagatgggaaggagagcggtttcctcaccgggagagccagtgcacaggccctggggtaggagaccatgtttcaggttcagggaatggccaggagaccggtggagctgaaatagagctagcaagggtcagaggtggaggagataaggccagcgggaggatgcagaggtgaggtctagagggccaagtgaggtttgactttgactaggaggaacccactggagagtttggagaagaagagaggcatggtctaccctgtgtcttcatactgcggctactgtgtgaagatcagactgaagacagtgccctccaggttactaggagatagtgagccaggtgttagcagtggaggtggtggattctggacatattttgaaggtagagctgatgggattcgttgacagatgagatatgtgagagacaggagtctcggatgattctaaggtttgaggcctgagaaactagaagaatgcagttgtcctcgactgcgatggggaacaccgagaggggcgtgtgctggaggcaggactgacaattaggagctaagtgtgggacctgctaagtttgaaatgccttctagacatccaaggcaatgtcaaatagacagatttatgtatctggagttcagaggagagatccatgctgcaggtataaattggaaaagccaactggaaaaaccaaccaaaaaccaagagatgtgacatccgggaagccagatgaagaaggtaagtaaaggcgggctgacccatgtgccaagcggtgtggatggggcaggcaggacaagctctgaaaattgactgctggattcaccgtggagacctggggtgcagattcctgtgcccagggttgtcagatgcggcggcgttgaatgaaggaaggtggtggtaccaccaggaaagacagcgactgtctcctcaaagccccagaggggacttagatgcctggcaaagagagttgatcctttaagggtcttatttaactctttgttcctcaggcaacttttcaggaaaaaccctgtgttaaaaaaaatagtaagagaaatacatccttaaacataaaaactcaaataggcccggctcactggctcacacctgtaatcccagcacttcactttgggaggccgaggcgggcagatcacctgaggttgggagctcgagaccagcctgaccaacatggagaaaccccgtctctactaaaagtacaaaaattagctgggcatggtggtgcatgcctgtaattccagctactcaggaggctgaggcaggagaatcgcttgaacctgggaggcggagattgcagtgagcagagatggcaccattgcagtccagcctgggcatcaagaacaaaactccatctcaaaaaaaaaaaaaaaaaagaaaaacaaacaaactggaggctgaggcgggcagatcttgaggtcaggagttcaagaccagcctggccaacatggtgaaacccatctctactaaaataaaaaattagccgggcatggtggtgtgcacctgtaattccagctactcaggaggctgaggcaggagaatcgcttgaacccgggagacagaagttgcagtgagtcaagatcctgccgctgcactccagcctgggcaacagagcgagattcaatctcaaaaaaaaaaaaaagaactgaaatgtgatgactagtatttttggcatagtaactagttactaggggagagctagagctagtaactaggggagtgtgcccctttacttgccagactctcagtccctcaggatcttggattggctaggaccgtaaaagtcatctagtccagccaaccctcattggacaccatccctgataagaggtgaagagcttgggatctgcattaagcaaacttgtttgagtcccagctccagccctcagcagccagagatctcggaccagttacctaatctctgtaaacccagtttgttcatccatatagtggaataatggttccatctggcagtggtgtcatcgggctgaaatgagatggcattggcagagtgcttagctcagagctacacacaggggacacactgaatacgtggaggagacccctgtctagctcagtcacttctgcttgtcacccacgatgatgggcagctcattgcctacaaggcaagccattccccttgggactaggccacgtcgcattgtggtgaagtgcacagactctggggctgcatggcttgggtccaaaccctggcctggccacttactggctgtgcaagcctgtgcaattggctaaacctcaccaagcaaccattggctcatctgtaaactggggctaatgattgtagccacctcatagggttgctgggagaattatacaggcagtgctggtagtgtttaagaacagtgcccagcatgtagtaagtacacagtatgtaagtgtttccttcgttacatgggtagggccaactgttgttttcatgtgaacagaagcaagaaagttccctggccatcaaaaggggctagagggatgtgggaattggcagctgagcctgtatttgcctggtgtgcagtgatatcccctccatcatattggtcgattgtgactcgctcttttctgggtcaagatgcataaagcccatcacccaggtattagcaagagacagaggaaggcggccacctcacatgggttcctggcctgtgggttgggcccctccctcctccacccaccaccctcgcagagttgcttcttgccacatactccaacttcacatgggattgcagattcaagtgatgtgagcagtattaccacatgtgtaacactcgaaatcctgcgaagaatcagtgctcatgcatttcctcacccagctcccacgatggggttatgttggaggcgggcagtggagaagtaacagtgtggacagtccctgcccctacaacagccgccctcaacccagggctccactgcttactttcccctctgtgggggcggttagtgccacaggaaagaaaaacaggccaggcacagtgcacacacctgtaatcccaatgctctgggttgccgaggcagacagaccacttgagcccaggaattttaaaagcggcctggacaacataaggaaaacactgtctctaaaaaaatttaaaaattacccaggagtggtggcgcatgcctgtagtctcagctactggagaggctgaaggaggaggatcacttgagcccaagaggtcgaggctgcggtgagccgtgatcacagcactgcactccagcctaggcaatagagtgagagtgtgtctctaacaaaaagacaaaaagaaaaacaaaagccaagtggtgtatgtgagagggattgcagtagcatggtccttccttaaacacctcccccagctcctgtggccccgggggcctggtgtggaaactaaacagcaaacatctatttagcacttgctaagggtgtggcacttgcccagggcttcagaagcagcctttaatcaatccagaaccactctggggtggcttctaatcaaacccctgtctttacagatgaagggactgaggcttttctttcttttccttttcttttcttttcttttttttttttttgagatagagtctcactctgtcgtccaggctggagtgcagtggcatgatctcggctcactgcaagctccgcctcccaggttcacaccattctcctgcctcagcctcctgagtagctgggactacaggcccccgccacttcgcccagctaattttttgtatttttagtagagatggggtttcactgtgttagccaggatggtctcaatctcctgacctcgtgatccacccacctcagcctcccaaagtgctgagattacaggcgtgagccactgtgcttggcccaatttttgtatttttagtagagatgggatttcaccatgttggtcaggctggtctcaaactcccaacctcaggtaatctgcccgcctcggcctcccaaagggctggaattacagatgtgagccaccacgcccggccaacaaggtcaaataacctgtccaaggcctgcagccaggcaggaagtgacagaacaaagactcaaaccctcatctgtctgattccaaaccccatattcccactgacttgctggttctttcctaagtggcagtttccctccacgtcatgcctccagggacaggcaaggctctgagcccgcctacggcagctctctggactctagagctatttctgggctcatgttcattcattctttcactcaacacatagtttttgaacacctgctgtatgccaaaaccataccacaccctgaggttgcagtggtgaacaggacagacacagctcagtccactttaggtttatattctttgtgggggagataagaaaaaaaatcatttaaccaacaaagacacaaaactgtttcagggagcagagtgctatgaagactgtaaagcaggatgaggtaaaaactcaaagcctttcttatgaaatgacttttgatcagagactgaacaacagaaaggaatggggcaaatgaagagctcatagaggaacatacagaagaacaagcaaggctacggcaggtgcaaagaccctggtgcattcaaggatcagctgggagaaggccagtgtggcctgaagggcaagtgagggaagaaccacaggagataaagttggaaagagagacgagggcagattatgaaaggcctcacagcaagtcgctcaggttctatttatgcagccagaagacaggggaggccaggtgcagtggctcacacctgtaatcccagcactttgggaggccgaggcaggcggatcacgaggtcaggagattgagactatcctggctaacgtggtgaaaccccgtctctactaaaaatacaaaaaaattagcctggcatggtggcgggcacctgtagtcccagctacttgggaagctgaggcaggagaatggcatgaatccgggaggcggagcttgcagtgagctgagatcgcgccactgcactccagcctgggtgacagagcgagactctgtctcaagaaaaaaagaagatgggagggttttaagctggggagcgacatgacttactaaacggtgtgagaatggaccgtaggtggtcaagagcagaagccaggagacccagcagaaggagtctgacctaacctctacttgatttacagtcaaatatgtgaagcccgctgtcatattccccatacatctttacttctccagttaaatattttcagctcctccagctgctcctcaggtggcaagattttgaagttcttcccttcctgttctggacctggtggccccttgaggctccttataaccccatgctctatttccacgattccacccatctgctccacctcatgttccaggggtcctctctcctaggaaactagctgtattttctcccccctgctgataatattaggaacaggctgatgattgcagcagcaggatggggcagagggcaactgaaccatgatgcagttgtagtaaagagctcagccagccctgcggggagctcctctgaagctaagatgactctgcagagctgtcctgagttggggcaaagaggcctggaagttagacctccaggccaacatgtcatgggctattggctgtcctgggaaggggcgtgacgtgggagagttagctgtcatcagcagaggcagttccaaagacggatgacagctgagcaccgcccaccggcagcagtcccaagagctgggagccccttctttgtccttaatgaggagctgcaaggcatcccacagcacccaccgtcatcagcaaggaaggccagaaactgcggggaagcagggtctgtctgcatctctcggctttcctttcctctgtgtggcatcactctcagacactctctccccttgaagccccatgtatggccacaggtatccccagaactgtgctcagtcagcccagcttcctttccctctagttccagcaaaaatccagtgtggaactcttcctggtccagagaggtgaccattccctggccaagaattgttatagtgatagcacagacctcctccaatttataaaaggtgtaagtaattacacacattagtgctctgttacacagattcactgaaatcatggaagttgggatacgcccaatacacagtggctgcagcagatatggagggatggtagccagggtggagcattctggagctgagggagcataaaatagcatgagaggccgggcacagtggctcacacctgtaatcccagcactttgggaggccaaggcgggaggatcatcaggtcaggagatcaagaccatcctggctaacacggtgaaaccccgtctctactaaaaatacaaaaaattagcggggcgtggtggcgagcgcctgtagtcccaactactcgggaggctgaggcaggagaatggcgtgaacctgggaggcggagcttgcagagagctgcgatggcaccactgcactccagcctgggcaacagagcgagactccatcaaaaaaaaacaaaaacaaacaaacaaaatagcatgagaaagctgaagtgagtgtgtaacccagagcgacgaagtggagcgtgttagtgagagaggagtcagcgtgccccgagagccggtgggcgaggccacggagggagggcgccaatgcaggaggaaggcgtgctctgccctcttggccacggctaccctggggcctccagactacaaatggttacctgtccacaatacttatggaaacggaggctaaaaagttacagcgatttgacacagtaaatgtatgtctctgtaatctaataataaaaatccgggaggtatattctacatgtctttttaattctatttttctagaaattcattctttgttgtattttacaaaagcagtgacctgtgatgggttgggaatgtttcagaaactggtccttcactgcagacggtttgaaacgcactcctcaggatgccaggggcccatccaagttttctctttttttttttttttttgagatggagtctcactctgtcgctgaggctggagtgcagtggcgctgtctcggctcactgcaagctccgccttctgggttcacaccattctcctgcctcagcctcccgagtagctgggactacaggtgcccaccaccatgcccggctaattttttgtatttttagtagagacggggtttcaccgtgttagccaggatggtgtcgatctcctgacctcgtgatccacccacctcagcctcccgaagtgctgggattacaggcgtgagccaccgcgcccagccaaggcccatccaagttttctaacagatgtcatccaaggcatctgcttctcccaaaggagcacgtagaggagcctgcaggggacagaaacagagagccaccatctgggtgggagccagttgaggtctgacctgcactgaggctggtgggagcgaagacccctggaaggagggcccagggcaggggtttctttttccaccagcgccttaacgacgtgagggcttccgtgtgaaaggaaagttacaatgaactggacttataggctctaacgtactcaaaagcgcctcccctaacctcagacacacatatggaataaatcttggattccagtatgtgggccggatggcattgccactcctgatataacctcagcataaatcctgccttcctgaacctctacgtcccatcagggcactttctttctgcctacgaaacagctcttccacctccctcctccttgccagtccccttctcctccctcccatctctgccctcatgctgaatgactcctgaaggccagagggtaattccaaagtaactcagatctcaccactccctcactcccaaacctctcatgactccccattgtctgggaacaaacagcccttgagcagggcatttaaagcccagtgcatgtcatcccaccccacatttcaccctgaacaccacctctcccaccactcccctgccccagctgtcctgctgagtgttccagagtcacttttgcacttttatttgcctttcctgcacagctcactctgtgactatgaatttgtacctgttgtgttgggcaaattccgcaagaccactgctctgaacccgaggcggggtggggaaatcttcaccactcactcactctagggctgggtgcccgcctccagcctagcttccatgcaatgcttcatttgggggttcagtcttagcaaaggaaaggaaaggtcaggaaagggcacgaagaagcttccatctgctgggtttcttgcctatgtcctcaatgcctttcatctgacttaattcctgtgacaacccactgaggaggtgtttagccacctttgcagtggaggaaacaaaagcttaaacagctttactcttgtgcccgaggtcacacagtaggaaatggtagagccaggatttgaacctaggcctctctgattccgaaacctgcttgtaggtactaaacatattgcttctttttcatcagatgagactgaaaaagagaacacccatattccaggactggctctgctagaaatcagctcaccttaggaaggtcacttcatcttgctagccaagcttcctcatctgtaaaataaggaggtatatgttttgccaaattccttccttctcttgcattcttttgctctgagcaataataatagctcgcgtttgttaaggcttattacacgcctagcatcaagctaagagcacttttatatgaattatctcatttggtcccaccacacccttatgattaagtgcagttagcactcccctttggcaaatgaggaacctgtggtttggagaagctcagcagcatttccaaggtcacacagttgagaagcaggggaaggacattctagttcagacgcactggctctggggtccacactcttattagcctgcctggcttccacgacctcagagtgcaggcctggctgcttcctccatctggggaaaacagttcagcccaccctgagctcacttgtccagggtaattcccggccaccaggcaggtctctgaaggccgggttccccagggctgggtcagctaccctcctgtgggctctcactgcccacagactcttagggcaggaactaccgtgtgtctccagggcatagacaacacactgtgttgcaaaaggaaaagactttctctgagagcagcccttgctggggaaacattaaacggagggctgctgtgtttcacctctactggttccaaccggctgaagtagcccaggatctcgctaatgacttttgtgaccagcgaaagggcagtgggcaatctcagctcgctgcaacctccgcctcccggattcaagcgattttcctgcctcagcctcccgaatagctgggattacaggcacgtgccaccaccattagctcagctaattttttgtatttttagtagagatggggtttcaccgtgttggccaggctggtcttgatcgcctgacctcgtgatccacccgccttggcctcccaaagttctgggattacaggcgtgagccaccgcgcccagcgtatgcggcttttcttaaccaagcttattgagacttaaaggcctcattctgtcctacccagcttgcatgttgccaatccttaattagcataaccactgagaaaaaccattttttaaaattatttaaaataaaaaaaaaaaacaagcaacaacaccaccaaaatcaaaaccctaagtttttgcctcccagaaaacatgtcagtaaatttcttcactggtatattcccttgtctggccagtaaatcaactcagcattgttattatcactattattactgctataatatgtatttatgtatggttctgatggtatttgttttattctttggcaacacataataagtttaataaatatttgtctggccaggcaaggtggcacactcctgtaatcccagcactttgggagggccaaggtgagaaatgtcaggcctctgagcccatgctaagccatcatatcccctgtgacctgcatgtatacatccagatggcgtgaagctactgaagatccacaaaagaagtgaaaatagccttaattgatgacattccaccattgtgatttgttcctgccccaccctaactgatcaatgtactttgtaatcttccccacccttaagaaggttctttgtaattctccccacccttgagaatgtactttgtgagatccaccccttgccctcaaaacattgctcctaactccaccgcctatcccaaaacctgtaagaactaatgataatcccacctccctttgctgactcctttttcagactcagcccgcctgcacccaggtgaaataaacagccttgttgctcacacaaagcctgcttggtggtctcttcactcagatgagcgtgacaagaaaatcacttgaaaccaggagttcaagaccagcctgggcaacatatcaagaccccgtctttacgaaaaaaaaaattaaaaattagcttgctgttgtggtgcacacctgtagtcccagccacttgggaggctgaggtggtgggatcacttgagcccaagaggtcaagattgcagtgagtcatgatcaagccatgcactccagcctgggtgacactgctcttctcaaaccaccaaccccctacctcctacttgacagattaaatacaatccttaggtaggagccctttggcttctcctgactggctagaagtctcatgacatctgcctcgcacccaatctgcttccctcctcctaagccaaaccctgcctctgagctttgatggcatccatctgccttcttagtgagccttgcgccatgtccacctggctccttcttgaatattcaactacatcctctcaccggatctgtctcacagaccaatatgcttaagtctctcacttcttaaaagaaaagtataaaccttcccttgaccctcttactcctctccagctaccatttcacagtcaaatctcttgagaaaatggaaaacaaaagtcaatgagggctgggcgcagtggctcaagcctgtaatcccagcactttgggaggtcgaggtgggcggatcacgaggtcaggagatcgagaccagcctggataacatggtgaaaccctgtctctactaaaaatacaaaaaaaaaaaaaaaaaaattagctgtgtgtggtggcgggcgcctgtagtcccagctactcgggaggctgaggcaggagaatggcgtgaacccgggaggcagaacttgcagtgagccgagatcgcaccactgcactccagcctgggcaacaaagcgagactctgtttcaaaaaaaaaatacaaaaattagcaggtgggcacctgtaatcccagctactcaggaggctgaggcagaagaatcgcttgaacccaggaggtggaggctgcagtgagcagagatcgcaccactgcactacagcctgggcaacagagcaagactctgtctcaaacaaaaaaaaaaaaaaaaagtcagtgagtacaaaaactccctctgtttcctcctgccactcccaggcagctttgacctctgtggcccattgaaaggatgcttgccagggtcactgatgacttccatgttgctaaatgcaacagacacttcccagttcccctcctgacttctcagggcatcagacactgtgggctactccctttttcttgccacactcctttgctttttgtcccacactctcctgctctgcctttagctctctggggttcttcatggactctctggctgggcagtcttccggggccagcccatggctttaattaccatttgttttctaatggctgtgaaactcacatcaccagctcagctctccccttggagctccaaatccccatatccagctgcttcttgatttctgtatctcgatgtctcaaaagtcatgtcacacacaagactgaattcatggtctttcctgaccttccacaccaagccagatctttgtccaatattttatttcttgggtgatgacgttaccaatcagccagaagtctaggatttttctttgacagcccccctcaccctccatatccagcccacccccaagtttctccttcattccccgccccccgctccatattcagcccaccccaccccccataatttgtgttttcctgatgtctttgaacaggtccagttctcccttctcctctggcaccattccggcccaagctgtcagtcatcctcctcccagactatagcagaggcctcctcgtggctctttcatatctatcctgcactctccagcccattctctttgctgcagccaaagcaacattttgaaatagctgagaacacacacacacacatgactttggttgtgtgtgttttgaataagggctaaaatattaaccctggcctacagaccctgcaccatctggccccccagcctctccagtgtcatcttccatgtcccaccagctgcccctgcttccctgtttctgctccagccacatggcgccctccctgtgcagggcctttgcatggtgttctgagtgcactgccctggccaccgccctttgcttggcttgggttgtgtctacgtttgtgttttcagcaaaacatcccctgacccccatgcaggccaggtctcattccttacagaagccagttttcttcctttagagccctgatgccagtttgtgaaacacactcgctaacgtagggatccgagtgatggactgatgtctgtctccttccagcaggctgttcactctctgagagcggaggtatctattctgctcactcttttatcccaaggtgttcttaacatggcaccccgaagaatgtaggccctcaggaaatatttgtcaaatggtgactgaagtggagagagagagagagggcaatgaggccgccgcttgtgagggctccaagtgttcggagggagtggattgtgcctattcagtcacgcacctttgtcacttgggaaatggctggctctggccttgcacctagtgggggcttcataaatattggcaggattgaattgaactgagttgacgcactcaccagctccactggaaaatgtgtctcgagctagcacttactgagcatgtaaaactacgggtcattatgctgaatgcttctcatgtgttcacccatttaatcctgaagacaccatgagatgggcattactgttccatttttataaacaaaggaaccagtcaggggccctgtgggaaacagatggcacactcaggatgatttcaggagaatttcacaaaggaatcctccacaaccatgtggacgggggtggggggaagaaaggcataaggggctgcgatgcctcagggctcacagtgactgctgggggcttcactgctacccctacgcttgaagtttgccagaaccccacacagagagggcagagtggaggagctgcctgtcaggagccaagatggcaggtcgagggctgtggccagtccaaggtacccctgagggcaccagaataaagtgtccagactcgctttccctctgaggctgtgcactgactgaacccagctggcagccctggggcaggggaacccttgatgccgtcctgcgggtcagcctcccagggcctcgagcaggtggagaaggatggaaaatggacctggaggtgcaaacaaccagcacaagtcccagagcacagtcctcagagctggagcccctctccaaggcccatcaagagccatctccatagtcctccaagaggactgctgtccatgtaccgccttcttggaacagaaatcagagaagtcagagttcttctccatgcgagtactgacgagtgggtgcgctgagactgagtcattggctagagcaggaactggtgggcagtgatgctggggaaggaagtacagagaggacatgtcaggtggtcaccagcccagcaactccccatcacatgtgcctcagcacgtccagcctaagggagggagggacagtcgacccagaccttgtcagtccacaggctggaggtaattgaaatccagccactttgatggcaactgctatggccctagtcctgtactataaagcagatcatctgagaacaagagagctcacccaatgtccatttcaccttgaataaaatctggaggctgtggctctgcttaccctcaacagtcagctaggggcacttctccaatgacacaccccatgtccttagacttcctcagtggctcaatgtctaacatgaggaagcgagaacatggacatcccaacgcttgtgtaattgtaacgactgtctgcaaagcacttcagtgttcccaaatggaaagattccccggaagtagaaagagctattattgtccattatgagcattctttctagaatcttcttctttctaccctcaactgtggctttttagactagcagacatctgccaaaagccactaacccagagacactgattctatcaaacagcacagtgggacagtcactctcccaactttctttctttttcttttttctttttttttttgagacagagtttcgctcttgttgcccaggctggcgtgcaatagtgcaatctcggttcaccgcaacctccacctcctgggttcaagcgattctcctgcctcagcctcccgagtagctgggattacaggcatgtgccaccgtatccagctaatttttgtatttttgggagagacagggtttctccatgttggtcaggcttgtctcaaattccccacctcgggtgatccacccacctcagcctcccaaagtgctgggattactgtcatgagccaccaggcccggcccccaactttcttaataattaaatccaatctcttgctagacagacttttttgttgtagtgccaaggctgcttgaaattttcattttgctgtctaatttgcataaacttgtaatcaataagtttttgccctatacttggcccctactcctaccgtagtaaaatattcgatgcatatttttcatggaaatattgaagaaacatacattctcagacaagaaacatcaaatgtggccattgcttttgtaccactcaatatgcaactcagactggttgaaatttagaccaaatggtaacatccagaagaagataggaccacagagctaaggagggctgcagtgggctgaatatggtgccactgcccacagtgtccacccagaatctgggatggtggccttatttgggaaatggggtctttgaagatgtaatcaagtgaaggctgttgccatgtgatcatcctgaattacccaggtgagccctaaacccaattacaagtgtcctcacaagagaaaggcagagagagatttgaaacacacagagcagaaggtgatgtggaggtgggacagagacccagcgaagcagccacatgctgaggagcgcctggagctggaggaggcaggagaggactcgtcctgagccgtcagaggaaggacagccctgccgccaccttcatttcagactcggcttccagaaccgcaggaggacacagttctgtggctatgaaccacccgatttgtggtgcttggttatggcagccacaggaaatgaatacagaaactattcaaatcccctggttgaattcctttattttacagatgagaaaaataacagcattcgcaagcgacacacagtttatgaaatgttttcacagagtgaccatgttcagtcttcatagcaattctgtgaggtggtagtttctgcctgttaaaaggaaaactgaggcaaactacatttaacagagtttaattgagcaaagaatgatatgggaatcaggcagccccctgaccagaagaggttcagagcgtctctggtgctgccgtgtggtgagagtctttacgggcagagaacggaaagtgaagcacagaaaacagaagtgaggcagagaaacagcctgattggctacagctcagcgttggccttactcgaacacagttggaagacttggccacctgtgagtggttgaagtatggttgcttgtcacaagagtaggttacagcccctttcacatccagttaagtgacagttccctttgtgcagagaagcctttagccacacaggtcccaaatgtaacataacatttgttacacttaaaataagtaaggaggcagctgtaggctaaatttaacatgcctgggaggagggaactgaagctcaaaccagaagcagcagatagatgggtctgcaaatttcatgcgttttccaccagatctctgcctgtggctcagagaggtgtggcagcacagctacctcacacagctgctgagaaacaggcttggatacaggtcttttttttctccccacttttgcttcagatctctacccaggtataacgagctgcatctcaaggtcagaacgactgaacaataaagaggttggttcaacagatgacctcaaaactcataacctacatcccgaagctaaagaaaaacttacgtctccaaaaagaggtgtagttagctgcaggttatttgaatgagcagcacatgctgtgcatttgctttaagattctccaaacacgcagaaagccaagctaatcctcagcgctcccatgccaatctggtgtggggaccctccactccaggctgccttgtagaatgccttattgatgtgcggcaaggggcaccccatgaaagtcccaacagctctgaaggtaatgagcaaataatccagttgagcaagcaatcaaagaacaataacaattgtcttgtgacaataccccccagtttgtaattagttagcttaaattagtttaaattcacttcatttggaagattttgcctctgaggcaggccaaggctctctttcagaggccaattagattaaattagaagtggcacattagctggggagacttcattcattttgggtttttgcagccttaattatgatgcagacacagctggagtcatcctttggagggttttcttgcttcagcaggcactggaggcgactggattcctgggagaggtgctttcagtggcgtgtgtggccaaccaagccacccaaggctactttgtcaccagattctgctcttggcccattcccccagctgctgtgggagagtcacaggaagtgaggaatcctaagaagatcttcctttttcaaaacagcttcatcaaggtgcaattaacagacaagaaactgcacacactgaaaatacacactttggtatgttttcacatgtctatacccatggaactaccaccacaatcagaataataagtatattgaaggaaatgaaaatatttcactccaaaatatactttttggcatattttaagatggctattcaaaagggctagaaatccaagaatagctgaaaagctgtcttgctgggggaggtttgcgtccatagagaccatctttgtgagccaggcctcctcttctgcccctgccataagctgatttgtcatcttttttttcttttcttttttttgagacggagtctcgctctattgcccatgctgaggtgctgaagtgcagtggtgtgacctcggctcactgcaacctttacctcctaggttcaagcgattctcctgtctcagcctcccgagtagctgtgactacaagtgcatgccaccacgcccagctattttttttttttggtatttttgtatttttagtagagacagggtttcaccatgttggccaggctgctctcgaactcctgatcgcaggtgatccacccgcctcagcctcccaaactgttgggattacaggcgtgagccaccgcacctggcccccccgacttgccatcttaacccactgtgggccaccctcagatcccctgttctctctgtaacctcgaggagatacacaagcttctgcacccgtgggggttggggtcatctttctgtgattttccctccatgcacgttgataaatttgtatgctgtttctagtattagtctgccttttataaattgatttttcagcaagtttttagaggatgcaggggagctttttcccttggtccctgcaatatctatccattgcccccagaaatttcctcgtgtaattttgtcatctctccctccaccccttccctctcacacagactcgggcaacaactggtctgcttttgtcaccatagactactttgtattttctaggattttatataaatggaatcatactacatgtactctttttttgctctttcgcaaagcataattgagatttatctatgttgttttgagttatcaataattattccctttttattgctaagtagcattctatcatccagatatactacagtctgtttatgtttatcgttgagaaatttggaccttttctaggttggggttatttcacataaagctgcagcagacatttgtatacaagtttttgtgtggacatatgctttcatttcttttgggaaaatacctagtagtggaatggctggtcataggctgctatatggtgaacgttttcagaaactgccaaacttttccaaagccattggaccattttacattcccattagcctgggaccattgttacaggttcccaggtgatctatatcttcccaacacctagtatgattagtcatttaattttagccattctaataggtattaactaaggttaccctaaagctgcctccatacatagtttaagttgggccttaatttcctctgtacatagtgaactataacttaactggatgtgtaaacagactataacctactcttgtgccaattatcaaattgcactcaattttctttttctataattcctctccaatcacgtggcagccaccagcgttattctgacctattctggctcaggaggccacacagttcatgaatcgttctttgctcaattaaactcttaaatttaatgtcttaagtttttattttaacagtcgtagtggttctcattatgattttgtgtgtgtgtgtgtgtgtgtgtgtgtgtgtgtgtgtgtgtgtgtgtgtgagatagcatctcactctgtcacccaggctggagtgcagtggtgcaatcatgggctcgacctcttgggctcgagtgatcctcccacctcgacttcccaaagtgttgggattacaggcacgagccactgtgcccagcctctcatggtgatttttaatttgcatttctataatgacaacgatgttgagcctattttcctgtgcttgtttcccagctatgtagcttccttggtgaagtgttcattcaaatcttttgcccatttaaaaaaaatgggttggttgggccaggcgcagtggctcatgcctgtaatcccagcactttgggaggccgaggcgggtggatcacaaggtcaggagatcgagaccatcctggctaacatggtgaaaccctgtctctactaaaaatacaaaaaattagctgggtgtggtggcgggcacctgtagtcccagctactcgggaggctgatgcaggagaatggcgtgaacccgggaggcagagcttgcagtgagccgagatcgtgccactgcactccagcctgggcgacagagcgagactccatctcaaaaaaataaaataaaataaataaataaataaataaataaataaataaaaattgggttggttgttttcttactgagttttgaaagttctttacatattctgcatacaagtcttttatcaaatatatggtttataaatatttcctctcattctgtggcttgtccttttattctcttaacagtgtcttttgaagagatgaagtttttcatctttttttttttttttttttttgagacagggtctctccctgtagcccaggctggagtacagtgatgtgacttcatctcactgcagcctctacttcccaggctgaatcattcctcccacctcaacctcctgagtagctgggactgtaggtgtgtgacaccacacccagctaatttttaaaaaattttgtagagatatggtctcactatgttgcccaggctggtctcaaactcctggcctcaagtaatcctcccagttcagcctcccaaagtgctaggattacagatatgagtcacctcacctgacctgaagttcttaatcctgatgaagtcaaatttgtcaattttttttcttttatgtactgtgttttggtgttggatctaaacaaaaacactttgcctagcccagggtcataagacattttcctgtgtttttgtaagagccaagggaaagattccccttcactctgtgaagatttactagcaaatcaactgacaaaaggcagactaattggagaaagcgcataaaaatgtattaatgtgcacacaggggagaatcagagagtgatggccccatatgccattggggccaatgtatttatatagccttatttcaggggggtgaggggagatgggaatataggtgattgtgttgaggggtaataaatgattactagggagaatgaatggaaagaggaacagagattaacttgtgaatgagttctattcaggtgtgattgggtcctattcaggtgtgggtacattcttggttgtttttggtcttgctttgtcaccccagctggagtgctatggcacaatcttggccttgacctcctgtgctcaactgatcctcttacctcagccttctgagtagctgggtctacagatgcatgccatcatgtcctgctaatttttaaattttttttgtagagatggggtcttactacattgcccaggctagtcttgaattcctgggctcaagcaatctgcccaccttgacctcccgaagtgctgggattacaggcatgagttaccgccttggtcttgttttctgcaacagataataagataatagggagggggagggaacaacaattgttctcctgatgggtacatctagtctttatgaaggtaggagaaagtctcttccggatcaaaggtctgttgacctctaagggcctttaattcaaaatactcattataccaggaagccatatttcagggtaaagttctctgtactccttcattctagaaattttacagttattttattttattttattttattttattttattttattttattttaagacggagtctcgctctgtcacccagactggagtccagtgggacgatcttggctaactgcaagttccacctcccgggttcacgccattctcctgcctcagcctcccgagtagctgggactacaggcgcccgccactatgcctggctaatttttttgtatttttagtagggacagcgtttcaccgtgttagccaggatggtcccgatctcctgacctcgtgatctgcctgcctcggcctcccaaagtgctgggattacaggcgtgagccaccgcgcctggcaaaattttacagttttagatttacctctaggtctatgatatattttgagttaatttttatatatggtgcaaggtatggatccaagttcaatttttgccaatgtagatccaattgctccagcactgaattgcctttgcacctttgtcaaaaattagttatccatatatgtgtggatctgtttctgatttctggactccctattctattccatttatctatttgtctctctgtgcaccaacaccatatgttttcactattgtagctttaaaataagtcttgaaatcaggtagtgttaatccccaactgtttcccaaaagtcatttgagtattctaggttcttaagttttcttgtgaattttagagtcagtttgtcagttcccacaaaatcttgcaagaatgttgactggcaatttgacgcctgaatatgtataagttttcatttatttaggtattatttcacttctctcagtgatgttttgttcatatttgtttttgtttttaaagactaattggagaaaaggcataaaaatgtattaacgtgcacatggggagaatcacagagtgatcgctccctatctcattggggcccacatatttatacagccttatttcagaggggtgaggggagatagggaatataggtgattctgttgaggggcaataaatgattactagggagaatgaatggaacagggaacagagattaacttgtgaatgagttctattcaggtgtggttacattcttggttgtttttggtcttgtttgtcaccctggctaggatcttgctctgttacccagactggagtgcagtggtgcaatcatagctcactgcctcaaactcctgggctcaagtgatcctcctgccttagcctttaaatgcattctaacctctctcctgctagaattacccccctagagccagggcagtaggcaactgagaagaaattttctaactagcaaagaggcttgattttctattgtgttagttttgctgacaattcctatgtggtagtttttctcaaattctactgtgcatcagaataatcagagaagggtattctaaaaacagagattcccaatacaccctctcttcaaccaatgaatcagaatccaggaaatctgtagtgtatttttaggccactgttcagaagattctgatatatacttatgtctagaagcctctattatagagaattcttggggttcaggcacttggaaattcattattacattgtaaaactaacttcctcagtattaatattatttcttcttcctctacttaggctcctgggtttctcagctctcttttaaaggaaaccaaaaatattttatcccaaaatatacttctttgtcatactttggggtggctctttggagggcctgcagacaggaatagccctgcaaagctaccttttgtggaagagatttgcgtctgtaggaaaaagtctgcactggtgaaataaacagccaggctttctctgaggccccacccattctttctgagagcagctcagtgattacctgagcaatttccacgtgcgtaacatgagagctttggtgtgagcagcgttcctcccttcgctcccctcaacctgtgaccccacctcccgagaaatgtggttccaggccattgttctttgggctctcccatcttccctgaaaatcgtttatttctacacctccttcatctcccctctttccaaccaagaggatatttaagcatcaaccgtcttgccattctttgagttttcgtattttgtgtgactcctgtgcatgtacgtgcacgttaataaaatttcccaccaatctagtctcagtgtgttttatagacccaaattatcaaaatttcaggggaaaaatttaaacttccctacattccctaggaaagcagattttcaaaaattatttccaagtgttgttttaggaataccttatatgcactttccttccaagagataattacatggtcaacagccaccatgcctaggaggccctgtgaccctgtcccaccccacctcagccaaagttcattgactttgggtgcaaatagccaaaggcagccttgagctgactcaagtacactgagcagtgacaaagtcacagagcttggcttgctgagagccgtggagatgacaaagtcttgaagcaatggaggtcagatgttcgtgctgacctgtcaacaggtgggaggtggtagcggctagatcatatacagcaggagggggcttgttttcctggaataaaaaaaaaaaaagccagacagcaaatatttctgtctttgagcaccatactgtctctggtgcaccatagtctagtgttgccattgtggtgtggaagcagccatcgacagaacataaaagaatacggacggcatggcagtcacagtcagttgacttcattgtagagccttatgggccacaatgaggtatttggatttattctattggcaaggagaaggcactggagcattatacaaggtggggtggagggtaattagatctcacttacacttcaaaaattataatcttagagctgtaaaaataccatggtactaaaggagtatttttatcccttgtgaaagaaagccaaattgtaagctttcaggaccagccagggtaatcttcaatttacgtctccaccatcttctgagttttatcttaaagtaggtgtaagatagtcatcctaacattaccatggaattataaaaccacagggttgggatgggtgcggtggatcatgcctgtaatcccagaactttgggaggccaaggcaggtggatcacctgaggttaggagtttgagaccagtctggccaacatggtgaaacccggtttctactaaaaatacaaaaacattagccaggcatagtggtgggtacctgtaatcccagctacttagctggctgaggcaggagaatcgcttgaacctgcaaggcagaggtgacagtgagccaagatcgcatcattacatgccagcctgggcgaaaagagcgaaactccctctcaaaaacaaaaaacaaacaaacaaaaaaccccaacggggttgcaaaggcctcgagagactgtctcattcaatcaccagccttccaactaggtccatgcctcaatcaactcagagatgaaaacccaaatgatgtgccaatgctgagcctgaggatgggttctgctcttccctgtgtgacaggaacacccacccccactctgatgagaggttagaaaataattctgctttttccaaagagattaagcaataacaaacagaaacaagaaactaaaaaatcttgggtgcctttggactgcagaacttacaatctctctaaatcccaactctgactcttcaaatctaccatttgactttttccattgaagtgagttgatttaattctagtgcagccacaaatgtagatgaagcacccgggaaccacatagcacatcgcgggatgcagacaggagttactgacacagacgacaggtcccaaagtagaaaattaggtctcttaaaaatcattttaagggagattataagcatggaaacatgatgtctacgtattgttaagtgaaaatagtaatatactgtctgataacatttctgtaaaagaacagagagagattggaatcatcttgaaattaaagatttctgcgaaaaaaacaagtgtccaccagtatgtacagcattcttcaacttatgtttttaaaatgctgtgtataagtgattgaaaaatcatatcacagggcatacaatagcaagtttaaagcacgtgctattataagacaaggcaacatggtaagaaggagggagatggaaaaaagaaaaggaaagaagtctgtctgtggtatggccagaggggaaagaaacactgggagaaaacccactcatcctggtctttcctgccactttcagatatcctcctggtagctttgctgtctcagtcctgtactgacaaatgctggtaatgggactgcatgagagcagtcatactctgaggaatccaccggcttttaagtgtggttccattacaggattatgtggcgccacgaagtccaatacccaggaacagaggatggggaatgtgacccacagagctcaaacaaaatgacaaaggagaccacttgggttctagggcagcagatcacatttgcttcttccaaagaaccagaaagctttttaaaaagcaaatggaataaagatgtggatgaaaagttttctccctgggataagtggatggggaggaagaaaatgaaaaacaggtaaattgctgaagaaaaggcagtatagtgaaaaaatcaacatttaagaattaattatatgccacttttcaagaaataagcataagacaccagaaaaatacgaatttagtgaaggtcgaacaaacacttttttcccagtggctatgaaagagagaagcaagcatctttaaacgctggcaattatgcagatggcagaaagaataaagactgaatttcattcccacataagggagagtataagggagagtattagggagacaaaaagcaacctgaagcgtttacagttttgagtgagcggacagcccagcaagcatttagaactcattatctgagctgtgaaaaatgaccctcagaaatcactgaaattaatcaagaagttaaacatttattaaaaacaagcttagagattataggagaaaggtcgagtccagagactccaacaaagctgaatcagctgatttctgggctgtgaaatgtgtggtgctcaatttagggcacaaggttcagatgcaggtaaggcctctggagccccgtcgggccggacctgagcctgcatatggggaaatcgctgttgttgtcagccgctcttgcaaaaagctgatgatgtggctgttgaacaacctgggacccttgaccctgccatgacgtttgtaccaatgtgggtgtctgggtgacattcaaaattaaataaatcaaacttaaattaccaagttctagactccaatgtccagggaaatgccacattttgctgtgggcgacagaattttgccccctccacgctttttgtcataagggtcaaataaacaggatcattgaacagacagagtgggctctgatgtgcttctcagctggacactgaacacgggcagtactgtagtgatgtccccaggagcgattgtgcaggagtgaggtggggcagacggcttttcctgctggctgctgagttggtgccatatacatctctgctgcccgaggcaggagtaacattgagccaataccatatcctgttgaattttgccaaaatgagaacgcacagaatcctcagatggtcaagtgggagaaacaaaaagaaaaatgttctgtcctcctaccttggtctaattatttactttctttcttttttttttttttttttttttttttgagacggagtctcagtctgtcgcccaggctggagtacagtggtgtgatctcagctcactgcaagctccgcctcccgggtccacgccattctcctgcctcagcctcccgagtagctgggactacaggcaaccgccaccacgcctggctaatttttggtatttttagtagagacggcgtttcaccgtgtcagccaggatggtctcgatctcctgacctcgtgatccgcccgcctcggccttccaaagtgctgggattacaggcatgagccaccgcgcccggcgatgtttagagtttttttaaaatcaggttacaaaatggtgtaagccaaattaaaatgtacagagaaaccaaaagaggacggcaacatgcctcagtgaaatagtgactgcatctgagtagctgttttttctgtttcttcagactttgctgcacttccccaatcctccataatagcaacagcagaagcacagcctgtggggctagccttgctttaagcattagctgctgttattcccagcgttgttactcgtatcatcaaaagttgataaactgaaagctgagaaaaagaccaaaggttagagggaaacatttagaaatgtgttagagacttgtttttaaagaaacttttaattttgaacgaattttaggtctacactgcaaagataatttagagagacccttccccccgtcccggtttccccagttgtgaacatcttacatcaccgtagtacatgtgtcaaaactaggagattacgactggtacatgacttaactaaaccccagacttcgtttgaaatttacttgtttggctgggcgtagtggctcacacctataatcccagcactttgggaggctgaggcaggtggatcacttgaggtcgggagtttgagaccagcctgaccaacatggagaaaccctgtctctactaaaaatacaaaattatcccggcgtggtggtgggtgcctgtaatcccaggtactcaggaggctgaggcttgagaatcacttgaacacagggggcagagtttgcagtgagccgagatggcaccacttcactccagcctaggggaaagagctaaactctgtctcaaaaaaaaagaaaaaagaaaaaaaagaaaagtaattcacctgtttttccacttagggactctttctgttttaggaggatgagatttttgaatgttaactaatgtccccctttttttatattttaattgtgaaacatacgtagaagttcataaaacaaaatgcactatttaaaggaaaatgaaaagttcaaggaatggaatgatgccagtctcctggtatcctttttctgactcgccacccagaggtaatcattaccctgacttttatggcaataatatccttgcttttcttggtagtgttactgtccagctataatctcctcagtaaagtagttgtgcctgtttttgaactttatgtacatgaacgcatgctgtatattcttttgttcaaggttatctggttgttgtgtggtgtgtgtgtctatggctcattcattttcattgctgtgtggtactcgactgagatgctctttgatattttctcctgctccctgcccttccctaatcaaatagaccttctgcctccatgtcccagggatggcaatataaccacagaaaatcaaattaaaattatttattattatttcaaaagcccacatcctcacggatttaaacgagatttatagcaggatttctcaacctccaccctattgacgttagacctaataattcatttgttgtggggatgtcctgttcagtgcaggatgtttagcagcttccctgggctctaccactaggtgccagtagcatccacggccctccagttgtgagaaccaaaatgtctccagatattattgccaaacatccccagggaggcaaagtcaccccagatgagagccactgtgagaagaaggaaaggaaaaaatcagttggggaaaatgcagactgcagaagcaacctgcctgaaaagttacagcaacaggcaaaaatgaaacaaccttggggaaaaaaaaaaacaaaaaacctcaggctgcacctgcgcacagataagcaacttagtgagctcccaggaaaaaagtttcttcccttttttcaggcatatatacggtggaaacttgcacagatggggagggggcttacctaaaacaaacccacagttaatacaaactagaaaagcagaattcgtgatggcctagagacatacccacggctgcgtaacagaaggggaattgcacagacagctttactgataagagaagtgactcaaactgctagagataagagtttctgataaaagcttttgaactcagctgtaaccccgcaatccactcggaatcctctctcctctgcagagagcgttttttctgtcactttttttttctttttccttttttttttttttttttttttgagatggagtctctctctgtcgcccaggctagggtgcagtgccgcagtctcggctcactgcaagctccgccccccgggctcacgccattctcccgcgtcagcctcccgagtagctgggactacaggcgcccgccacctcgcccggctaatttttttgtttttgtttttgtattttcagtagagacggggtttcactgtgttagccaggatggtctcgatctcctaactttgtgatctgccctcctcggcctcccaaagtgctttttttttttttttttttttggagacaagagtctcgctctgttgcccaggctggagtgcagtggtgcaatctcgtctctactccaatagaaatgtaattggtttttgtatattgatcctgtatcctgcaaacttgtacttgttactagctctaataggtttttttggtttgtctttgtgtgttctttggattttctatatacaaaaccatgtcatctgcagatgcaaagaattttgcttcttccttaccaatctgggttccctttatttctttttcttgactaattgttctggttttattttttttttaacaattttctcttaagcttctcttctgccaagccatggaatcatgttagtagtcagtttgggatcttccctgctttcctggagttgtgtctaattttttttttttttttttttttgaggcggagtctagctctgtcgcccaggctggagtgcagtggtgcgatctcggcgcactgcaaccgacgactcccgggttcaagcgattcccctgcctcagcctctggagtagctgggattacaggcgcctgccaccatgcccagctaattttttgtattttttagtagagatggggggctgggcgcggtggttcacgcctgtaatcccagcactttgggaggctgaggcgggcggatcagctgaagtcaggagttcgagatcagcctgggcaacacggtgaaaccccatctctactaaaaatacaaaatcagccgggcatggtgacacatgcctgtaatcccagctactcaggaggctgaggcaggaaatcgcttgaacctgggaggcggaggatgtggtgagccgagatcgcgccattgcactgcagcctgggcaacaagagtaaatctccgtctcaccaaaaaaaaacaaagaaaacaaaaaaggaaagaaattaagaaaacaatccaattcaattaacaataacatccaaaagaatgagatattgaataaatttaacaaaagaaatgtgagtcttggccgggcatggtggctcacacctgtactcccagcactttaggtggccgaggcaggcggataacgaggtcaggagatcaagaccctcctggttaacacagtgaaaccccatctctactgaaaatacaaaaaattagccaatggccgggcatggtggctaacgcctgtaatcccagcactttgggaggacgaggcgggcagatcacaaggtcaggaggtcgagaccacggtgaaaccccgtctctaccaaaaatacaaaaaaaattagccaggcgcggtggcggacgcctgtagtcccagctacttgggaggctgaggcaggagaatggcgtgaacctgggaggcagagcttgcagtgagccgagatcgcgccactgcactccagcctgggcgacagagcgagactccatttcaaaaggaaaaatattagccaagcgtggtggcgggcacctgtagtcccagctactcaggaggctgaggctggagaatggcgtgaacccggaaggtggagtttgcagtgagccgagatcgcactactgcactccagcctgggcgacagagtgagactccgtctcaaaaaagaagaaaaaatcaaaagtgtgagtcttgtttactgaaaactatataatatttttggaagaaactaaagaagaattaaatagaaagacatgccatgttcatagattggaggataacatcattaagatgataatcctcctcaaattagtcaacataatccctaacaaaagcctacctgctttctatgcagaagttgaaaagttgatcttaaaattcatatggaaatgcaagagacccagaatacacaaaacaggcctgaaaaagaacaaagtagaaagactcacatttccactccaaagctatagtaatcaagatgatgtggtgctattgtaaggatagacatagtgataaatggaataaaattgagagtccagaaataaaccattactttcaggattaattgattttcaacaatggtgataagacaattcaatgaggaaagaagagtcttttaaagtaaggatgctggggaaaccacacacatccatatgcaaaataaaaaagttgaaccccccacctcacaccacatacaaaaaaaaattcaaaatgtatcaaagacctaaattacatttagagctaaaactataaaactcttagagaaaaatacagatgtgaatctttgtgactttaacttaggcaatagtgtcttagttgtggcaccaaaagcactagcaattaaaaataaacaaattgaacttcatcaaaattttaaaattttggccaggtatggtggctcacgcctgtaatcctagcactttgggaagccaaggcgggtggatcacctgaggtcaggagttcaagaccagcctggtcaacatggtgaaaccctgtctctactaaaaatacaaaaattagccaggtgtggtggcacacgcctgtaatcccagctacttgggaggctgaggcaggaaaattgcttgaacttgggaggcagaggttgcagtgagccaagatcgtgccactgcactccagcctgggcaacagagcaagactctgtctcaaaaaaaaaaaaattaaacatttcgtgtggcaaagaacactaataaaaagtgaaaaaaatacacagaatgggagaaaatatttgtaaatcatatatctgataaataacttgtttctagaatatatgaagaactccactaaacaataaaagggcaataaaaatgagcaaagaatttgagtagatatttctgcaaggagaatatacaatggccagtaagcacaaggaaagatattcaacatcatgagccattaggggaatgaaaatcagaactacaatgagatactacttcctacctagtaggataaccataattttaaaagacagacaataataagtgttagcaaggatgtggagaaaattggaaacctcatacactgctggtggatatataaaatggtacagctgctttggaaaacagtctggcagttcctcaaaaagttaaacagagtgaccatatggcctagtaattccactcctaggtatataccccagagaactgaaaacatgtgtccactcaaaaacttatacaaaaatgttcattgaagcattattctaaatagccaaggagtggaaacaacacaaatgtccatgaatggctgaacaaatggaatactattcatcaataaaaagaaatgttacaatatggagaaagcttgacaacactatgttaggctaacagccatgtattgtatgataccatttatataaaatatcaaaaatagacaaatccatagagacagaaagtagattaatagttgccaagggctgagggcagaaggaatgaaattacagctaatgggtatggaatttctccttggggtgataaaatgtttaagaatgcagccataaaaaagaacgaggtcatgtcttgcgggaacatggatagagctggaggccattatcctttgcaaattaacacaggaacagaaaaccaaatactgcatgttctcacttagaagtaggagctaaataatgagaacttatggacacaaagatggaaacaacagacactgaagtctacttgagggtggagggtgggaggagagggaggagcagaaaagagaactattggttactgggcttaatacctgggtgatgaaataatctgtgtgaccaacccccataatacgagttaacctacgtaacaaacctgcacttgtatctctgaacttaaaataaaagttgagttttgttttgttttgtcttgtcttgttttgttttgaggcagagtctaactttgtcacccaggctggagtgcaatggcacgatctcggctcactgcaacctccgcctcccaggttcaagtgattctcctacttcagcttcccaagtagctgggattacaggcgcatgccaccacacctggctaatttttgtatttttaatagagatggggtttcaccatattggccaggctggtctcgaactcctgacctcaactgatctgctcacctcagcctcccaaattgttgggattacaggcgtgagccaccgcgcccgggctcctgagtctcctttttctttgtattatttctgcctcatgggttaccccacacaaacagccagtgaggcttctcacagtctgacctgaacctgcatcttgagttcaaatcactgccctgctctgaccttgggctagtcactcttttcggccaggcgcagtggctcacacctgtaatcccagcactttggaaggccgaggcaggcagatcaccaggtcaggagatcaagaccgtcctggctaacacggtgaaaccccgtctctactaaaaatacaaaaaattagccaggtgtggtggtgggcgcctgtagtcccagctattcgggaggctgaggcaggagaattgcttgaacctgggacgcggaggttgcagtgagccaagactgtgccactgcacgccagcctgggcaacagagtgagactccgtctcaaaaaaaaaaaaaaaaaaagaatgcctcttttggccaggcacagtggctcatgcctgtcttcccagcactctgggaggccgaggtgggtagatcacctgaggtcgggactttgataacagcttgaccaacatagcgaaaccctgtatctacaaaaaatacaaaaattagccgggcgtctttgcaggcacctgtaatcccagctactcaggaggccgaggcaggaaaatcacttgaaccccggaggcggaggctgcagtgagttgagatggtgccattgcactcctgcctggatgaaagaatgcctcatttgtggggatattttgagcattaaatgagacaataatgttgaacggcttagcacctccaaatggacagtaggtgctcaataaacttttgctattattatttcccactctgcccctggactatggcatgcatattttccctccatctttacccataatattgccttggcctagactgtctgcttctctcagccccttctctctagccaaatccttttcatccttttcaaaatttgccttaagtctaatcttaacggatttgtccagcccacagggccctttctctctcttaaatttggagccctcggctatctctttcactcattcatccagaatcacatgctgccttagaacagtcttttcactactgtatttgttaattgtcacatattttcacctaaactgcaaggtcctcgagttcaggaagctcacacaatgcttacatgttaaggcctgtgaccccacccgaagtctcagggaatatttgctgaatgaaatttgtgtccttaacagagtcaccagagaattaaggtattccattgtatgccatgaaaaaaagtaacaagcaatatgagaatacctatttttagatgttttggcttcagggtttaatttgactgtgttggcgttagatctgttctccgcaggccttggatgttttttctttaacgtgagtttcttggctgagatgaagtggggttgccactctgtagtgaaacctgtaaccgtgccattcaaaataagtgaattccctgtgggggaaagttgaaagccagcttttggaacttggatttttttacctcacagctttaaaggaacaaatctgccccagtgagacaacagatgcagttgtgaacttttgctcttggtctacatatttacccccattcctcatgagaaagggcagaaataagctggaataaatgatttccagcattctctgcattcctggaacattgttgaaatagatattttcctgaggaggccattataagcaattggacttggccactgcacagtgagtcttttgcatccaaagttacttaatttttgcttattattattgctgcagaagcatttttggatcctatcctttccctccactctcataaatttggttgaaatagctgcacataaatattggacatggttccaagtctgtcaccatacccagatgtctcctctgctcctctgtggctgatcctaagctccgcctcatctcatagatgagcaggaactcaggaccccagcatcttttcttttgtcaatcattttcttgagtacttataatgactaaggttttacattcattatctggatttttattgttgttgtttttgagatagagtctcactctgtcgcccaggttggagtgcagtggcgctatcttggctcactgcaacctccacctcccaggttcaagcgattttcctgcctccgcctcccaagtagctgggattacagacattcaccaccatgcccagctaattttttgtatttttagtagagacagggtcttaccatgttggccaggctggtcttgaactcctgacttccggtgatccacctgtctcagcctcccaaagtgctgggattacaggcgtgagccaccatgccctgcctgcattcattatcttgtttaatcctcaaaacaccccataaggaaggtcatttaatagaggacagaagtgagacttagaagccaccaaggggctagatggtgcaacccagaagtgaggggcctttggctatctgggggtgtacattggcaattggtatacaggagacaggaaggagtggggaagataaattccacctcttctgtggagtcgtaaccctcctggagaagtcctccttaggtagaggacatccattggtgactcattgtgatgctgtggccaatacagtactatgtcatgctgtgtccggagttggttccttccagtgggctcttggcctagctgacttcaagaatgaagccacgaaccttcccagtgagtgttacaggtcttaaaggtggcacagacccaaagagtgagcagcagcaagatttattgtggagagcaaaagaacaaagcctctacaccatgaaaggggacccaggcagtttgctggctggggtggccagcttttattcccttatttgtccccgcccacgtcctgctgattggttcattttacagagtgctgattggtccattttatagagtgctgacgggtgcatttacaatcctctagctagacacagagcgctgattggtgcgtttttacagagtgttgattggtgcgtttacaatcctctagctagacagaaaagttctccaagtccccactggacccagtaagtccagctggcttcacctctcaatgccacactaaccagcatcttttcttgccttacagcttgttttccctcaccttcttggccctaggtttgtacccctcatataaaataccagctctctaatcaggactccagctcctctttcttgaggacctgggtaagacagttattttattttcccaatttacacaattgagttgtgtgtaaaaatggctcattgaggcatgaagagaagaatgagcataataacataaactacaattcagaaaagcatcccaaacacgagcagtgaggaagaatctcttgtgaatgccaaaaggagtctgagtgggtgaaacaaacaattatttcacatatgacacagaaaaaggaaaatcaagttcgatgcagtccccagcgtactgtcttctatacaacttttcaaacggccgggcatggtggctcatgcctgtaatcccaacaccttgagaggctgaggcaggtagatcacgaggtcaggtgttcaagaccagcctggccaagatggtgaaaccccgtctctactaaaaatacaaaaattaaccaggcgtggtggcaggtgcctgtaatcccagctactcgggaggctgaggcaggagaatagcttgaacccatgcagcagaggttacagtgagccgagagtgcgccactgcactccagcctaggtgacagagtgatactctgtctaaaaaaaaataaataaataaaataaaaccttttcaaacttctgctttatttctgtacaagaaaactctgagctctccagtagaacaatttaggttttaggataagcacaaaataatgctttgcagtatgcaattttgttgccaaaaccatagagacatcattcaaactcccacttcttatactaaaaacaggtagtttactttgctgccaagaatcttataaaatcatcccaaatttacaaatgttatgccaggagaaaaagtagaaaagtttattcacaaaatttctttttaaaacatctctatggatagcacataaaactcaatggcttaagatgtggaaaagccattactatcatatgcgtatgagcagatattttatagctggataaaaatgcccctgtccaaagtatgaatcaacttttggcacatgtgtaagtcaagttaggccaggcgacatggagcaacaaataaaccctgaaaccgtgcctttataaagtctgatgcagttgggtgaccccttccatactgcagctgtgccatgtagaacgagtatctgccaagatcactgcagcacaggaagagacggaggaggcatgcagctctcaaacaccttcacctggaatgacgcattgagaaacaccaggaggaaacgtgaggacaacaggccattgcttctgcccgtggtgcatgtatgagggagaagtatgaatggttttgttgttgctgactaccaacaggaccccatgccttgggcgagtgagtgtgtgtgtgtgtgtgtgtgtgagattaaataaccaggagatgtgatgtgccttggcagtgcagccaccaatggatgtggatggggtctgtgctccatgtgcagcgcgagggggcagtgccacaaaagtaagagaagatgcatctgaatgtcaaccctaccccgggttatcctctgagaacacctaaggacaacagcatgctcccaaccttgattcagtatttaagaaaatgaaaatcacatgtaatccacatgcttgtagttctctcttcagtgtgttgtggcaagacactgggactgaaacaccaaggcttcagtctaggtcctgctgctcactgcacagaaagccaatcactgagacagtaagtattgccagggaagaaggcttaaatcaggtgctgcagctaaagagatgggagctcagcctcaaatccatctccctgggggacgcaaattaaaagtggacgtagcagcgaagaatgtgaccctgcatgggaaaacaaaaatgagggaggggtaaggaagaggagttggtccacaagaagctggtggtgggttaggcagtcatgacctgtgaggggtctgcagcattttccagatgctgcaatctggtgagtttccgttccttgatgcttatctgggaggtctgatgattggtttcctgagaaagaaactcaggtaagacaattgtaactttctcaagttttaagactgagaggggcagttcctggcattcactgaggctcacttccttggactctttggaggtagagctcagaaatacacattttaaacaagttctgcagagatttttatgcacaccaatttattggtaggcttggaaaactttgctaaaaatggatacatgaaaacatgagatgtcaattgcaacaggcaatggaaatgaatttgagtttaaaagttcctctgtcctgaagaaatttcagatggtaactttatttccaacttatgtgctccttaagcaataaagttttcagtgctgacataagccaagtttcttgccttttatggtaaaaacattagtgactccgtttctccaagtgcgaggacaaaaatcccagtaatccctctaattcatagcacctccacagataatgactgtttgttgtcagatggaaataatttcattagcataagtggatgcggagtttataaatgcagacgcatgtgtttcatattctgctcctatttatttacacattctgtaaacacatgtatacacaaagtcacatggacatttttaggcgagcgcctggaacactgtgcacatggaaataccgcagttgttgccttcaggactttttttgtcaggtggcaagttggttactgttcagaggatctcagttaccccattaccacctctcccaggtgaaaatgtgccctgccgcaagtcaggctctggaactttcttgaacttcctttttctcttcgaaaagtcctgtcctcttagggctctaatttattggaaaagtaattcattcccaaatattcatggtttctaatatgttaatatcacagccttctcaaataacatatctctaaatccacaatactcaaagttaatgaagagaagttcaatcaggttgatgaggaggctggattgtacactcccttctgctaacacaaaaggccttggacacacctgggatcaagtcagaatgaacctggttctggaaacacaagcttgcacagtgtagggagaggcaggtagaaaaggtggcagagctgtgtgtctcttctgagcctcccctggagaatgaaatggacccaaatgttatctacctcatcagaaacaattggtaactacaacccagtgtctcctgagctaaattagatttttgtactacatgctaaatgtaatgtgacggggaaaaaagaaagttaggtagaaatcatgctttccaaagctctctttatttaaatggtctgttttggtccagggactgtatgatctttttttctctctctttaaatttatgaaaactttttttctgatagtgaaagcaaaaatactagctgtcttctgctgagtatactctgtgccaggcacatgctaactcctttacattaacagatgagaaaatggatgcctagagccaatagctgcctcaagattgaacagctaattagtagctaaaccatgatcagaacccgaagcccatgtactggagagtgttcccctaaaatccatgtgcttcccagaacctcagaatgtgaccttatttggaaataggatcatcacaaatgtaagtaaaatgaggttatactggaggagggagggcccctaatctgatatgcctggtgtccttagaagaggagaagagacagacacacaaaaagaatgtcacctaatgatggagggggcagtgattggagtgaggaggaggctggtaacaccaggagctaagagaaaggcggaacaggccctgtcaacaactagactacaggcttgtagcttcccccactgtgaaatactacatttctcttacaatctggctggcttaaaagtaaacaaaatgtattgtttcagagttttccaggctggaaatctggagttattgtctcagttgtttcgtactttgttaaagctcatgcagcctgccatctgaaacaatgcaccctgcaaggtgcttagtgtagaaactttggaaaacagagaattcactaagtgctcatggtcccacgttccagaaccagtcgctgtagagtgtatattttccagttttcttcacttgcctctgaaggccattctgtccacttctaccttttaaaaatagtagcagttctcttatgtattttcttcttttgttgtttgatcagctgtactctttatgggatgtgctttcaaaagagtgagaaccactgtaaactccagaatcctgtttttcatcaccaccgccaccatcctcctcctccttctcatcaccatcaccatcaccatcatcaacaccatcatcagctggttagaataggtccagttgaaatgagaagtgcccctaccccaatctttgactcaaagctttgacactaaaaacggaaccacagtctctgatgagactccccagaagatggcagtgtggatcacaaaaccacactatccactcagtaccactgagccccagcccgtggatcctggtgtaaccagaaggccccgggcctgcggccttggtagccaggccacccgctgccctgatgaggctgctgggagtgagtattccagctctgcgtggtcctttcgtcttgtgaaagagaaaaacattgaactacaactttaagctcttcatttgaagaaagttacagttcagacactggagatttttgtcaccaatatttcaaggtatccactctaatgtctatattctatctcctacttatctgaagggtttaaggcaggcatctcagtattgtggataaaagaaggaagggctgagaaagaattaaatggagaaagttcagaaggagcaatgaaacagaataccaggatcatttatttaatgcttaatagctgtgggatccagggatactcaatcctctgtttttttctttcttttttttccatgggcataatatctgttgctgattctgcactgtttaacacagctcaaatgagaaaatgactattaaaactgtaagatagtatttctatcattaaatatcctttgtatgatctagcagggattcttaaacatgatcagaatcacctagatggcttattaaaccatggattgctgggctctaccccatcatttctgattcagtaggtctcaagaggggccagagaatttgcagccctaacaaatttccaggtgatgctgatgctgctggtccatggaggacactttgagaaccactgggctacaacaaatctaagagaatgtgttgctttcaagcccttactataagtctcagaacttcctaggtgactttttttttcctccccccaagatggagtcttgctgtgtcacccaggctggagtgcagtggtgctctctcagctcactgcaacctccgcctcctgggttcaagcaattctcatgcctcagcctccggagtagctgggattacaggcgcccgccaccatgcctggataatttttgtatttttagtagagatggggtttcaccatgttggccaggctgggcgacttgagctcctgtccttgtgatccgctggccttggcctcccaaagtgctgggattacaggcatgagccaccacgtccggcccctaggtgactttttaatgcaaaattaaggatagcatttcacaaaattaggaaatgctgtttgtgtatgtgtgagtgtgttcagtgtctagatgtacccaaaggtaaccatcttagagatcacaccatttccagtgggtgtggaacttgcacaagtgcgtgttttccaccttatggtgtctacataccccactcactgccatgagaacctggtggctactgaattgacagtcggatcaatgtgacccgacggttccctcaaagaccaaaagaaaagcttacagaccacaggacctcccttgagaatgtcacaagaagaggttgtgtttggtcactgctgggcttacagccctttacctgggtccattttccctataggtttatttattgcttactgtccatctttctctctaccccccacatgtaaaaatttaatatgtcccaagaacagtggctggcaaaggacaggcatgcagcaattgtgttgaatgaatagataaacgctggcagtgcccttctcttcccaaacacttaaatgagtttgtgaaacgcatttatgtgagcctgcttaacaccttccagaacaactgtgaggaaagtttcacatcgttccagcaaaacccacagtcaccattataaactataaaacccaggtatttggagaggaggccccaaatccttactcacatcttaagccaatcaaaatccacgtaattcaatcaagagttaatcaacatcaatgaacacagaattatagaaccaaagaagttagcgctggaaggggctaaaagattctgtaagtcgcggtactctctgaatgaagaagcagaaggcccctcctgactatgtggctgtggaggagcccatgaagagtgaagggtgggtgtcccctcctaggctggtgctcctgcttagcttctctcccggacaccctgagactgagaagctcgcagtgatgccctcccactagccccatgtggacatgatgcaaaggggaagtgtgaggaccagcggccagctcctggctcgcccagaggctcatccctatcactctgttgacctaaaaataacgtaacctacgttttacacaagtcctggttctcactcagagcatatggtaggatttattgtcttcaggtcctggttctcactcagagcatatggtaggatttactgtattcagattttgccaacgcgcctatatcttctacatgctacagattctgaggttgacactgtagtgacctgtgccagcctaacattgttttttcttttttgcctttttttttttttttttttgagacagagtcttgctctgttgcccagctgggaatgcagtggcgctatattggctcactgcaacctccacctcctgggttcaaatgcttctcctgcctcagcctcccaagtggctgtgactacaggcatgcaccatcacgcttggctaatttttgtgtttttagtagagatggagtttcaccatgttggccaggctggtctcgaactcctgacctcaagtgatccacccatctgggcctcccaaagtgctaggattacaggagtgagccaccgtgcccggcctaacattgtcttttctgatcctataacttgtcattttggttttgggataaaactgatcataggtttagaaagagcggttcaagatgatgattaaggatctgccttgagagccttaatagaccaggaagatttaaaaataaaggctggctgggtgtggtcgctcatgcgcatcatcccagcactttgggagaccaaggtgggaggattgcttgaggccaggagttcaagaccagcctgagcaatagagagagatcccccgtcactattaaagtgaaaaaaaagtaaaaataataataaaataaaaataaaggatcagagggaccagaagctcagagaaggtataaatggaaagaaacagaggtagatccttaaatgctctcaaagtcaaactagataaaaggcagcattagtagaattcccatcccttgaacactgacagtgttgcagccagccagccaagtgtttcatctttagtgacattcaattcgctaccaagctgtgcagtgcatactagactgagccacataaaattgccatatttataagtcaaaaatggttgagcaacgacaatattatttggttctaagatggatcattcccatgttacagataaggagcctgagcctcagaatggagaaatatcctggcagtagtcattgtgctggaaaatggcgtagagcaagattttgaacccaaatctgatagactccaaaatccattctctttccactaaactatggggctagataagaaggtgaagctcaggaaaagccataggcaattgcactgtttgtactgtactcgataacatttcttttcataactcataatcctttattctccctttatagtcataaataatgcacttcaggaaaactgcaagtaccatcttgaaggagccctaagtactgaaagaaccacaaatgattgtttccaggttatcaaattttaataacattattttattacaatacaacatctgtccttttaaagacaatgttccaagaactcattatgcaattataaaataataaagctcttcatagagtgaagaaccaaaggcagttcctccttgtagcaacactcagcatctcctgaaaattttttttaaaaatcctaagcatgcaatattgcttcttcaggcaagagtagatacagcacaaagtaagtataagtgaggaactgaataaaacatgactcaaaatgaatctgatgtgtatacgtgacactcctaacgatatcctagggtaagaacagtcttaaagtttggtcatttctcagttgactgagatggcaaaggcttttacatacaaccaagttgaatctttggcattttctcttcttttgtgttctagtatcattattgacaagttttcccttgttatgggttatttaattctaaatgcaaacacttgtttttggaatttaatacacagtcataattttaaaaatcaggtaataaataaaagtacaaaaaaaatagcaaataaaccaccccaaatcccacttagtctcaccagaaatagaagatttgatgctaattttccacagaattacctttggtgcatacttcagggcatactgaagccactcacagaaaggaggagaaagtggttgtaatagatctgggcacgtaattcaatttcatacaacagccaccctgggttctatttgtggatgatcttttggattaacaagtggatagatttcccatcccataaacttgattcataagcacacgtgttaaagaaaactttaagtgcatttccccctcattttaattagggtccatgtaaaatatttttgctccaattataaccagaactacaaatacctcccctcttcaacccaaagaagcagttacgagtcctttgtggcgtgttccagttctgacttgagtatcactgcattttttcccagaagagcaatctcttgggaaaagagtcaggccactttgggtaagatgtcatggcgacggcttaaactgaagacagatagtggaaatagaccttttcaaactttcaaaacccagacttatgatccattctgcttttaaccatggaggacccaaatatgacatgagaaattggaataattttattctctaaaagcaccagtaagctcccgctcctggaaacatattagaaaagtttttgccctttgccctttgcatagataggtccaaagaccttcccaggctataattttttttatcatgtaccacagcagagatcaacaaaactgagttgcactgtggctgctgagcaagtggctcagcccactcactagcccagggactcccttctgcaaaccaggcttccagaacaggggattctcttctgtgcagaggcgaaagtatcaaatcactgcgtggcttggacttctcaaatagctgaaagcccaaatattgaatctgcaaaagctaggagcaaggtagtaatgtatttgacttctagtctacagagccaaagttcagctctggctctgacatttacatgatcttgggtgaactccctaatctctctgttgtacagggtgaagataaaaacaacacactgttggccgggcgcggtggctcacgcctgtaatcccagcactttgggaggcgcaggcgggcggatcacgaggtcaggagatcgagaccatcctggataacacggtgaaaccccgtctctactaaaaatacaaaaaaatagtcgggcatggtggcgagtgcctgtagtcccagctactcgggaggctgaggcaggagaatggcatgaacccaggaggcggagcttgcagtgagccgagatcctgccactgcactccagtctctgggcgacagagcgagactccgtctcaaaaaaaaaaaaaaaaaaagtatttccccaattttctataattaccacagccttgtatcatcagggttgtcccttctgcttccactgaattccatttctgtttcatctcaggttctctacttgctgttcacgttccatgtgtcaaaccagatgtgggatttgcaccctatcctcaacttccctcccaaaaaagttacatgaggcctatgcttgtagcagactttactaaggtctttgaggatactcagtgggtttatatggcagaaactccaaaataatttaaaactgagtctgggactcacctgctttgaaaaattctttagccattctaccaccgggccccttgctgcactctttaaattcttttcttctcaagaacccaaaatacatacaggcttacactctcccttttcacctgctgcactccctgcctgacacccagcctctcccttgcttgcttagaagagccacgtgcattctgctcacacaagttggcatctgcccagacacctccttttcttctttctcctccagtgtttgtgaaggaaagagcatggtagaggcattttatttctcctagaatataaattatgccaccattacctctcccctttagaagacagaagcagctatagtccatttctgtgtgtgtgtgttttgtttatttgtttttttagatgaagtctcgctctgtcgcccaggctggaatggagtggcacaatctcagcccactgcaacctttgcctccaaggttcaagcaattctcctgcctcagcctcccaaataactgggactacaggtgcacgccactacacccgactaattttttgtatgtttagtagaaatggtgtctcgccatgttggccaggatggtcttgcactcctgagctcaaataatccaccgccttggcctctcaaagtgttgggattacaggcatgagccactgcgcccagcccatttgtatttaacaataggtttttgaattgttcattcattcattcattcaacaaagaggtattggccggtcacagttgttcattcctgtaatctcagtactttgggaggccaaagtgggagatcgcttgaggccaggagtttgagaccagcctggcaacatagccagaccccatctctacaaaaataaaaaaaaaagtagccaggcatggtagcgtgtgcctgttgttctagctactcgggaggccgaggcaggaagattgcctgaacccaggagtttgaagttgcagtgagctgtggttgtgccactgcactccagtccaggtgacagaatgagatctatctccaaaaacaagaacaaaccaagtatgtgtgtgtttctttcaatgtgccaggccctattctagatgctgggttgtgaccacagccaaaaatccctgccactatggagctcatatttggatggtgacaaggaacacaacagacaataaaccaatatataattaaagtaaatgtatatcagactgtgacaggtggggaaagataaagcaggatagggtgacagaaagaaatggcaagacggtgggggacaggtggcttgcaattttaaattaggtagtcagggaagaagaccccattgaggaggggccattttagcaaagacctgcaatgtgtctgggagtgagtcatgtgactggggaagaggggcaaggatggaaaatgtcacaggctgaggaagcagcctgtgccagggtcctgaggcaggttgctgtcacatcagtagcttttcctttctgtaatggacaggataagatttcaccttttgctcagctcaatgtcaggcatttcttcagggtcccagaatttcctcaactttgtccccaccttccttgtgtatttcctgttgattctgcctcctaaatgtaccttgagcctagcccttcccctccatttgaccggccatggcactgggttgtgcatgcaatttctcccctggtctacaggtgtagcttcctaactggagagtctgccccacttcgactcccacctgggtgacttagaattcaaacctgatctcaccactctgctgcattaagtatttcaattccttccagcccccataaccttcagaaaacaattcaagctcgctagcatggcaatagcaaagattgtcagccccccacccatgcccctcagcacctgctgttccagatgatgcccgcagggccctgctgcaagcacctgctgctcttcacttgagggattgctcttggttttgggcagtgagccttaagtgcgaggaagttaatgctcccaggcagcagccctcagccagtgagagatgggaatggaaggaccaattgtccaccttgcccacccctgagggagggggcagtgcagagagaatcactttgaggtgttttctacactgtctgccagatttttcctggtggcattgactcccagtgcccacagggccacgatgcccattattctgaccttcttaccttccccctcccgccttcccaccagcccccactggagcttcctagaatcatccctcaaataaacaacttgtactcaaatctttgtgttttgactattgttgtgggttgaattatgtcctctaaaaagttgaagttctaacccctggtacctgtaaacatgacctgatttggaaatagggttttcatggatctaatcagatatatttcatggatataactaagatgaggggtgggccctgatccactatgattagtattcttataagagtagagcgagcacacataaggaagagaacgccatgtgaacagggagaggggaggtcaggtggcagaagaatagagactggagtgccatgtctccaaccaagggatgccaaagattcgcagtaacatgggaagctaagagaagggcatggcacaggttccccctgagccttcagagggggtgtggccctgccaacacctttgtttcaggcttctgtcctccagaactgggaaggaatacatttctgttgttttaagcctcctagtttatggtactgtgttacaggggtcctagaaaactaacagttatctattgctatgcataacaatattctcaaaaattagtgccagaaccaccgttttctttttttttttttttttggtcttttttttttcctttttgtggagaacgaggtctcgctatattgcccaggcagatctcgaactcctgggctcaagctatcctcctgcctctgcctccctgagagctggaattacaggcatgagccaccacgcctggccaccaccgttttctttatctcacattctgtgggtcagaaacttggacagggctcagctgcgcaactcttctgttccatgtggtgttgactgagatgtccaactgacagctgggcaagtcgagggaatccacaacagctccgttcattgtctggcactttggcagagtcgcagagacaactagaaggctggacctgacggggaccacgtcccagagagcctgcatgtaatctctctaacttggccaatttagagtcatcagagttcttccatggtggctcaaagctaccagagtgagggtgttccaagagacccaggtagaagcagcaaggtttcttgtaagttagtctcagaagtcccagaatgttacttctacaaattctgttggctgagcaggtcactgagtccagcccagattcagagggtcatgaataagacagccccctgaaatgggaaaaagagcaaagaactgcagccgtccttcatgtacatcacctgtgccagggtctgctgctaggggaacccaacctaagacacttgcctgcaagattcttcaggctctggctcctgccctgtttctagggtcatctcatgccctcacatttgactttggtgcctgacatgccagattctcttttgtttttctaacactccaggttctatcttgctcccatgcctttatttaatttacttattatatgcaaagtaacaaaaaatacacaatagatgttcatgctctcctctgcctagaatgtccttccaccctatccttgtttacctgcagctgggctcatccttggagacctcgactgggcttcgccttcttcattccagtgaggtcacgcacctccaccctgctcctgcctctgcagcatggaacacatcaatttccttgtcagtaagttcttctagagaaggaattcttctttcccctacttcggtatcctcatgtctgatgatggatgaatgaattatgtgtggccctaagaactccaaggcaaaaatataaacagttcagcaaattgctaaatttttacattaatgttctcctgccatttttgagggattttcttaatgtcaactagctcaatgtaggagctggtcaccaagctgtcacggggctgaggagtgtcaggtggggagataatctaatacaactacttttttttttttttttgatggagtcttgctctgtcgcccaggctggagtgcagtggcgcgatctcggctccctacaagctccgcctcctgggttcacgccattctcctgcttcagcctcccaagtagctaggactacaggcgcccgccaccacgcctggctcattttttgtatttttagtagagatggggtttcaccatgttagccaggatggtctcgatctcctgacctcatgatccgcctgcctcagcctcctaaagtgtaatacaactatttaacttaaatgatgggaccttatatgtgactcattgtctccatgccctcatttatctctctttgctccctaataggcttggctgatatcttaataaagttaatgtcttccttgacccttgtcttgttcttgcagtataaaagaagtcccagttgctccaaacagggaaacttttgttcgtaagccctgtcagagttctgccagttataaaccgggataaagcaagcgtaatggcagtgcagacatctggaaaatttccctgtaaagaaccagatagtaaatattttaggctttgtgggccaagaagtaaaattgaggtattttctatagacacaaatgtaaccatttgaatatttaaaaaacatcctagagccagcaggcagtggaccagatttggacgatgggctgtgatgtcccaccctgtgatgtagtagattgagagcaaaactgaggtgaagagagctgggctcaagtccttactcggttcattattgtgttaccaacctagagcagaaggctctgggggagattccaccgacaatggaggctccactccccagggcatagggcggaggtagagttggtggctaaccttctgttctgagggcaaagggagttcggatccttggtcctggaggaagagcagaggaaagaaacatggccctggacctccagggaacacatagtgagctcagccccacccccagaaccacacctatggacgctggatgctgaaccaatggataaagtgaagggaattgtgtgtgggcctcaagccaaagcaggacaggtggctcatccagaggacctgggccaacattccattctgcatcagtgcccaaacaaagatgcctctcaccagggctccagcttctctgtgagttaaacgttaactggggtttgagctcctgtatccaggaatgcagtaaacacaaagttctcagccagggtctgataccctcctgagggcatctgaaatgtgtgaaggtgtttctggcagacccgttggtcctcggggaaaagcatttgccagcaatggcacatgctctgcagttcatggaatagacccgtgcaatgaagacctgtcctgaccaaatgccagcagctcccccttgagaagggctgctagggagccatgctggtgttcctgggctgctggaatgcagaggggagggacagcctcagtatcttgaattccagtgagcctcactttcctcatttaatctcaaggatgcttgtaagaatcaagagataattacatttgagtcttttgtcgactggcaaatgttataaacatatcaatcattgtaatgtgtcctccagtggctcctaaatgtgatgtctttttaaaaaaaaataatgaggccaggcgtggtggctcacgctcataatcctagcaatttgggaggccaaggagggtggatcacttgaggtcaggagtttgagaccagcctggccaagatggtgaaactccatctctactaaaaatacaaaaattagtggagcatggtggtgcgcacctgtagtcccagctactcaggaggctgaggtacgagaattgcttgaacacgggaggtggaggttgcagtgagtctagatcgagccactgcactccagcgtgggtgacagagtgaaactccatctcagataaataaataaataaataaataagtaagtaaataaataaaagagatacaacttacatgaagtgcacaaatcataaggtatagctcaatgacatatatcatacctcaacacatacccagatcaggatatgcgatgttgcatcatcccagaaagttccttcaggcccctctccagtcaatacttccctcccagaggcaaccacgcttccgaactctccagagacaagttttgcctgtccttgaactttatgtaaggggaatcatccagcatctcctctttcatatctggcctcctttgtgaacatggtcttgaggttcatccgtgttgttgcttggaccagcagtgcatccctttttattgctacatcatgacatgtatcttttttaggtggaagggaatttttaaaatctcaaaattacagcagaagctacaaataatcattccaccccttgcatgatttcaggtcctggtctctttaccagcctcactcccacgctgggggaattataatgtcaattggcttttagctgtattgtgttaggaccagcccgtcattcctaacaaggacaaggatttcgaggggaaaggcttctgttagcttagtatttattagtctgattatctgttcttcaagtcaaaaatctgcttgcctcttacttaactgttttatttacctagaaagtagaaagaaagtctactctaaagtgcagataagcttctcaacttggaagcatggtgctttaagagaaaaagcacacactctgcaaacaagatgtggggagtggaatggaaaactccactgagtgctttcctggcctcatgccaatctgtgaatacttaattatatatgtgtgagtgtgtgtgtgtgtgtgtgtgtgtgtgtgtgtgtgtgtatttaaagccaactgttctcacatttaggccaatttttctttgctaatatggtcttttcttgtcttcaatccaaaacagattgagaatcaagaaagatatattctatccacagtttcatttcaccaatcatctgttcattttcaactaacgacaaccatttatatgtctttaaatattaatgtgggtgccaaagaacacaaagcaaaggcactgttcattcagagccgaaattgactgagaattcctgcagaggtgaagtttcttctaattgatggatttggtctggcaatgcccatggccagaggtgcacaacaaggaaatgaatgagtgcagagggaatagtgccagtcaagaatctacaggttcaggtgtatgcttaggcaagtgcctaacacaatttctttgtcaatggtgccgtattaagttgactctggatcccctcagaaattgggaagaaactcaggggagaaatgaccgtatgtgctttcccttgattagttatcgtcactacatcacctcaccttaatctgcatcaccatatgcagccactgtatttcataatgcttagggttgatcagccattatcccatagctccctgtccatggctcagtttggtgcttagattaacctaggaggtggtaaggaaagtactcttgccaccttgaggggtgaaaaggctaaatgacttctgcaggggtaacattcagtaagtggaggagggcctgccttgttctctcctttgtctccaggttaaactgaatgatactctaatgtaccagaatatgccctttgtaatattttatttttttaaaatttattttactttattttattttattttttagatggagtctcagtctgccaccaggctggagtgcagtggcacgatttcagctcactgcaacccccgcctcccgggttcaagcgattcttctgcctcagcctcctgagtagctggggctacaggtgcctgccaccattcccagttaatttttgtatttttagtagagacagggtttcaccatgttggccaggatggtctcgatctcttgatctcatgatctgcccgctttggcctcccaaagtgctggaattataggtgtgagccactgcgcccagtcatttatttttatttttatttaattttaattttttttttgagacagagtattgctctgtcacctaggctagagtgcagtggtgcaatctctgctcactgcaacctctgcctcctaggttcacaccattctcctgcctcagcctcccaagtagctgggactacaggtgcccgccaccacacccggctaatttttgtatttttagtagagatggggtttcatcatgttagccagaatggtctccatctcctgacctcgtgatccaccccctcggccttgcaaagtgctaggattacaggtgtgagccaccgcgcctggcctatttttgttttttaaacggagtctctctctgttgcccaggcaagagtgcagtggtgagatctcagctcactgcaacctccgcctccaggttcaagtgattctcctgcctcagcctcccaagtagctgggattataggcattcaccatcacatcccatcacataatttttgtatttttggtagagatggggtttcgccatgttggccagactggtcttgaactcgtgacctcaagtgatctgcttgcctcggcttcccaacgtgctgggattacagacgtgagccactgtgcccagcccctttgcaatattttataaaggttaaccaataggcatagagtccttattttactataatggaatataaagccttgtccattaaataagaataaagttgcttgatttgtcccagtgaattgactacaaatgaccagatgctatggcctgttgtctgtcttccttctccctctgctcaccagaacataagctgcacaagggcagggacttggcttagttcactgttatatccagagctcctaggccagggcctgacacatagtgggtggtctataaatactaagtatgtgaggggacgaagaaatgatggaatgagggaagaaaggacagagcaaggcttagattggtggagtggcttgctgaaggtcacacaaccatagcaaccttgatgttcgagagagcctgagcataaacaccactcctctgttagatcttttcatctgtgctttcatttccatgggtagtattcgttgcctttttggaggtgagagctgggggaggagagacgttgccatttttctagaggaatgtctttaacaagttgtaagagttgtcttatctgaggaagagggcgataaagttgctttgaatgtgaatgctggtggctggccaggccccctaactagcaagtgatttgataacttccagcatggacttcaattcatagatcacaacacgtcagagaccttatcagggctatggttggtctaactccacaggtgtgaaagatcggggtagttattcctcctgaggatcttacatggaatcctttttttttttcaaaactgtatcacctaagtttctggtgtatcacaagacatgcccatagcaaaggtaaacttgatggttgatgctctttttttcatgcttagcacacactagagaaatatatctgctcatgaatatgtaaataatttttatttaaagtctaactggcttgaaagaaaattcttgaatcacctcttggtgttctaggaattcaatatttctcagtgcaaatatcaaactcctactcagatgcaccaaatggagacttggctggttttaaagcatctatttactcagaagaatagagcccacgcacagggaaaatgtcccttcttctactgatgtcccaaatgcctctttgcttaaagattgcttaagagggatgccaatgtagttaatgcagctctatagtgaggagtgaacccagtccagctccatattacatttttgtgtttcataatattataaggctcttagcaaggaggggaaagaaccaattcagagaaaaagagcttatgccctctggaatgaataagatgccaagatggcagatagtaccagatagttcatcttaatgctttttttttttgttttttttttgagatggagtctcaccctgttgcccaggctggagtgcaatggcatgatcttggctcactgcaacctccccctccggggttgaaatgattctcctgcctcagcctcctgagtagctgggattacaggcacccgccatcatgaccagctaatttttgtatttttagtagagacagggtttcaccatgttggccaggctggtgtcgaactactgacctcgtgatccgcccaccttgggctcccaaagtgctgggattacaggcatgagccaccctgcccggactaatgcctttttaacaatgtctgtgtgtacctttcttttttcttgtaacctgtgttctcaagacagagagcaaaacagcagcttaacgttttctactaacagaaaaatcatagtaaccaagtgtacctgaaagcttattaattttcctggccagccacctttaccttgattccttttattgcattaaaaatcgagactaattaaggcaactgttgctgcagcaggccaaattaggtttttcttagagctctcccttcatctcacagaatgatgtcattaagtgtgcagcctgtgaaatgctaaggacagcctgtttccaccgtgacatgggtcactcaggaatgcgagggaagtacaccactgaatgtcataaagctttaaagagttacaataacacctacactgcaggccaagcagaatatgggcattcacttctctttgtaaacagactctgtgaagccagagggaaggtaggcgggaagtgatgcgggaaatgatggcatgaaggctctgcatagctgctctgcaggctacttggtctatgggcctcttgattggccagtcacccagaggctttacatagaactgggaattgggaccaccaaattgcacagcttcttggcaggcctgtttggccacaggcagctcttgaatcacagggctatattatatggccacttgatacctgcttatgattaagcaagctccagtgtgctttcacaatagagatatattagtcaaataagtttacttcatttttttccatgagccctgggatttgaagagttagattacagtccactcaccaagattctttcatacagatggttttcttatagtggagtagcccattgccttctcaagtgaaaactatttagtcgatcccctctggtttgttgtttgcatgtgtctaggtagtctctgagtcctgatccttaaccagacataagcatttgtgttgacattgatcaaaaaacactactattgccaactactcagcatgtgtttctaatacctactatgtataaggcatagttctagatgctatgagctagacattgatcagaagcctgtaagacctgttctcaagaagacaggttaaatatacattaaagtaattcagaatacatgacagtcttcgaaaagggcaaagaaaagacaggagtttaaattataattggaagaagaatgtgaagggaaacagaggtcaagagagataagtattgtttggaaagatcaggaatgatgtgaaattcagatagtggaaaatgtaaaatttaaggagggataagcagagaaaagggacaagccagagggaacagctaaagactagtttgatgagaagaagaaggttacccatgtttcacttgtacactgtcttaggtggtaagctaaggaatttaaacttgtctttaaaaaaaaaacaaaatcactttattgaggtatgattgacatataaaaagctgtgtctacttaatgtatacatctcgataagtttgggcataagtatacccctatgaagcaatcaccaccatcaaggagatatttatgtccattaacttttttttatagacagtggggagccatagaatgttcttaacaagggacttatatcatttagggattttttttttttttttttttttggtgaggcagagtcttgctctgtcacccaggctggagtgcagtggcgcgatctcggctcactgcaagctccgcctcccaggttcacgccattctcctgcctcagactcccaagtagttgggactacaggcgtccgccaccacatttggctaattttttttttttgtattttttgtggagacggggtttcaccatgttagccaggaaggtctcgatctcctgacctcgtgatccgcccacctcagcctcccaatgtgctgagattacaggcgtgagccaccgcacccggcccatttaaggctattttatcataagcagcagagaagccaatttgacctggcttaaacaacaaaggaagtttcttggcttacacaatagaaatctctacagacagatattggcctcaggtaaggtttgatctagcaatccaaacaagaactcccggacactagttcctctctgcctcagcttcatccttagataccacattgtccctacctgccatccccatcctcttctaggcagctcctggctctccatgtgtggcagaaaatggctgcagtaactccaggcctcagatctccctataccttctggaggaagagcaagcctctttcctggtagcatctctggaagaggaggaagcttgtctttcccagaggcttcaaatggctcctgtgtcttcatggatctgaatgggttactgatttatctgggaatcagtggaggatgtaagtaagtacatgggaaaagctgattggtttaagccaaccacagtccacccgtagagcaggagaggtgggtgaatccctcccaagccacagggctagaatgagaaaggatagatttcctgaaggaatctgtaagtagtgttaggaagggagaatggcccttgggtggccaaagagtgacacatgtttactagaggtaataataagacaaaggtaggtaggtttatgtgacagtcaagaccagcttatcaagccatataattgtaaaggtatgaactaacctctactgacactgactacgtagtcagtatcaacctaaaaaaaaaaaagacaccagaaaattgtctctaaatatgttgggtttactcaagaatagaagtaaggattatagactggaatgcatggaatggcaagccactagtgcattcagtgaggaagggggaagggaacttttattagcaaaaataaattgacataaactgcttagaaacaagttcattggttccagaggttcaaagccagaattgttgtcagttcattggtggagatgtcgctactgggcaagtgttcttccaagaacattttatttgaatcactgcagtcctaaagaatgtctagtgataggctgggtgcggtggttcatgcctgtaatcccagcactttgggaggccgaggtcgggagttcgagaccagtctgaccaacatggagaaaccccatctctactaaaaatacaaaattagtcgggcttggtggcatatgcctgtaattccagcgacttgggaaggctgaagcaggagaatatactgaaactgggaggtggaggttgcggtgagccgagatcgcgccattgtactccagcctggctaacaagagggaaactgcatctaaaaaaaaaaaaaaaatgtctagtgataaaccttattaaagcaggagatgtgtgaagggcttatagaaagtccttggaaatcgtttatcgcagaatgtaagcttgagcctcctctccttactggctctattttgtctgggtttgacagaaatgatttcctccaggtatctggaattttcacatcagccacctccccatcctccacctggccctgtatgcccgccttgccccttttacttcagaaagttttagaaaggcatcatcttgtttcacatagacccaaggatgatttctcaaactgaaagaattctcaaatttttatttggaaataaaggaattctggccaaatgcagtggctcatgcctgtaatcccagcactttggaaggccgaggtgggaggattgcttgagcccaggagttagagaccagcctgggcaacgtgacaaaacactgtctctacaaaaaagaaaagcagattagccatgcatggttgtgtgcacctatagtcctaattactcgggagctgaggtgggaggattgcttgagctcaagaggttgatgctgcagtgagctgtgattgcactctctcacaaaaaaaaaaaaaaaaaaaaaaaaaaaggccaggcgcggtggctcacacgtgtaatcccagcactttgggaggctgaggcaggcggatcacgaggtcaggagatcgagaccatcctggctaacacggtgaaaccccgtctctattaaaaaatacaaaaaattagccaggcatggtggcggcgcctgtagtcccagctactcgggaggctgaggcgggagaatggcttgaacccgggaggcggagcttgcagtgagccgagatcgcaccactgcactccagcctgggtggtggcgggcgcctgtactcccagctactagggaggctgaggcaggagaatggcgtgaacctgggaggtggaggtttcagtgagctgagatcgcgccactacactccagcctgggtgacagagtgagactctgtctcaaaaaaaaaaaaaaaaaatcttcgcaataaccatacaaagcaggtattactatctaataggt

SEQ ID NO: 15255 - DNA, 99797 bp, Human
  misc_feature (1)...(99797): n = A,T,C or G
gagcctatttacaaactcttcgggggaaagagcccaaaaagaaggaaagtggctgtctggatgtgagtttatggactgacatcaaacagaccttgttgggactgaaggcctgaagagtaagcatataggtgggaggtagttgaaagagaactttccagataaactgttttcttcatgaataagtaataaagtaatatctgctgagagaagaaagggatgaggtcgattacgagaagaccttcaagcatggtacgtccttatgcgagtggcgcatggcttcaagaggagggttgatgggacccatccatgagtagagaagttaacaacaatgccagtctgcccaggatgttctgctgggactcagaaaaacatccagtttccttcctttagattttaactgcagcatcacgagctgccttcctagagggaattttgtattttggggctgtagctcagaagacttccattctcttttccctctcccaagagagatcgcagctgcttcccggggtttatgtccatgacataggactgtccctgctgggaatgggggagggaactgcttcccactcgaaagcagccttttcacttccagcttccatctgccttccactcccacctcccaaaataaagtaaataaatcaaagccagaaaaacattctggctggaattttattacattcagtattgtgtgagagctcccaaactagctgggaccgttggatttcagagtacgtgaaggtgaagcctgtgaggttcccccaggagtgctgggcagaaccctgagttttagaactccctctgcctttagcttgtcttggatgtgctcttccactctttcaagcactaaacccttccctgtaaatagtcacctgccagggtgccctcaggttatagcttgtcaccagctctaagagtggctagtacccagtctcagtgttggataacaagcaaaagtgatgagttgttttcttggggtttgtgtgtgtgtgtgtgtgtgtgtgtgtgtgtgtgtgtgtgtgtgtgtgtgtttggtttgttgtggtggtatgtttttgtttttgttttttcagagacatggtctccctatgttgcctagtctgggcctgaactcctgggctcaagtgatctcctatgtcggcctcccagagcactgagattacaggcaagtgtaagccactgcacctggccgttttcttgtttttaaagattaacctcaggccctagttatgttaccatcctagaaatgcagttatcctaaaaatgattcctctataataaaggaattgggtaaaggagctttcttgctgtattttcagtgaattcaggcaaggacaccctcattcatggaaggggaaggctgaattaattgctctcaagttctttcttaccttcaactaaattagatccctttattctccagtggaaacttggcactgaggagtcccaggaggtgactcagtcggatatgtgaggccttagcaccactggccttgctgcttctgcactgtgtctgtcagggatatctgggacagaaagaataatttccgctgctggggcagccagagcctggcgtgcccgtccctaagctggcctgcaccttgccaccggaagatgtagtgtagagtagctgcttgaccccagagtagcattcagagggcacataaagaagctccgttaattcaaacatgtagttattatagagatccagagggccagaggctatcatttttttaaagttacctctttctatgatgatcagttattcatttttctaaatatttgtctgcatgttatatgtgctttcagtaagtttttgggtgaatttcttaacttcataaagtatataaaacaacttagcaggatatgagttatgacatttaggggtgttgtcctattgcttcagaacagtggggttatcgtgtaacacaccatgtcacatgatttgactaaatacaggaaaaaaaaaaaccctgaacttggtttcattggctcaaatatagttcaagacaacagagacaaagctaagatgaggaagttctgtacagtttaggaaatagaggctttcaaagataattcgcagtgatgtgaaactggcctcccaagccctgataagtaagttaaataagagtaggagccaggagggaggttctttactcttgaattaagagaaggggagctggaggtggctcaggtagagtgcgtaggtttgcagaactgggcctgtgtgtgtaaagtgactaaggcaaaggagtggaagtttgagagaagtttaagagaagaaatggacatgattgcctaaatcagccaaacacagggtattgttgtatttctggatttgttttccttatgacctacctttctcagttatttaagaagcaaatctaaaggatatttgttgaaactctctatgcagaaagggtcttgggtgagttgtagtaaccttcagccatgctgattaaaattttctccctgctgcagaggttatgattgtggttcttatatcttgtagatgtgtatttaattattgaaatatgtgaaaactttgttttattggtttcaaagtagggtgggtgtggaagggaaactatgccttttgtttgcaaagaaaaatttaaaaacaattgataaacagtatttagtgtcatatggtttatatcctgcagagccttctataaaagaccttagtaatgcttttggcattttattacattaattttttaaaacattatttctgctgcctagggtctttggtggggaaatgtactatttagcaatatgtttagtgaacttttgtcctgtcatggtaagaagaaagcagctataactaagtaaggagttactcttattcattaacatgtaaaacgctgtttaaaaaaaaaaaactggtcatttttttaagttttatttttaattggcacatttatttatggagtacaatgtgatattttggttcatatgtacattgtacaatgaccaaatcagggtaattagcctatcaatcatctcaaatatcactttttcgtggtaacaacacttaaaatcctcttgaggtattttgagatatacaatacagtattattaattataatcactttgctgtacaatagatcaccagaacttactcttcctaattttgtacctgttgacaaactcttagtttcattgattctgttgtttttctagtctctttttcatttacttctgttctgatctttgttatttccttcctcctgctaacattgggcctagtttgttatttttctagttccatgaggtgtaatattaggctgttatttgagatctttcttttttgaagtaggtgtctattgctgtaaacttccctgttagcactaacttttgctgcatcccataagttttagtatgttgtatttccatcttcatttgtcacaagatttttttatatatctcctttattttcttctttaatttcccctttaattttttctttatctcgatagttgtttaggagcatattgtttaatttccacatatttgttaattttccatgtcctcctgttactttagaaactattctagtttcataccattgtgatcagaaaagatacgtgatgtaatttcagccttcttgacctgtcctggagaatgttccatgtgcacttgagaagaatatgtattctgttgctgttgggtggaatttcccccagcaggccactcttaaaggaactgtaatgcctcagacctacatttggaaaacatttattaaggggtgattatttacccacagaagaatcttttgctttactacatgacttgccttatacagtggacttcctagagatttaaatgtatttgcaaaagcattgattttacagttaaccttcaagaacattaagagtgataccgattgcatgtgtaaggcagtctcttatatagatgtatgttgtgtgtatgtacacgtgtgtatatatgtacattcacatacataatcaggaaataaggaatagttataatgaacaggagaacacaagtatttttcatggataagaaagaaaacattaaaaagaggatgatcattttaatttggtcttttagttgataaaaagggtacatgctttttagtttgcaaacaacaaggcactttgcatagctgatagaatgaaaatagaataaaatattctgaatgaacataaacacttggtggtagtttaaaaaatatacaaaaataactaaacatcaggccatcacaggtagtgtcaagtttttgaggctaaccaaaaagagcggggaacccccttcaattctaagagacggcaccatggaggtagtgacttttgagttgggctttgaagaatttgacaaatgatggaaaagagtgttgttctaggcacagttggcaacagctcgagcaaaggtttgcaggtcagtgttacttctctcttcagagtcctccattgcctttccatctcacctagaataacatccagtttttattctgggctgcaagtgctttctggatctaccccctgccctattcctttctgtgctgtgttttccgctttagcctggaagatttgttaaacaggggctttgtttcctcttgttcacctctgtattcccagtgcccagagcagtaagtgctcagtaaataaatgttgaatgaatgaaagaaattcaaaaattatctactgtgctggaatgtttgaaggataagaatggcagggagggagggtgtatgtggagtattggtcttgagggcagtgtaaagtttggggacattagggaagcatctgtgatgttgcagtgaagtgtttgctaatattacagtgtagagaatggattagaaggactaaagagcaagatagcaataccatacgaaaggatgtgtcagtgggtctttcattcagttgacatttgagtggttgccccatgctaagcactgtgttaggttctggggacacaaaggtgactgagaaatggtttccatgggtaatgccagatgtgtgaacatcctgtagcaaaggactgagcaaatgatgcggtggggcctgaacctgggcgttgtcagaggcgtgggaaggagtctgaagtctcattgatagtttcttgatgtcagtagttccgcaagttcccagaaaaaagaggaagccttcagtgaaactttttttaaaaaaaaattgattgattgacaaggtcttgctctgtcacccaggctacagtacagtggcacgatcatggctcactgcagccttgacctcctgggctcaagaaattctcctgctcccgcctcccaaatagctgtgactacaggcacacaccaccatgcctggctaattttttaaatttttataaaaacagagtctcactgtgttgcccaggcttgtcttgaactcctggcctcaagagatcttcctgccttggcctctcaacatgctgagattacagacttgagccaccatgcttggccttttaagggaacttttaaaaatgtttttagtttttttttttgtttttttttttgagacagagtctcgccctgtcatccaggctggagtgcagtggcatgatcacagctcactgcaacctccgcctcccaggttcaagtgattcttctgtctcagcctcccaagtagctggaattacaggcacgcaccaccatgcccggctaatttttgtatctttggtagagacgaagtttcaccatattggccaggctggtctcgaactcctgacctcaggtgatccacgtgcctcggcctcccaaagtgcttggattacaggtgtgagccaccacgcccagcctagttttgtttttttcatgcggggacttacagtgattttaaattgggtcttgcccaaaagttagccatatgttgattgacccattagttccaggagaaggaggtatacaggagcagtgttttagctctgagtcggtgtgtcacttctgaggcgcagtttgtcagaacagttacaggatgaaatgttgatgtcctgtagagtgcttgattaaaataagtgaagtggcaggtggggaggtattttataccccaaatgttgccacaaatgtatgataatattgttgggagaaaaggatactttatcagcccagatgggacatataatacagaatctaaaaaaattgaaaaataacttataccaatttttgtgtgtgggaggggggtgtgtggagaacaggcagagattcccttatagggctttaaaatgtgctatgctgaaagaaagtttgtttgcagcctgggaagacatttagactaccaagttcttcgggttcagctgtttatggtctttcttgtcacttatttaacagtttcagaccataaggagcgtatacttttctcacttgttctttattcattgagcctatttatccttgaaatactgtggtgtaagttgaaagaccttgggtttaaattttacttctgccatttgtgtgattttgaacaaattatttaatatctgagttgcagattcctcatctgtaaatggcaatagtatttaatctgtgagtagtgtatgtaaaaggatcctagcttgatatttggtgggatctaggtgaacaacaaatgttcccctttttattgtattaatagtaaaatgtatataacattcagttgtggaggacacttgggttgtttccataccttggatattgtgaataatgctgctgtaaacatgggtgtacacatacctgtttgcatccttgttttcaattcttttggatatatacccagaactggaattgctgggtcatgtggtaattctatgtttagctttttgagggacttccaatcattctctgcttttgttttttagtttactctgcatcatttatgcatatctcctttaagatccagaattactagagttcagggtttgaaagcaactaaattcactttagtgcctgatagtctcatggtttttctctacttccaaacatatctaaaccttatccaagcctcccactgtgtgacttctactgtgaaaaaagccattcttctctttcttttgcttttttctttcttaaatcttctccccttcgattgccttttctttccctcactaattctttccttctcaccgcctgccttctataaaggaatgctggggaaaaggtcttgccggagttacttctccatccccactctcaagcctacccagacctggagttgctgtctttgtgaaaagggacatagacacagaatgatatccagatgctagattacgtcaatttacaataaactttaatttaagccagactttcagaacaattagcacctgtataatactaaaaaatgccaagtatctgggaaaggttgggtggggaaggagaaaatagtatcatccatggggatgattcaactcttagggctgccagcctagcacactgctagcaacagctgggaagaaatcataaagtgaattttccacagataaaccagccagaaataacaccagactgccaagtcagatgtgatttcttagtcataaaaggtacttttcattcctgtaatcctgattggcctggtcagtaattaaaagtcaacattcagttttattttacttatttctaggaccattgtagaatccttcagtcattacatatctggtgagaccctagtggtaagtaaaggatatccatgcacttgaggggaaggaagtgttcacacatgaaatagctagaatagtaacaaagctccctttaaattcagacaatagcagtgagctactggtaacagcccaaaggagaaaatgagcagcagccagaattttgagattaattttaataatttattaatgaatgcaccagcagagaagaggtgggaaggatatggtcgacaagtggtaggagtaaaaaattcagctgtggggaaggggtagcttttgcttagaaagttcaccacagacccctgccctctaagttatggtgaattctgtggaagtgattagagtggagaaaaaggaacaaagagggttggaatccagacgttccatgactaaccccaagatgactaaaccagctactgaatgcacccacagaaagggaagtgacatttactgagaacacatttagtgttgctgaacgcttaaaatgctttctttgtgttctcagtccttaccagtctgtgaggggggtttattttgtctacattacagatgaagaatctcacctgcaaatgaagaaagttggctggccgacaggagatcgtttgaaatgaaaggattccagggtttctttctactgagcgtattcaataagcagggcttattatactatctagaatggtgctatcctgtagaaatacaatgtaagcagcatgtgtagttttaagattttctagtagccatttaaaacaggaaaaaagagatagggaagattaattttaataatatgtttaatttaacccagtatatcaaactgtcatcatgtccaagctatatacatatcatgtcatcagcattttaaagttaccaggagaattcagtgggtactttaaagtccatctgaattcagactagccacatttcaagttgctacatgtgactactggctaccaaagtagacagcatagctctaaaaaaaaggtagacagactcatcctaaaaaaaaatcgaatgtagaggccctgctttgaagtcattgagaggaattatggtggggcaagaaagcagcttcacctgagatggaaagctctgtggaaggaaggtaccatacataaaagcagggctgctcttgaaagaatgtgaccatatcatgcaaggacattactgactgaagggctatttatggagagcagtaaggtcataccgacctttatcaccactgccagtcgtgaccacaggaaggccctgtggtgttgactgctagatgctgaaccgtatttgggtgggggttgcgaggatgctgtgtcttggcaaatctactaaccattaggagtggaaaccacagcctttaatgtatgtgtggatgtcattcccaaagaatcttttcttccagtgcctttttcagatgaggaggtgtaatgtgtgcttgaggaagtaagcatgaacaaactaccttatatgggaattcccagacctcagctccacccagaccaagataaatgatggtttcagactgctattccagcaaaacagggaccatcctatatttataatattcagtcatttcttccatgctttcttactttaaaaaatgttcttgaaattttcccttggtcttctttcttcttgtgattctgcctactttgttgcctttgtcccacttaactattttcttcagtttttcccattgtacttggtttattttgttgttgttgttgttgttctgtagtcaactgtgtactaggaatcagtgtaccccccaggtcctgttcttggctctcaactgtgggactttcattctgttccttcatctgaaaaatgaaaaacattagaattagagtcctttataatcttttagggccctcattttgcagctcgtttggagcctcttttttttattgtggtaaaaaacacataaaatctaccaccttaatcatttttaaactcaacagttcaacagtgttaagtacacaagaagttgcacctatgataaaatgtgaaataagatctagaggcttgaggagaacctgaggttatctgtggagggtggaaggcttatgctgaagtggccccctgagagcaaagatcaggagtaagggacgatctcctagtattcacttgcagaagtgacttaaagctgctaaaaggatgtgtgtcagggctttggcattctgccgcagacatagaaagacctgatactgttttgacttcatgtgtccctgtagccattcagcggccaacatttgtatagtactttatctttctcagcttatttctaattagcgataattaatactcttagtattaatacgagttaatttgtaattcttacaaaagagtgtgagataaatgagcatgtgctgtctttaatttccaaaggaggaaatgaaagggtccgtggaagatgagctgtagctgtggaaggggcagaaaagccagagggtggctcaggagtctggtgttatatatgataacattttaaaaataagaggtgaggaaaatgggagcacactttttggaagattaacataaatgtaaaatgatttacagaacagatcaatggaattcagttaggtctcagattttactttccccattagggatgtatgtaaagaaagggcatgttggccgggcatggcacacgcctgtaatcctagcactttgggaggccaagatgggcagatcacctgaggtcaggagtttgagaccagcctgatcaacatggagaaacctcatctcaactaaaaatacaaaattagccaggcgtggtggtgcatgcctgtaatcccagctactcaggaggctgaagcaggagaatcgcttgaacctgggaggcagaggttgctgtgaaccgagatcacgccattgcacagcctggacaacaagagcaaaactccatctcaaaaaaaaaaaataaaaataaaaaggagggggacatgttgaggcaataggaacttgaagtacttgggatggttcattaatttccctacgaaacatctgtttttttttttttttttttttttacagagtcttgctctgttgctggggtgcagtggcatgatcttggttcactgcaacttccgcctcctgggttcaaatgattctcctgcctcagcctcccgaggaagctgggattacaggtgcgcaccaccacacccagctgatttttgtatttttagtagaagtggagtttctccttgttggccaggctgatctcgaactcctgacctcaggtgatctgcctgcctcagcctccaaaagtgctgagattacagatgtgagccactgtgcttggtcaaaacatcttaatttgaccttttttttttattcacagaccactttgagactcaacacttaacgacattcatagaagaaaatgcacaaaggcacatgcatagaaagtttttgtataacttccaggaattcatgcccccagtgcagccacagcaacacgtgattgtaatgatgattgcatttctgaagactttttaaaagcatttttttggatagaagagttaaaatgttgtgaattcttgataaattgaataagcaacaaatacactagcagtcactagagggtgatgttttctagcatacaacatcaagttctttccggcaggttgccattgtaggttcctgtgtatgtgcttgcttgtacgtatgtctgtgtgaaagagacagaggcacacacacagactgtctctacctgcataactaaaagaatttctttgtgcatgtttcttttttctccttttcacttatctataatacaagcaaaaatgcttttttttttttttttttgcgacagagtcttgcatgttgcccaggctggagtgcagtgatgcagtctcagctcactgcaacctctgcctcctaggttcaagtgattctcctgcctcagcctcccgaatagctgggattacaggcgcccgctgccacacccggctattttttgtattttttagtagagacggggtttcactatgttggcaaggctggtcttgaactcctgacctggtgatccgcccgcctcggcctcccaaagtggtgggattacaggtgtgagccaccacacctggccagaaatgctatttttttaaagccttctcccacctgttctacagatgaattctgaatgttttctaatatatccttgtttctcatcatcctaggaatagctaccaattatgagcacccactgtggttggctgtgcactgggtggcttatgaactttacccctcatccctacaactgcagcgtgggctatttcatagattaggacatgatgtgtaagtagctggctcaaagccctccatctagtaagtttgccagtatatcatcagttcatagtaaactaaaaaaatgtctactttatccaaacttttttgtttataaatgaatttttgtcacctggtatgtcttagatatgatttgagactttttgttgttgttgacatagctttaataaaattaacataaactgtgactttgtataggctaggaggaaggagagactgaggagtactatgtttggaaggaaagctgaaggtagggcagccggatggttagctttgcagataccaggccagtgagaagaaaacagctagttcgatattttgcttaggattaagccctgatggttggatactagccatctggggggtggtgggtggggaatccttttgggagaacggacggagtgtgggaatgaggccctggccaggcagatgtgtgccagtctgacactgttcatttcttctgttgtttatgccagttcaggcaacacggaagctgtgtctgtttctcctgtcattgtaaacgtagccctggtctttcaaaaagctgtggttgtgtgggtctttaaggtattccttcagtaattgtggtggccactatttcatttaaggagttagcatcttataaagaaaaatctgttttctcaaggctctatagtaatgatattttgtttaagtttgtccaatatggtatttagttcttcctattaaggaggagtctctaaacttcagtctgtgggccaaatctacctcctgtttctgtttaattattttattggggggggtgatatttatcccctcaagcatttattctttatgttacaaacaatccaattatattattttagttatttttaaatgtccaatctaattattattgactgtagtcaccctgttgtgctatcaaatactaggtcttattcattctttctaactaatgtttttgtacccattaaccattcccttcccattccccatctcaccactacccttcacagcctctggtaaccatctttctactctctgtgtccatgagttaaattgttttgatttttagatcccaaaaataagtgagaacaaatgatgtttgtctttctgtgcctggcttatttcacttgacataatgatctccagtcccatccatgttgttgcaaatggctggatctcattcttttttatggctgaataatactccattgtatataagtaccacattttttctttatccactcatctgttgatggacatttaggttccttccaaatcttggctattgtgatcagtgctgcagatatctctttgatatactgatttcctttctttagtttatatccccagcagtgggagtgctggatcctatggtagctctatttttagttttttgaagagcctccatactgttcttcacagtgattgtactcatttacatttccaccagcagggtacaagggttcccttttctctacatcctcaccagtatttgttattgcctgtcttttggttataagccattttaactggggcgagatgagatctcattgtacttttgatttgcatttctctgatgatcagtggtattgagtaccttttcataggcctgtttgccatttgtacgttttcttttgagaaatatcttttcatatattttgcccattttctgatcagattattatatttgatttttttactatagagttgtttaagccccttatatattctggttattaaccccttgtcagatggttagtttgcagatatcttctcccattctgtggttgtcttttctctttgttgactgttttcctttgctgtacagaagctgtatttgttgtttttgttgttgttgttgttgtcgtttgagatggagtctcactcactgtgtcgccaaggctggagtgctgtgacgcaatctctgctcactgcaacctccgccttttgggctcaagcgattctcctgccccagcctaccgagtagctggggctacaggcacccgccaccacgcccggctgattttttgtatttttagtagagatggggtttcaccattttggccaggctggtcttgaactccttacctcaggtgatctgcccacctcggcctcccaaagtgttgggattacaggcatgagccaccacgcctggccttgcagaagctttttaacttaatgtgatcccatttgtgcatttttgctttggttgcctgtgcttgtggggtattattcaataaatttttgcccagaccaatgtctttgagagtttgccagacatttccttgtactagtttcatagtttaagatcttagatttaagtctttaattcattttgatttgatttttgtttatggtgagaggtaggggtctagtttcattcttctgcattatggatattcagttttcccagcaccatttgttgaagagactgtcttttcctcagtgtacgttcttggcacctttatggaaaatgacttcactgtaggtgtgtggattttgtttctgggttctctattccgttnnnnnnnnnnnnnnnnnnnnctgcctcagcctcctgagtagctgggattacaggcacccgccaccatgctgttctgtgcgggagatgcctgagggggggaagaaaacacacacacaatacctttaagggtaaacaagctttatcccacgtaaatggcaatgcagatataataaacaaatgatataataaacaaattgcaatgaaaaggggagaagggaaaagatatatatatatattttcttacactcaccaaactatggaggattcatcaccagaccgggaagcaacagcctgggctccagagtcagacacttgtccgtgcacagcgagggaaggtctcatgaagtttcggtgcagtctgggactctagctgttttcgtaacaagttgtttggcatgagacccagtcacgagtgcccttcgtgactgggcttaaggaacacaaaaaggtcacaacttgtttttgcgattgtctattgttttttaataactaacgtgtaagaatagattgaaatagagatttctctgaaacagcgatggatgaatgcctcaaggggctcactcaacctgtttcaggacttagtgaccattgtttgtgtccatgttcaattgagttcaaatttaatatttaacttttcctccacacacatgcctggctaatttttgtatttttggtagagacagggtttcgccatgttggccaggctggtctcgaactcctgaactcaggtgatccacccaccttggcctcccagagtgctgggattataggtgtgagccactgcacccagcctagaattgtttattctatttctgtgaagaatgtcattggtattttgataaggattttattgaatctataaattgctttgagtagtatggacatattaacaatattgattctttcaacccatggaatgtctttccattttttggtgttctattcaattttctttatcagtgttttatagttttcattgtagagatgtttcacttcttcggttaaattaattcctgggtattttattttatttgtgtctattgtaaatgggagtactttttaaatttctttttcaggtcattcactattggcatatagaaatggtactgacttttgtatgttgattttgtgtactccaactttactgaatttatcaactctaatagttttttggtgaagtccttaggtttttccaaatataaaatcatatcatctgcaaacaaggataatttgaagacttctttccaatttggatgccctttatttctcttctctgattgccctagctagcacttccagtactgtgttgataacagtggtgaaagtgggcatccttgtcgtgttccagattttagagcaaaggctttcagtttttccccgcagtatgatactagctgtaggtctgtcatacatggcttttattatgttgaggtatgcttttatacccagttttttgagggttttttaaaatcatgaagtgatgtcaaattttatcaaatgcttttttagcatcagttgaaatgatcataaggtttttatccttcattctgttgatatgatgtatcacattgattgatttatcacactgattgatttgcatgtgttgaaccatccttgcatcctagggataaatcccacttgattataatgaatgattgtgttgttgaattctgttttgtagtattttgttgaagaattttgcatcaaaattcatcagagatattgacctgtagttttcttttattattatttttgttattgagacagggtcttgctgtgtcacccaggctggagtgagtagtgcaatcatggttcactgaaacctcaacctactgagttcaagcaatcctcccatctcatcctcctgagcagctgggagtataggcatgtgccaccatgcctggctaattttttgtatttttttgcagggacttatttgtatttttagggtttcgtcatggtacccagccaggctggtctggaacacctgggttcaaatgatctgcctgccttggcctcccaaaatgctgagatttacaggcacgagccactcgcctgaccaggttttctttttttcgatgtgtctttttctggttttgttatcagggtaacactggccttgtagaatgagtttggaagtattcccctctcctctatttttcagaatagtttcagtaggattagtagtagttcttctttaaatgtctggtataattcagcagtgaagccgtcaggtcctggccttttctttactgggagactttttattatggctttgatctcgttacttgttattggtctgttcaggttttggatttcttcatgattcaatcttggtaggttgtatgtatctaggaatttttccattccttctagattttccgatttattggcatatagttgctcatagtagccactaatgatcctttgaatttctgcagtatcagttgtaatgtctccttttcatcgcctttttttttttttttttttttccacttgagacagagtcttgctctgtcacctaggctggagttatcttggctcactacaacctccacctcctgggttcaagtgattctcctgcctcagcctcctggctagctgggattacatttgacagagttttagctcttggtcaggctggtcttgagctcctgacctcaaatgatctgcctgctttggcctcccaaagtactgtgagccaccatgcctggcctccttttaatctctgattttatttatttaggtcctctatttttctcagtctgactaaaggtttatcaattttgtttaactttttaaaaaaactttttattgaactttattatttcttttcttctattattaattttggatttggtttgctcttgcctttctagttccttaagatgcattgttaggttatttatttgaagggttttttgttgttgatgtagacatttagagctataaacctccctattagtactgctttccctatatctcataggttttagtatgttatgtttccattatcatgtgtttcaagaaatttttcattttccttaatttcttcactggcccactagtcattcaggagcatattgtttcctttccatgtatttatatagtttccaaaattcctcttgttatttatttctagttttattctggcctcctattttttttacagcgtgtgagctaagaatattttgaccttttttaatggttgagaaaaaaataaaaggatgatatgaaaattatatgaaattcaaatttcagtgttcataactaaagttttcttgggacacagccacatttacttctttactattgtttgtggctgcttttgaaccacgagggcagggttgactagtcaccacaaagactttatagcctgcaaggcctaaaatatttactatctggccttttacagaagtttgatgattcgtgccatagaggagttgtagcaatttttgaaaacttaacattttcaaattttagacggttactgcattcagatcttttatccttagcctctcaaattaaattttgttctaatagaaatgactggatattaacatattttaattaccttaaaacaagtcttgctcctcatcccccttcctcaagatgggtttcttgtaactagcattagttagcttccgttctttctgtcctggaagagcactagagagttgtctaagaccacccccactgcccctgctcctctgagttggatgaaggatgaaacaggggaccagcaggagtagagtctgttggacagacagtaaggcagcatctcaactgtacagagcacttggtagtctgaaatttgatctccgccaggtaagagcaatttacctgcaggaaggattgatgggtcagggattaatgccacatagttcctttttcactggaatccagttgtctgatgattccccaccttgtgagtctgaacaggatactgaagcttgctccctcttgagaatctggaagggccagatgactgccttcctagcctcacctgcagctgcagctgaggcacaggaatgtgtcttgggctctggccattaggtacacctgtattggactgtgacctgagagctagagatgcaaagaaatagggattgcctggaatcatttctggagagcacggttgtaacagcactcatgacacccattgtttaggggcagcaatagaacctggtgtgagcagcacagcccagtacccagcattggtccatgtggtacactgtgtccaaaggtgtagggctggggacagacttcccctgctgggcaaggtgttgttataagctcggttctttgttaatcctgcagagtctgtgagcattcaaatatcatttattaaatatctcttctacttaaaattaacccaaggtggtttctgttgcttgcatcttagaaacctacatgtgtcaagctaaagagctcactcaaaatacctaattttttataaaattttttaaaattttccatattttgaaacttactgaaatttattcctttcagcatcttatgctgtccccattttcctctttattcattccaaaaatgtctgcccagtacctactacatgcccagcacatggcttcacataagcagaaacacaagcagaagaatgtgtcagtgtttggacttagtgatgccccacttagagaatgccatccagtgtagtcttcatccttataaccaagttcattttatctgtgtattgtgggccatattagactacagtgagggacccaagagcaacttggaaagaaaagaagtcagattatcctctgagagtgaaacttcaaacttgacacaggagtagagctctgtagtctcctaaaggggatggagtggctctggatgtgtatgtaaagaaaggacatgaccatctgaaaggcccggtgagcatggaagcagcagttgtatgggcagtcacagaggtgaagctggcaaccaggcctgggggccaggcagcgtggccctcgggcccaagtaccaggttcctgctgccagctctgcccccagtttgggggaggtgaatctggctgttgtagtcactgagtattcagactgtataactatttttatgaattcaggcacaccagacaaccttctaattataacttaggttttcatttgacctgtgtctaggagagaacacattacttatgaaagctagatattttagtttgcaagttggagttgtggttttacacgtcagttctaaaagttggtgaatgaggatgcttgagtggcaggtctaccttagggtgctgacaacattcattgctcagcttcagaagctgaaggtcagactttacatttttaaaaattcaccaaggtgggattcttcaccaaggtgaagccagctggattcaccagcaaactctgtcactgaaccgaggactttttttggaaggggggcggatttcagtatatgtgcatgtgtgtatacgttagtaagaaaaaatcacaatttgtaaggtacttttacaattttattagcactatcatgtttgtatgaagcttctgaactgaattcaaccattcaagaagcatttcttaggtacctactgttgccaggcttgaagagctcacatttcagtgaggaagagcaaccaacgtataaacaacacacaatacagcaagtgcaacaaaatagatttgtctaaagttcagtaggatcccagaggagaaaacagcttccactgcctccctgggggagctctggaaggctccaccaaatgggaatattgtgggagtcctatgtgaggagagaggctggaggttcatccacatagagaaatggtagatcctggaaacacaagagtgtgctgagtctagggaagtggttgggaaattaaaatatagcacaattagttgttagaaggggaaaagtgattggaatgaggccacacaggtgagtatgcagtaaagggtatgtctcatgtaccatgctgctgtggtctgaatgtgtctccccaaaattcatatgttgaacttctaaccccaaagtaagagtattaggaggtggagcctttggagagatgattaggtcacgagaacagagctttcatgaatgagattactgcccttataaaataggcccaagggagcctgcttgccccttcctgcatgtgaggacacagtgagagggtgccatctatgagcatggagagcttagcttggacagccagctgatgagggacacatcgaatcaagatacatgacatggtgagtgctgctgcacaatattgagctgttccccctccaaatgaaacacaaatagaacataattgagcacaccagttgtctggtatcttcatcacataaatagtacatgtgtgcacatatagaagtgatttttacacaagggtgtatttttgtgcatctagtaggattcactatggtttcatttttaggtatttctctctaacctggatataaccagaaaagaggtattgatctctctaataaatttgcctattaaaagtactaagttttacaagtgaaattattaataccatgggcggagttccattttactgtattctttttgcttatttacttctgggtcttaaagtcaattcacaggtcctcatttacctgttaattgtgcctgaaacccagtctttcccatctgtttttactagtcttatagtttatatcccttaacttttctcgtcttcctttgagtgggctcctagcataatgttttatgtcttctgttttattaagcattatttggaaatggatatgattttaatattggttatgtatcaagtaggggctccttgggctttcactgtgggtaacattcatgtgatattggtctcagagttaatgccccttttgtcctctgaaaattgtgtgcctgtaacatcttcaggagccacatggtggcaggcgcagtgctttgaaactttgtggacttacatactcagagtgtttgctttgcatcttcatctttccttcttttaaaaataatgaagatattgaaattaataaaaggaacctccaaatatctaccacccacctcaagaaataacaccttacagagttgaggtctcttggttcagtttcctcttccaatcacattccctcctcctgttttcctccacgaagaagccctttccttaatggagtttggctcacttttgtgcatatctttatactttcattacacatttatgtattcttaacagtgcatgggattccgtctttcctttaggttttccttggtgtatactgtttgtgtcactgtgcaagttgcctttttcactcacttttttttttttttttgagacggtgtctcgctctgtcactcaggctggagtgcaatggcgtgatctcggctcactgaaacctccgcctcccgggttcaagctattctcctgcctcagcctcccgagtagctgggactataggcgcccgccaccacacccagctaatttttatatttttaatagagacgaggtttcaccatgttggccatgatggtctctatctcttgacctcatgatctgccctcctcggcctcccaaagtgctggaattacaggcgtgagccaccgcgcccggcccactcacatttttaaaacatttatttgtgtagatgtgtgcttcagtgaattttcttttacagctatacagcatttcattgaagacatcactattttagaaatctgttttcttgatcttgagagaagcagggtagtagagtgatcatagatggggcccctgatgcccattccagtccccattctgtcactcaccagttgggagcccagtttctacttccgagaaatagggataccgctcatttcacagggtgttagggggatcaaatgaaatagtatgtgaagcattaacaccatgattattaccgtcattactgccactagaacgagatgacagtaatgcagactcagggcaggactaattttgtgctatattttaacttgcagttggacggagggcactctgaaagaagtagggacaatagcttggagacagctgaggtggcgtctttctgaagacttctgttttctctaacataggtggggttatctcccaagagtaatagaaaaagagggtgggatcggtgattcgagagtactgagggtttgaagtgttctcatttggggcatgatctggctaaatacatgcaaaataatttcctgtgttggtgtgtgtgctaatcttgtttgatttttttcttagcaacctgtttacctggcaaagcataaaggcttctcctctggagtcttctcttccctcccccatggcaggtgttgctgcctggagctgcttccacaactggttgtctccaggattgcacccctccccacccggaattctaaccttgtgtggcttatcacctgtcacataaacccatcagcctggctctcactcttcaaaagctgactctaaactgcccggctccccgcagtcattgctcctactgtttccagagtgaggcgcccactgttccctggctcacttctccaccttcccatgcctttgcattctcctctccatctagaatattctctcctcccttttcctggtgccattctttcacaatgtaacatatcccttaatgtatttcatatgatcttgggcaatctatttaacatcctcagatatgatacttcagatctctcattagaggaagcacccagaaaacccaggagtcctgacctgatgccttctgctgtgctgtcggtgcatcacactgcacacatatacagcagtgtatgaccttctggctttaaggaagttatgcttgttttcatccccacggttgaagtttttttttaacttaaaaatattttattggccgggcgcggtggctcatgcctgtaatcccagcactttgggaggccgaggtgggcggatcacgaggtcaggaggtcaagactatcctggctaacatggtgaaaccctgtctctactaaaaatacaaaaaaatttgccaggtgtggtggcaggcgcctgtagtcccagctacttgggaggctgaggcaggagaatggcgtgaacctgggaggtggagcttgcagtgagcccagatcgtgccactgcactccagactgggcgacaaagtgagactctgttacaaaaaatgtgtgtgtgtgtgtgtgtgtgtgtgtgtgtgtgtgtgtgtgtgtgtattattataaaactattcttttttattttctaaaaatagagatggggtctcactatgttggtcagggtggtctcaactcctggcctcaagcagttcttctgccttggcctcccaaagtgctggaattacaggtgtgagccactgcacctagcctgaaaattttcattctaatataaaaatagaagaaacaatccttatactcatcacccacacttcttgccatatttgcttcacatattcttttttcttttcttttctttcttaattatttaaaagcaaatcccagacatcaggtcatttcatcccaaaatacctcagggctggtccctgaggagatggacattttcttttataagctggtctctgagaagatggacatgctattaccatatctaacaaacgagtgataattctttatcaccatccagtaccccacccataatcaaatgtcctcacttgtcccaagagtagcattctacatttgttttctttaaaccaagatctaaacaaaggccatagtttaataatacatttgattgatatgtctgttaagtctctcttaatctgcaggaaaaccccttctctgtttttcctccagtcattgacagagataccagctctgttgtcatgtagaattaaagttttgaatttttaaaataaaccttattttggaataattttagatttatagaaaagttgcagaggtcaggagctcagataatcctcacatagtcctcacctagcttcccctcttgtcagcaccttccattatcttcatcatgtcttttttctatgccatcaatcagtcgaggataccacattgtgtttagccgtggttgaatttttaaatgatttctgattataagttctcatctactgctgagaaaaataaccattttctgactagcaggcagtacaccgttatggtttaaaaccaggctgaggccaggtttcagtttttcactcaattacgtaataactgtatagtaagttacactttctatgtcttgtctcatcacctttgaaatgggaataataatagtactgtttcattggattattgtaaaaactaaatttggtaagtgtatgcaaagtgcttatcacagttctgggcgcataagaagcactcaatacatctagctcttgaccaaggtgctatttcctaaattatattgagccccggggaaggaataatcagagcctttatttcttccccaaggctctgatttaaaaaataacctatcaatgttttttttcactttccttagaaatagtgcacttgctttggttctatatagtggtctcattacattttgaggtatttcacttctattttgggaatttttgttcagtagaacatagttccctagagtgttttgatcaatcaaaaatattggctctaggctgggtgcagtagctcacgcctgtaatcccagctctgtgggaggccggggcgtggggatcgcttgagctcaggagttcgagaccagcctgggcaatgtggcaaaaccctgtctctacaaaaatacagaaattagctgggcgtggtggcatgagcctgtagtctcagctactaggaggctgaggtgggaggattgcttgagccagggaggcagaagttgctgtgaaccatgatctaaaatatatatatatatatatacacacatatatatacacatatatataaaatatatacacacatatataaaatatacacacatataaaatatatatatacatatataaaatatatatacatatattatatatacacatatataaaatatatatacatatattatatatacacacatatatatatacacacacatatacacacacacacacacacacacacacacatatatatatatatatacatatatatatgccctaagagtgagttttttctcttggcaggggttcttgagatcaggattggaggattaaaacttcaggcctttcttttattagtctcacagagtgactggtttgatttgtgttttagaattagaatcaccttcttcaccagacttcctttgcatgaagcagtaggagcaagtggctgcttgaccagcttgagctctaaagtgtgtttgtggtatgaagtgttctcagaggaaccgaaatcggtgtggtcacacatcatcagtgcctcttcatacacccacgctctcctgaagtttgctgtttgtattgcttccagtgcgtgttgctgttcaacagtacccttggtttcagcgtagttgctatgatgaagaaaacctgttagaatctgccttttttttttttccagaactgttggaaacattgaataattccatgtactctaaaaggaaataaagtcttttgggtaatttggacccaaagactcctaaggaatctaggaattcagttacatagaaggtcacttctttcactagcttttgcctccaaacctgcaggagaaaaccagctgaagaggaatactcatatgagtggggactgcacctgagcacctcacgaggctcctttcagaaccctcaaaccgaccattcacaatattcacgtggactaggtctgggtcatttggagagagagaaggtgtgggctggctgaggtgtctgggtggtttctagtcagtgtttacactccggggcttgcgctgcggctcctgcgcctgtcatgcacccagtttcccagaagcttccggggttaggttgtcagtgttgagaggcagtgctagttcagacttgaccttgtgatggtctgtgggggagaatgttttaggccctgggacagtgcagtttaatgactgaaacaggaatctttgagtcaaatcaacttgggttggatccacacactcttattggttgtattgtttggtcaagtcgtttaactgctttaagactcagtttccccatctgtaaatgggtataatcacaatacatgcctcatagggttgagatggaggttaataacacataatgtgctgggtaggtactccaacgtcagttgttagtaataattatattacataaatagttgagagactgagctttacaatacaagcaaacatttttatgtcctagcttttttcttttgtaaactcgtaaaagtctttattattagagtcaaagtaggtttaaaacgcttacgtttctgtggacaagattaaggcaacatgaagtacatctggctcatgctgtagttcaccaggtctgtttgttgctatgtccacaaaagaatgtggggagaaacgttagcagtgtgggtgcttcctgcctccctccctggccctctgtgtccagtctgcccttctgccctccctccctacacatctctgtgtccactctccttgctgttctctctgtcaccaccctggctagctcaagctgctgtctgttccatggactgccatgtggctctgcacagctgtgctggtccttaccctggggcctttgctgcctcagagagaggggtcctcagcaaacaggtgggatcttgtcagtaccctgcttaagacacgggcggcccttggctctcagggtgaagaacaccaggtccttcgaaacatgccaccacccatgtctcttgtctcatttcacctcctagccctcccctcagccacagggtcaggccctcttgcttttgagcctggtttcttggatcagatccagtgtttctgtctcaggaagcttgcccctgctgtcctgctcccctccctgctgtcagcatccactctgcaccctactttctactacttgacatgttttaaattgtgattatatggttgataccagtgtcccctactcgactgcaggctccacgaggccactgagtctctgctgctaagagcagaccccagcctaggttagacgctcactaaaggtgtgtgaggtgcacagctgggttgggggcacaccaggcacccttctgtgttgtttcttatacttggctgatgacagactctccgcatgtgacttttgcttttttctcatccgctttaaacctgtgttcccggtttggaaggcccatgcctctggcagtctcatccccttgacaggtcctcaccatgctcgggcgcctcctccacgcgaactgccctgaacttgctctctcaccacccagaccctgcctaggcttccagtctctgccaaccagagatgtcctggtagacactcttccagatgctggggagggtgtggacacatacaatgtatgtacatatgtggtctttgcatgtgaaatagaatctcttagcttgtatcctatggtctttttttcattcagtggtagatcatgaacacacatttttatgccaaatacatgtttacattatcattttcagttgccatcagtcactctggcatagtaacactacataggaaataaaagtttttggaaaacttttgtctttagggctagatacccttaaatttctaaattagatttgtgtcattgaattgaacttttatatcggagttaggaaaaaataataaataaagggataatacagatatcagaaacgtggccacacagcttgttatgtgtgttgttgcctttaagattagactgcacacaaaacctggggagtattttgataacctggtaaaaacaattttgaagtgaaagttgatgtgttgacaatattggctatagtcatgaacctatactggggtggggcaggaattgtggtttattttttaagacacaccccttgaattccagggcagggagaagaaccgtttttgttctttctggtcttcagaatatcggaactgttagcttgcaagtaactgttacatttctcctctcacacagaagtatttaacctattggatttttttgtaatgacgatttagtttagaaatatgctgagcagatatagatacgctagaatctatagcgtatagttgtatgtatagttggtggtcaggcagaacggatagaaacaatatctaaaaagtgatttcaatacatatatatgtatctagttttaagtcaaattatgggaaaatctggatttgtggaaagctctcatttgtgaagagtaccactagaattccttttaaaaataagttcatttagggaaagaaaaattattctatgtgctaaagttttagctttatatgtagttttccagaagcaagtttactacattgagtgagataccctctattttgccctcagggaggaaaagtgcagtcctgctgcaagcttctgtctgtgttccttccctgaaaggtcagcgctctgttgaggaggaccctctgttctctttgggtcgggtggggggtatggtggggctagggtgatcagcatgcctttttgtggtccttatctactctagagctcttatcctcaagcagctttgtgaccaaagaaaaggtgttcatggagaaggatctggggagcccagaggctgttcagggttctcctccacaccccaaaggcctggcacactgatgcctttgggaaattgctgaatgtgcagagcctgcccatgtgtacctgctttattcaggaatgagatttctgactatatgaagaaggagaaaagtgtgcttagtcagggagtcatgttgcacaggtcctgtctgaaaaccaagtaatgttagcctgcagagaagaccatggaggtcacctaattcagccacttctgattcaagtggaacaatggaggactgtgatagttaaatgacttcctgtgtacttataaggtagtcacagcaagggagtttccaaacgtggaactgtcagctaaatgtctactggtcacctcttgtatccttccactaacctaccttgtactctcccttggccccttgaaaacgtgggattggataggttacttagaatttcattctaaattatttggaaatatacctggaaaatttgcatattgtatcagtggcttttgagaacatttgataatggtctaaattgaagactgttgatggccccatgttgctggttgtggaagaggctgctgtatgagaatgacacaggcaagtttgcatgggcttttttttttttttttttttttttggatataggggtcttactctgtcacccaggctggagtgcagtggtgtgaccatagctcactgcagcctcgaccttccaggctcaagtgatcatgatccccccatctcagtctccctcgtagttgggactacaggcactcgccaccacgcccagctaattttgtattacttgcaaagataaggtctcactgtgttgcccaggctggtctcaaactcctgggctcaagctgtctgttcacctcggcctcccacattgctgggatcccaggcgtgagccaccacactggcctcacatgagctttaatgacagctcagcctgtccagtcagatgtgtcagaggtccaggaagcctgattaaggagaaagttcagaggggcttgtagacagttgcaatattatctgcttgtgagtgggaccatattttcatgattttttttttccacacagtgaacagtttttgtggacagatgcttctgccttctcatactctctgctccagttagcttgaccttgagcctactcgcaatggtacatcgttgaacccttttctgcagcagatatatagccctgttcttccttcaaatttatagcctagagcagtcttgagaggcctcacttaggaagacagcttggctggcaaataaatgtttgccagatgaatgtgtgttggacatagtatggagggatattcttgctttattagataaaatttgattttccctgtaaatgattatttatgagataaaacataaactaaaaatgattcatttccatcaagtgcaaagttagctgcaaaacataacattcttcctttatgtcacacagggaaattaatggcctggaaatgtacagctgctcaaccagtttacgagccattagtacctagtgtactggcagtgagccccagttagccatggaaaccagcttgcagctttcttaactctgtataggagaaataattgatgattcagtaacattaatgatcatatttacagcttgatgtttaattaggtttctttaccctcttatatctgaaggggttaattgcaacaggatgctaaaagctggactatgacaagtttaggcaaaaatccaggctaattttttattcttatcacaaatggaaaatgtttatacttgtggaaggtactgttcaactccacaaatatgaaagcttcagagttttagtctcaccaagaaagtaaatttttccaatactgtagaagaagtgtgtcttttaaaatctcatttaggtaacattgagtgttacatgcagaaatgaaaaagcttcaaaactctggagatttcttctcaaacatgacattgtaaaatgattaggctctcaaaattaattggttgaacaactaaaacataaagcttgtttaacaaacgtgactgtcttccatgtccctggccctatagatgcagcggtaagtgggatatggggtttagaaaggtttctcggaagagatgatccttgtagtgagtcttagtgggatgatcaggagctagtcctgccagtgatccttcttccagtcttaccaagccatatgtgcaaaggctagaaagtgagaggaagcacagtctgtctgggaaactcctggagtccagtcctctcagctgggatgggggtgtgagatctgctggagtcaaagtacagattcaaggagaacccagcagtttggaaaaaaggacagaaagttgtaattagggccagaccaattgttaaggcaaatgtcttattcccagtttttgtgaactgttgttcctcaagaaccactgggcatgtgggggaaagccccaggagttttatgaggtagtaatttccccatcactgcaagtgtccatgaagagacaaactcccaggtcatagatattgtatagggatgaggccatggggaaaatgacggtggggaattctgcattgaatgagagtctggactgaccttcaaagatttttttagagtgctaaaatgaaaaatatctctatttggaaacccgcagaaaatgcatttatacaggcctccctctgtactgtcaaaatcatgctaagacagttatttgaaatttgaaacccttttaaatagggcctgatctgagaattcaggcataattaataattccatctccatgggaaagtacatttgaaaggaaaaatagatggggactcctccctgtctttgtcatggccctgctgtgtgtcctgggtgtttgcccatctgacccccttccctgtgctgatgtgctgctgtctgaagggtgctggggagggaaagcagtcctctctctctctctctctatcttcagtgaaaagatcctggttaggcggggcacggtggctcacgcctgtaatcccagcccgttgggaggctgaggcgggcagatcacaaggtcaggagatcaagaccatcttggccaacatggtgaaaccccatctctactaaaatacaaaaaattagccaggcgtggttgcgcgtgcctataatcccagctacttgggaggctgaggcaggggaatcgcttgaactcgggaggtggaggttgcagtgagctgagatcgtgccactgcactccagcctggcgacagagcaagactccgtctcaaaaaaaaaaaaaaaaaaaaagatcctggttaaaaaggccttccccaaaggcccagaatttaattttactcagctgtggcagtttcatcagaacataagcattgatttgctgaagttcctgtttgtcagtacagcctttttaaaagtcagagggcaagaattgtttcagctcgtttgttttatggcttggtaactgtccctgttactgctctcccccgccccgtctaaccccctgcacatccttttaacactagtctcatcaaatgcaggattcatcctacacagttaggtgtttcctgtctggttaacctttagtagtcaccaagttgttttcccttgtcagcaagctgcattaatttttaaaaactcttttaaaaataagcaattatttacatttcctatggagacaggtcatatttaatgttgggatttctgtatttacaatgaatatacaattgatttgtgttttattcattaggcgtctattctgtgttgatggtgggggaaaacaaggaagattagtggttgtttctgttctttttttttttttttaacttgtcttgattttaaaaaacgaaggctgggcacggtggcacacgcctgtaatcccagcaatttgggaggccgaggcagttcgatcacttgaggcttggagttcgagaccagcctggccaacatggcaaaaccccatctctactaaaaattcaaaaattagctgggcgtggtggcgcaaacctgtaatcccagctactggggaggctgaggcacgagaatcacttgaacccgggaggcggaggttacagtgagccgagattatgccactgcactctagcctgggtgacagagggagactctgtctcaaaaaacaaaacaaaacaaaacaaaaagaattggatacttcaggagttctaaattgaaatgtttctattactgtaaactaaattgtttggtatttaaatcttctacattctatttgtttttgagtggcaatatattcaaagttcagaaggtgtagagtggtgtgtgtagtggaaatgcttccttctgcttctgtctccccaggtccctcagaagcagccagtattaccggttttttgtataccctcccggagacagatgtaactgtcaactgattttttaaaacgtgtttcatcactcattaaatctagtgtagtgacaaaaatggtaaattttttccctgcatctttaaaaacatatgctgtgtttgaatggcaattatgaaaagtcatttgtttttcctggggccgtggacctagcgtaacaaatggtagccctcaggggaactagcatctgtgtcctaagtgaaggaataagatgtagacttccctttcctatgggttgccttaatttttgtatatatagagcagattctctcagagatgggaataactctctagctcttagtgtaaaaatattatcagacccatttctctgtgttcttgtcgagaaggttctaaaaggaaaagaggctggtataaattgcccagagaaaaattcctagaaccatttagtcaaactactggctaagatcttgctgggaggtagcctgtatttgtggtgtggtcctgtgttcccagtgggactgaagtggattggagggccgtgctgtgcctgctgttgggtagcatcactttgagctggatgacgaaggactttccccaaacctgtcctctgttgtacacatccccacacccaaaaccttcctaacattgtcactttccgaggtcaaatgtacagataaatacagggtatataggacccattccaccttaaagccaacagcattgtgtcagccggggtggcctttcctacgagagggcattattcacagccagtaattacaatgaatgaaggaagaaaccatcttcctttcagttatgaattcttcagtaatatttaatgaggggtgggtggaccaaagacacttccttcccttctgaagaggatttagagtggagtggtaagggggaggaattggactgcttcccgttagaattctgcccctcctctcctttttaaggaaaatgtccctaaggagctcactataaccaggcggttctttaaactgacaactgcctgtgaagtgttgatggatttcctggcaaataaaacagcaggacccttctttagcgactaccttactggagctttttagcccaattttagttcagagtggtcctggcaaggtttttaaaggaattggtgtgattattcataacaattaaattttgcttattaataaacaagtaagtaacctgccttcttggtcaccgcttcccccctccccaaggtgcgaggcccagagataaggcaagttgtgccttgctgaggagggtgtgtaccagtgagaaacaggaagctgtgcttcagcagcttggtctgcctggaggtttctaaggctgagtcaggtgtgctgaggtccctcggcaagggacgctgctttcccctggcagccacactgctgagcataaatgctttaaagtgtcagcaattgatgtgtggagagaagtatgactgcattacagcttaaagagctttcacattcaggtctctacaggagaagacgagatcgccccgatagtttgagagtaaatgggttaccagaggaagagctaaggtgagtgcaaagtcatggttggctaaaggtcaagacatctaatctagtaagtgcagtggggattcatgcctaagtggatgcagcgttgggaagtactcattgaaaagtagcctcttagtctgtaattaaaaactgaacacaatatcaagattgtactgattggaactgtgcaaaaccagaatacttttgcccatttcttcacaaatcctttaagttgttttaccccttctccaaacctacagtgttgttatgtctttaaaaattatataatcaccagaaatattttaaattgaaaacaactgatttttccacttagtttaaagagagttttctttggctgattggaacatgtttttgtctgtgttttgatgaaggtgggtagtttgtggtggtttggggttgggggaggggtgccatggagattgttactgaaatggtgtaacaaaggaatgcagtggaactattcaatgtagcctaggaaggaaggacatcaaaaacctggaaacctttttaactaaaaaggttagagttcttggctttcaaagtgaatttccctaaaacaacacaattttatttttttgttgcaactactgaaaatttcttagatttgaggttctgaaagcctctacaacattaagcctatgtgttaaaatactgcattaactgaagggtttagattttccctgttcctgggatgttcctgttttactgatgacagaaggctgcagtaaagagagacttcctttttttaaattacatttactgtttagtactttaatttggaggtcttgatttaagtgtttgaatattctgattagatggcgggaaggctatctatactttgtgtactattgttctttttcctacaaactaacttccagagtttattttaaattctctatttaaatgtaacaaggacaaattgacaagcttcaacttctctattaaatttgtatttgtcacagacagctatactacagtaactgtaatttgctaaagaaacatttattttaaaattgttgactcaccaatttttgaagagggtagcattaaaggactattattgacactaacattattagaacttatcgcttactatgtcaggtgtctcttagctacatttaatgtattaactttgaattgactggattaaacaatttaaaagtctcagagtttaaattgttaagaagtttgtatgtgaggttagtgaaaatattgagctctatattgctaaccagatagacaattggaagtgacctctgaaaccaacatttattggtagactccagtctacaatggatccaagagtgaagttaccaaaaacagttttaatttcagatttcggggtttggaggaatttccttttttaaaaaaattaagttatataaaaaaaattctaaaccaaccttttctttattttcagacaatagccaaagtactcatgagtaaaataacgtatatgccaaggaagtagttatttacatagttataatgctctttcaaacaactagattttttttttttttttttgcttagaatttaattaaaagaggaagaataattcttaagtattgcctgttctagttgtttaaagagaaatattttgtcacccattctggtgatgtagttatctggtcatagaagggacttgtatttctgccacttttgtctcctaatgtagagaaaatgatcattttccttattcagaagtataggttagccaagaaaggtaaaccattgtctgtttatgcctggctttttttttaatcagcttaggtgtatttttttttaccctagttatactaagcctattttcaggattaaatgaggtttctgagctaataggaatcaaagagagtaaggactttgaagttaggtacaccagagtttcagtaccactcagttggacaagttatataatttttttaagtcttggtttattcttttttaaaaaaaataaggataaaaataactactattattgaacattatttactctctcacagaactcaaaccaccaattcagtgaggcaggtggcattgttatcttgcgaatagtgccatacagttaattcattgtttaattgttattgagtgcctactatttgcaaagtaaagatacagtgaggaataagacacaggcctcgccacaggaacacccacctaggtttgggcatatttaatatgaccacagattttctctccatgaacaattatttgattttgaatacctgtgctatcaaacatctttcatactgtctcaagtattgcataagacccattccagctctcattccttcttactcaagtgttcatttcttacgtttgtggactcttaacagaaaaactttcagagactaaaattggccatggccactgccagaaaacattttttgctcttaaagtttaaataaaaggctgtgctctgaaacacgagatgcacgtgcttaaagagcactgtaatacacatgaaaatagttctggcgtcaaacttgaaattgttcaaaaccgaagcaggtaaaaggtggcatgacaaacactgggcttcctagacttttgttttaaagtattaaatatgacttgaaactgactttattcacatactttgtacagtggagcattacccactgtgtttgtggttacagttagagtgaagtgacacaagtgacatgcttgttccagtgggtcggaagccccagaccttcacaaggcattgacccttttttccctgaagtttttggtgtcccaaaataacatctaagatatacccatgtacctacacttactcctttagctattctatcttttaaattatgttgcattcaaacatagttgttttttgacaatacctgaatgacaaacacacctgagaaattcctgccctttaaaaattctcaaagttactttttctctgcctcagatagaagggatctataaataactgattagaaacagtacaaaattgaagtttctcctggttgggttcaaaacagcttaatataggggctggtggctggatgcagtggctgacgcctataatcccagtactttgggaggccgaggcaggcggatcacttgaggtcagaagttcaagaccagtctggccaacgtggtgaaaccccatctctactaaaaatacaaagattagctggacgtggtggcaagcgcctgtagtcccagctactgtggaggctgaggcaggagaatcgtttgaacccaggagacagaggttgcagtgagccgagatcgcgccactgcactctagcctgggtgaccaagcaagactatgtctctaaataaataaataaataaataacaatataggggctggtaggccgggtgcggtggctcacgcctataatcccagcactttgggaggccgaggcaggcagatcacctgagctcaggagttcaagaccactctgggcaacatggggaaacccagcctctactaaaatataaaaaattagccaggtgtggtggcgcacacctatggtcccagctagtgaggatgctgaggcacgagaattgtttgagcctggaaggcggaggttgcagtgagccgagatcacgccgttgcactgcagcttgggctacagagtgagactctctcaaacaaacaaacaaaaaatatatataggggcaggtgaacttatgaccctcaggccaaatctggcctgctgcctttttgtgtatggcccatgagcttgggatgggttttacatttttgaatggttgaaaaaataataaaaatatttttcacatgtgaaatatatgaaattcaaatttcagtgtccacaaatgaagttttactggaacacagccatgcttatttgtatgtgttgcctgtggtggttttctgctacgctggcaaagttgagttgtgacacagaccaatgtggcccacaaagacaaaaattatttaccttcaggcccttcacagaaaacctgggctgacccctggtctagtgctgagataagaactcctagagctttcccttttccctgttccttcggccatgcttctgccctcctcactctctcacctcccagttaggtttatcttgcctggataaaatcagggctacgtcagccatttgaaaagaatatgaatccccccccccaaaaaaatgcagtttgaaatttgtatccctaatagtttaggagtaaagtgaaaatgggaagttgccacacagcagcagtgagctcttcgcttcttagacctcctttcctcctttcctgcagcgttgaccttgaagtagtacccttctcctgattcctggatggatcaggttaaccaagaatggaagtgcaaagaaatgtaacctttactttctggttatagaataaaccttccaagctcatatttttatagatatagcatataaaatcatttttaagtggtgggaatgtccttgctttggtttgagagtgaaaactcagatcatgtgttcctgactagtacataaccattaattgaacccctgttataggccaggcactgcattaagtaagggcttttgtgtgtgtgggcccaccatgtctcatgatcccgtaagagagaaagaactgaaggctataaaggtggtcattgttatgaaaccagtttctgtccttgattcaaataagttagtgcttagaattcagtcaacgttggagtagctcagcctaggctgtgtgtttcttgcatacctcttttgcagtttgctgatcactttttggcccaacttttaactgaaaaattatgtttgtattttagttttagaaatgtagtctgttagacaatagggataaaattgcagttttgccattatcttattatctgatattatctgttcttattatttggtggttcagtgagggtacatttagtcttcccaacaatgagcaaacacatgggacaattaataagaaatatttttctctttgctataggaaagagaaaaaccacttgctagtgttgctttttaaaagttcatagtgcttactcctatatgtttgattgtaacctacaagtacttatattgtaataactggttttacagaccccctcttcacccactctcacctcccacccccatataatagagaggggattcttcaaggcaagagactttaccatatttcctgtgcatctagcacgtactgcagttcagaatctgtttctcattgaatgagtaaaggaatgagaaactaaactggcctaaaggtacctcttttattctagattaaactctttacactctactttttaagtcttaattattaactttttatttatgtacagtatcacactgagagaagcctaagagacggatgtatctatcagagtatagatcatgattattttgcttttctctttcagtagttttggaaagcttagtttccaaagggaaatgtatttttcagtcatctaaaatatttctgcatatagtcatgtgctgcataaaacgtttcagtcaacgagagactacaaacatgacagtggtctcttaagattacaaggaagttgccctatgcagatgtaccattttaatcttttaaaccgtatttttactatactataatatttttagctattttatatatacacttaactgttgtgttacagttgcctacagtattcaatacagtcctgtgctgtacaggtttgtggccttggagcaacaggctataccacgtagcctaggcatgtaataggctgtactgtctaggtttgtgtatgtttatgtgaacatttgtatatttatgatgttcacacatgactaaatcacctgatgatgcatttctcagatcatatccttgtcattaagcaatgtatgactagtagagggagtttatgctgaaattaaaaatagcagtgttgatgcttaaaaatcaggtctgttaaaggaatgataagaagtaaaaagttattgaataatgatccctttctggtttttttttttttttttttgcactgctataggagacatttaggaacgaaccgtcaactttaacagaatcaatctgtaattttgttgtcagtacgcatcatattatctaaattatttattgtgacaattaaatcccaaaatttcaataatttggttgctttcctgttggtttttaaaaaagcaaacaaaatcttgaagtctcaggtataaattacttataaaagtcagaaaagatagttgtccaaaacttgtgctttacctacctgactttggatagatgttattaaaaggaaacagtactatttattctacatgtatgtatcttagagacacagcaactgattatatgtctgtgctactcattggctattctgtgactaaaacaaactttggacgtgaatattttcttatttaaaaaaatcttcttttagaagtaattattaaatatgtttcacataaatatgaacctccttaagtttttttaaatggttatatctgtttcctagggctgccatcaccaagtaccataaactgtgtagcttcaaactacagaaatttgttgtcgtagatttctggacaccagaagtcagaaaccagcgtgtcagcagggccatgccccctctgacccctgaagggagatgcttcctttcctctccaagcaccaggctttgcctgcagtgctgagtgttcttgacttgcaggtgccttgctcctgtttctgcccttgtggtcataaggccatcttctcagtgtgtctgtcttcaccacagctctggtcactttcccttgacttcttgaagtttgacagcagtaatactttcttcttaaaattgtctcctccattgtctcctcagccctgccttttcctagttttcctactggttacttcttttcagtttttcctttgtctttcagtgtctcccatggctcttgagtatgtatggctcagataccatccatgtgcagtcactgtcaaatcaggccaagagtcatttctagctctcacttaatgactagcaccagtttaaactagggatttccagttaatatttgtgaatcgataaatgaatgaaatgagctatgaaagcagtttattggatcatttattgaagaggcagtgaaatcaatgttgcctaggctgcagtgagccttcgcctcccaggctcaagcaattctcccacctcagcctcccgagtagctggaattacaggcgcaccaccacgcccagctaatttttgtatttttagtagagacggggtttcaccatgttggccaggctggtctcgaactcctgacctcaggtgatccaccctccttggctcccaaatcgctgggattacaggcgtgagccaccgcacccagcctcagtgcattaatttttgaagagaaatatgacagtaatgagttttatgaaggttcttgttttttctgagacagggtcttgctctatcacccaggctggagtgcagtggcacaatctttgctccctggctaaagtgatcctcagccttccgagtagctgagactgcattgaaatatttttttaaaaagcagaatacttatttgaccatctatgcttaaagcaatatcagtaggtttggtgtccatcataagcagctgtgcaattcaacagaaacgtattgccatcacctttgtctatctatgttgccatctgctattatagctgtttaaaggaagactgttgtgtggtattgggaggaaatggtacattttattgtcagaattctaattgatcggggtaatgagaatgaaaaaatggcagtgttatagggaagaagtattcgtatgcgtggaactagaaacggatcacaacttacatgttggcttctaatttgtaatgtttcaaccatgttcggatggaaagaagatgtataggattgtttccaaaaaagtttcttctctatgaatgaacttaggatggtcttcagagatatatataaagaaagagaggagacagagactgaaattgactgcttcaactgtagtgagttaactttcactcataatagaaatagctagaggttggattatttcaaaaagccagtcagtgtttttagagcttctgattctcacaagaacagatgaaaaaatgcaagtatcagttatagagaagactttccatttgagactctcagaaaaggtgtgggtggttactgtgtttgtttgacattgcatcctttaatgagcttgtttagtacgtgaggaagtggaactttaccttgggcctctctgaagcccagtttcctccaaatataaaaagaaaggcttggtccattcagaagctttaaagagtcatttttttcccagacaggatttccctgtggattgtggtatgtgaaacaaagtcagtgattctccatggaggtgatgtgaggagagaaggctatgtggcctagactgcagattcctttcctgaggtccttcctttgtcccatggcagctgcagaggcgtcttggtttaggagatcaagatttgaaaaccaggtgaaggccaggcactgtcgctcatgcctgtaatcccagcactttgggaggccaagccgggtggatcacttgagtccaggagttcaagaccagactgggcaacatggtgaaaccatatttccacaaagaaatacaaaaattagccaagcgtggtggcgtgcacctgtagtcctggcaacttgggaggctgaggctggaggattgcttgagcctgggaggttaggctatagtgaggtgagatcataccattgtactccagcctgggcaacagagtgagaccctgtctcaaaaaaaaaaaaaaaaaaaaagaaagaaaagaaaaccagaagacagcctgcctcacttaaaattgtgattttaaaaacagtgaaattcaggcatccctgtagtgagcctccttcgaaattcactgcactgctataggaaatcagagcttaattatgtcacacttacatgctgaagaactcagggatccaatgatacaatgtagggaatttgtttcaaaatattttatggttgatgagtagataaattgatcacgacttgatgactgttggagttggataatggttcagagggattcgttatactcacttgtttaatatatgtttgaaatcttcagtaatcaaaggttttaaattttttgaaatacgtatcatgacgaatggcacagttttaacgtttcccttatgtgtaactaacacattatactttttcatttatttagggcttatctgatgagtggttgtgtcccatccaaacatctatcccagtagtcaggaatataacaaagcccctgagattccctctgctgtcagctacctgtgtgtctgttgggatataagccacaccaggatttcaccacccatggctctagcatgagtaatttggaggttgagtgggacgaggaggaaaaatgtaggattctttaccttaatctaggctgtcgttctatggtaatcattaagctttcatattttgtgttggaaaaaaacagtatttcttaatgttagaaagtgaaaatggtaatgtaggggtaaaagattagattcagaaaaatgaacatctcaagttactgcttttacatctgtggagcagggatggaattgtttgatttttcagacaattaaaatttattatgacaggatgaagttggcttacagagtgtgggacacttaatgagtcagcttctagcctctggcttaagaatggggtagactagcctctggcttaaagaatggggtagactgacttggactctcatttaactgaagattttattttctatacctttacttgataatatatacctccgcccttcccttcctagttttgagtgtaaatacacttgttttaagttgctgagtgagagtgggtgaggagtctgggtatagcccactggcctgggtccagtgtcttgaataactacttagtaattgacttctgcaagtcagttatttttaggagctttgagtttctccctttgctagttgaatatgatctgtaaaagaagtgaatgttcttatattaacagatttagacctactcaaggaggatttattgtgtttcattttaaatatcaaatgattgtatgctgtggaacaaaagggactctgtcttggatgctaatctaccgtgttgccttttttttttttttctaagacatctgttatagcatgccatgttgacttctgattagcctcctttgagacctttgaatggctcctgattactactttacttactgtccctagtggaagaacatgtcaacctggatgttgtcacacagactccaggctgtgatgcgtacggcatccatgttctggagggttgtctgcacacgtgccctttcttcatggtctgtaagccctgggtctgggagcagtggtgcagagatctgcctgttttgtggctgaccaagaccacacttctgtctgtaagttccctcagtaaatcacccaataccaacaaaatagatttgtctttctccttctttagtttctcagctccttcacatttggaaccgctttgcatatatgcctccttcacagaataggtactttcgtgtttgtttgtttgttgagatgcagtttccctcttgtcacccaggctggagtgcagtggtgcaatcttggctcactgtaacctccacctcctgggtccaagcagttctcctgccttagcctcctgagtagctgggagtacaggcgcctgccaccatgcttggctaatgtttgcatttttagtagtgacgaggtttcccattttggccaggctggtctcgaactcctgacctcaggtgatccacctgccttggcctcccaaagtgctggaattacaggcttgagtcaccgtgcccagctgatactttccctttttactctttgggaagccacacatgtttgaaaagcagaaagttaattgctttttacttcctaagtaccttgtgtcagtgatttcatctgctaaattcagccatcttctctgccttgaaagacaccatgttaaaagttaagtgctgatgctgcataggatgtagggtccaggtgtctcaaggtcaggcaacgcgcattctcagagtgtgatgaacagtgaaggaaaactcaagggaggatatgcccagagtcctgatgttctggacaccttgttctttatcaggcagtgctagatcttattgcacaaaatggtatttggggccaaatgaatggtaagcgagccaaagagaagcctctctgcctcctcagctttgaaaatgtaagagggaatgcagatactgctatagaatcaacatgtgagtagtggcacttcagcaacttctacagagctgtacatgagtgcctgggattgtggcctcagagaactggaatactggctcaggctacttaaatgtagatgaaaatattaaaccaaaaggaaggtaaattgaccttgaaaagtctgtttatataagcagtttacttacaggcaatctgtacctgcatagcaagtgtacacattgatttctgaatgagaaagcactgacattgccttatgagccattatgatattgttcttctgattatgtttgtgctcaggttaataaagtgtaccaggtgactcccttgtccccttccccctccactccaggaagcatccgtgtatcccctgctctgctctgaaatagaacatttaatgttcatcatgacggcagtggaagatttggttttgccttttgaattattcctgctcttctgtccctttgtttttgccagcatcttaattcttactaattgatttggtgaggttatttttatgtattcttttaacacagaattattttttgtgtttcagagcagttttatttcaaaggataaaactgtctcttgaaatagtcatgtggtgctttgtctgtaataggttagaatattgccatccatagaagagtaaaaatgactgctgcttttaaataggcttaaattattgactttttatacaaccagcataggcgctgtcattagagcgtcagacctcttatattcagtctgaacatagtccaaatagtcaccatatttattagtttatttgaaccactctcaatttcaccatttgatttgctttcctaataggttctaaactctttgaagctcagttattttgttctgttttctcagcctatgaatttggcctcttgccaagttagttttgattacatttttgctttttcatttatgagctgccataaaagagattgttctgtcttatgctttactaatagttggttaaaggtttgacttaaaagacttggttggcccagagtcatacaagtgcatgtttgccattctgaactgaaatccctggcgacagtgctgtttataaaaggattagagcagggagttttgttgccctaaaatcaggaaaattaagttttattttatattatttaagtaattaaatgataagaaatttacacacaggtgtgtgtgtgtgtccatccttgtgcctcaattacaaaatttcctgaaataatctccctgagctccatcgtggtgtttctcccaccaagcttttcttgtgattctgtcttgcacaccaccgttctttagaagtagtatttcttggaggtttgtgtttgagatggggactggatgctggctgtagcctctttgtggctccaaaggaaagaggagggaggattgtcctcaaagactcttacaagggtagagagggaggaagcaggctgggcaaagctcaaggaagtccatgcaataactgacctgtgtcaggttggggtctccttctagcaggatgtctgtagggggagggaagaaggactgcagggctctctggtgtgccagctgccagctctcatgcagcactcagttttcagtgactctcatgttaattcagcatgccagctgttcaatttaatgtctataccaatggggaatgggagagaggtagataatgaggaaagagaagaaataatgaggtaatatgtcatctcctaaaagctcattttgtaacagaaattgtccagactgttactgcattacattttaggtttttctcaatcccctcagaaaacaaagaagctcatacagaacattgcccctaccactagcaagaggcaaatctttcagccctcccaaggctggctttcaggctcctgaagctgtgccttctgaatgtgacaccttgtcctggcgacatctctggagagacgccacacacatcagtgttaagtggtacacatggtccttttcaccacaaatgtcctgaaatcgagggactatttagaaaacaggcggctgcttcattctattgtgggagtgatgtgacaggaagggaggctcaggaatgaccatgacaggaaagcatgtggagcactcacagtaaagcttcacagaagccctcacggccaggcgcagcagagcacagcgactgcccaaggagctgctgtcctagccaccctcccagtcatcttcaagaagaacaaaagttcactgatcgcctcagttcctttattctcctcttgttcttgaggactgaccaatgggtgtgtgtccctgtttgcctctttgctggggtcacagaggaacccaggagctcacattgagtggcccccagacatgtcactggggccagaaagtgccatgaggatgggggtctacactggggtgtggggtggccatatcttctggccctgacttgaacaatgagtccatgtgtggcctctagtttacataaataaagaatggctgtggctgggcgcggtgactcacgcctgtaaccccagcactttgggaggcccaggcgggtggatcacctgaggtcaggagttcgagaccagcctagccaacatggtgaaaccccatctctaaaaatacaaaaattagctgggtgtggtggcaggtgcctgtaatcccagctactcagggggccaaagcaggagaatcgcttgaactcggaaggcagaagtggcagtgagctgagattgcaccatcacactccagcctggggggaaagagcaagacttcatctctaaaaaaaaaaaaaaaaaaaaaagaatggttgtaatcccagcacttcaggaggccaaggcgggtggaattcaagaccagcctggtcaagatggtgaaaccccgtctctactaaaaatacaaaaattagtcaggcgtggtggtgggtgcctgtaatcccagctacttgggaggctgaggcagagaattgcttgaacccaggagggggaggtttcggtgactgagaccgcaccactacactccagcctgggtgacagagcaagactccatctcaaaaaaaagaatgaggtagacagacttggactcccgtttaactgacaggtttattattctgtacctttacgtgataacacactcctcccccccgtctgttcctagttttgaatgtaaatacagttgtttaaatcgtctgttcctagttttgaatgtaaatacaattgtttaaattcctaagtgacatcttggagaaagagcccaaaaggtctaagtaccatcagctgcagagtcctcacataggctgcctctgtcggcctgggtccaaccaggagagaaaacccacacgctaatttgaacaggaaaggtttaatataaagatagaattactaactctaacaaggttttggagtaataaggaattggctagtaagaggagagaaagcaaaagagtataggaatagccgctgtaaggagcagccacggaccctagagctgagttagagtgccaagggaggagccctactccgtgcccggggtcacactaccagggcatgctgcatgcagaaaagtcgctggcacagattgctggaaatcctcctttccaataccagagaaggctgttcccagtgagttccctcacccaaggtaccccctacatagctgactgccaagggatgggtgctgctggctgcatgcaccatcagggtccaaggcactctgctgtaaaacttttgaggggccagtgccactgaagctggtgctagccaccatgccctgcaggagctagacaccgaagaagccagagtgctgcaggagctttgcccagggagcaggcaggactgggaagcaaacctcttcctcctgcagtgtctctccagcaccctctactgacaaggtctcagtgctgctcatagaggacaaagattcacagaggtagcagtaactgcatcaccagcacctagcaatatcccagtgatgcctcctacaggacacaagggggtctgtctaagtgggtaattgccatatttttatatattattgctagatgtatagaataccactttttgagaagaggtaaggaatggaataaagagcttcctacttagccctgtgaactgctttcaaaaaccatagcttcattccgtgacagagaatggagagctctgtgtggggagagaggaaggttgagcacaggagcctgcagaacaagaggagtgactgaggcccctgggagatgctgctagcctggttgtagctgggcagtgttacatgagcaccagcttacagtggttgacctcctgaccttatactatttccacatcttttttcattgtacttatggcaaaatctaagttatggtagctgaaataatcccttgcctttctgtgtacatttcacaaaatttaaagttaatgaaagaaaagaaacctttttaaattcagcaaaatatacatatatgtgtgtgtgtgtgtgtgtgtgtgtgtgtgtgtgtgtgtgtgtgtgtgtattttagttcctctgcttcatcctggtcagtattttcaaatgctgtttaatgcagtaaaatctacacaaaacatgttctgtgtcaaaaagaaaataacgggcagtgaaagatatgtacatttgaatttgaaaaggttcattgttttcacttgactcaagtgaaatgttttttattctgttctattctgaaattctcatggttttcttttaccttatcattgagggaagtaaaccccgtgttaagcttagtcacaaaataaaaactcccacggacttccctcccagtgtagctgaaggttaatgtccagggagatagccttgactgagtcagaactaaaataagggtgttatttagagccagatactctggtgctacagccactacagccgtgtcaagagctcctgacacactggaggctgtcactggtgatctgggcgttctcctaagtcagcattcctagctaaaaatactgccattctgtattggaaacacagcttcctctaatttgtctgttttgaccagaacacaatgttatctttttaaaaagctgtttaggtgtgagaatgtatgttaatggatcacaatacgaataaaaataaaagaatgaaaagataagtgatttgaaatataaaggaactagtacagagacattttctagttaaagtttctaaatggtcagagaaaaatcacctaacctatgagagaaaattttaagatttttttttttttttgagacagtatctcgctgtgtctcccaggccggaatgcagtggcatgatcacagctcagtcatagctcacaggctcaagcgatcctcctacctcagcctccttagtagcgcctacaggtgcatgccaccgtgcccggctaatttttctatagagatggtgtgtcaccacgttgcccaggctggtctccagctcctgagctcaagtgatcctcctgcctcagcctcccaaagtgctgggattacaggcatgaggcaccatgcccagcccaagaatgtttttaaattgactaaacactgcttatttgagggaccatgggagaaaaaaaaattgtgaggtggcttatagatttcaaactatagtgattctgattgatcgagctgtctttcttgaggaaagttacgccaaaggcaacgagctagactgagctgtctgggtgtctgggtagggacgcagctcaccagggcttgccctctttagatgccctctgcaggcagtctagggacttctctcaagatgtccagtttgattaattgcatgatgacagtgtgcttggtgccatgaggggtataaagattcaacagaggctgggcgtggtggttcacgcctgtaaccccagcactttgggaggccagggcgagcggatcacctgaggtcaggagttcgagaccagcctgtccaacatggtgaaaccccgtctctaccactaaaaatacaaaaattagcctggtgtggtagcacatgcctgtaattccagctactcaggaggctgaggcacgagaatcacttgaacccaggagatcgaggttgcggtgagtcaaaattgcaccactgcactccagcctggcaacagagtgagactctgtctcaagaaaactaagcacaggctgggcacggtggctcacgcctgtaatcccagcacttggagaggccgaggcgggtggatcatgaggtcaggagatcaacaccatcctggctaagatggtgaaaccccgtctctactaaaaacacaaaaaattagccgggcgtgttgataggcacctgtagtcccagctactcgggaggctgaggcaggagaatggtgtgaacccgggaggcggagcctgcagtgagcatggatcgcgctactgcactccagcgtgggtgacagagtgagactccgtctcaaaaaaaaaaaaatgtctacttaagggcctcctggtgttcttaaggagatgaggagcacctttgcgatacagaacacaacattatatccaatgaaaatcttacccactcactgcatgggacacacagtgggtgctatggctgctgaacagaagatcgataaggcctggaatgtcaagaaagcttcctggagaagatcttgagcaggtacttgaggactgggcaggtttctgataagcagaaagttcaggagaaaaaaaagggacagtggtattcatccagaaaatcgtatgtcctttgtatgtttcacccagtgctggaaatgttgatcatcacttttaaagataattctaaagtcaccttgcaacaaccctgcatttatttaagatcatatatcatatatgtgtacatgtttttgttttgtttttttgagactaagtctcgctctatcgcccaggctggagcgcagttgcgccatctcggctcattgcaacctccacctcccgggttcaagtgattctcctgcttcagcctcctgagtagctgggattacaggcacctgccaccacacccggctaatttttgtatttttagtagagacagggtttcaccatgttggtcaggctgatcttgaactcctaacctcatgattcacccactttggcctcccaaagtgctgggattacagacgtgagtcaccgtgcccagccgtgtacatgtattttaaaaagaatagagctcaaaatgttaaagtacttgtttccagttggcaggaatatgcgtgattcttctctgcctttcatacattttctgcaataagctatattgctgttgggctgataaaagttgacaaattcaacttaccaaaccaaaacagtacagttcagtgatcccatcccaaagcacttacacatccatgcgcacgggctcacagaaactgaggcttgccattgttcagtcatttgttagtgttctgcttttaatgattgcacctttttgctgcccattctgttttcccatccagtctcgtgtctttccatgatgggtttcctgtgtgatgggagtgtctccattatcatagggacaggatggcttgttgcagggagtaagagcgtcacaagagtgtctgaggcactcagggagtgtcatggagaaaggagagagtgctgggaggagcttgatttcagtctttctcctttcccttccccaggctccatgtcctttacaaagtcctttgtgggtagatatttgttggttggttcatgttagcaacttttctagagatcatccagggagaggtgcttcttaagaaacaagccaccacataggtcgtcaagacttaaaactggttaggattgagtaactgacctatttatttgcagtactttctgcctgttgtgggcagtgtctctgaggccacacagtgctttcagacctgccttgtgttgcagaaccccatggacactgaggttgagcgtggggccattcctgccttctctgggctgtccctcagtacacctctgcctggggctcctgagtggccactctcttttgcctgtgggctttgggaataaaactaggatagttttccctcagatactagaggaggaattttttattgatacataataattgtacatatttatggggtgcatgtgttattttgctgcatgcatgtaatgcataaggatcaaatcggggtaactagcatatccatcacttcaaacatttatcatttccttgagtttagaactttcacaatcctcttctagctttttgaacatgcgcaataaattattgttaacattagtcaccctacagtgctgaggaacccaagaactattcctgttactcagctgtaatgttgagtcccttaacctctccctctctcccctcccagccacccttcccaccctctaataaccaactctgcgttctaattctgtgagttcaattgtatttttgctttcacatatgagtgagaacatctggcatgtgtctttctgtgcctgacttatttcacttaacataatgtaccccgggctcatcatgatgccaccactgacaggatctaattctttttttgtggctggatgatattccatctgaaacgatgtattttagatgattttaagacttaaatgggtgcctgctagttttcttccagaaatatttcaacctgatatcataatggcatttcactcattttccttttaagggaaataaatacagttaagatatcataaagtttgggatgctagaaacctatctgcaacaccgaagagagtctctaactctttagattaagtttcatttcagagggagtttcttgaagacaattagatgcaaatagccttctcacaattacaacctcattgtaatttctggactttgattccagtgtttgggatggtttgggcccctgggatggggttgatggtgcatagggagagaatttgttttgttcatttcattattgttaggtgataatcttttagtgactcttcagttatttttagcatatgtaacaaagccacggtagctctgccttactttgataataatcccaataagcaatgctaatacaaacatgtaaaaaatgtgctattttctttattttaaactagcttgagaaaatgtacattatttctttatcactgtcttgcttctgtggtaatgaataatttctttttgcctgtgcattcaaaaattaggaaaaaaaattgacaaggcaaaatggcatattaattacaaatccgtatctttttctggccaaactttgtctgttttctcactgtctgttgaaagaaaatccagtgcatttgttctagaagctacaaaatgggaaggaacttcccagtttcattatctttacttgcatgtcatgattgttttgtttttagtagtctgggggaaattagattgtattttccatttgagcaggatagaggatgatagtagaaacagttcattttggcatatgataatttcaccaggccaccccaacagttcaaataccccattatgacctggaagcctttgaatgcagttggagaagcttcatctagtagttgttattgccaagtgctccgtttagccatcagttatgcaaatctatttgtggaatagaatgaagcatttactaagcactccgctttttctatattggagtcctgtattttagaggcaattggttaaaatgtctagtttggcttttaaatcctacagatatttggtaatgatgtacataagtccatcattactacttaagaggagtaattttaagctactagtgttttttttttttttttttttttgagacggagtctcgctctgtcgcccaggctggagtgcagtggcgcgatctcggctcactgcaagctccgcctcccgggttcacgccattctcctgcctcagccccccgagtagctgggactacaggcgcccgctaccacgcccggctaattttttgtatttttcgtagagacggggtttcaccgtgttagccaggatggtctcgatctcctgacctcgtgatccgcccacctcggcctcccaaagtgcagggattacaggcgtgagccaccgcgcccggccgctactagtgttttttaaaagctgctttttaaaaaaatgttggctgctattttcatgactttattcaggccttaattatttgagctgctgaaaatagctataattttttgcatgatatctccaagtagcttatttgtatttggccatggcttatgtcagaggtggagttagttttgactaaaatcatgaagttagcagacagttggaatctgaagctttacagccttctttacaggacactactgtgtgccaactttgcatcactgtgcagtgagtgggggcccttaaccaagctattggactcatgcagccagggtcctagatttgccgcagtaggtcaatcattccataagtgaaacacgcagtagatgatcagaaaatgacaaattcatcaactgttttcataaagtagaaatcactctgctctgggtggatttaaggaacatgtggggttcagacctgtcctgtaggatctcccaaagacccaacttagccatgagggctgattagagtatagaacctcttaagaaacgccctggatttgttggcaagatggcaaataggaacagctccggtctgcagctcccagcaagattggtgcggaaggcaggtgatttctgcatttccacctgaggtactcagttcatctcattgggactggttggacagtgggtgcagcccaaggaggatgagccgaagcagggtggggcgttgcctcacccgggaagcgcaaggggttggggaactccctctcctagccaagggaagccattagggactgtaccatgcaccccggcccagatgttgcacttttcccacggtcttcgcaacccacagaccaggagattccctctgaagcctacaccaccagggccctgggtttccagcacaaaactggcggcctttagggcagacaccgagctagccagtttttttttttcataccccagtggtagcgtttgagtttttttcgtgccccagtggcgccaggaatgccaacaagacagaaacattcactcccctggaaaggagggctgaagccagggagccaagaggtctggcttgatgggtcccacccccacggagccaaacaagctaagatccactggcttgaaattcttgtgctagtatagcagactgagctcgacctgggatgctccagcttggttggggaaggggcgtctgccattgctaaggcttgagtagatggttttaccctcacagtgtaaacaaagccactgggaaattcgaactgggtggagcccactgcatttcagcaaggttgctaccctcagactgcctctctagattccctcctctctgggtagggcatctctgaaaaaaaggcagcaaccccagtcagggacttacagataaaaccgtcacctcccgggacagagcacttaggggaaggggtggttgtgggcacagcttcagctgtccctaactggcagctctgaagagagcagcagatctcccagcacagcgttcaagctctgataagggacagcctgcctcctcaagtgggtccctgacccccatgtatcctaactgggagacacctcctagtaggggccaacagatacctcatacaggagagctctggctggcatctggtgggtgcccctctggaatgaggcatccagaggaaggaacaacagcctgcagcccccgccagtgatacccaggcaaacagggtctggagcggacctccagcaaactccagcagacctgcagcagaggggcctgactgttagaaggaaaactaacaaacagaaaggcatagcatcaacatcaacaaaaatgacgtccactcagagaccccatccgaaggtcaccaacttcaaagaccaaaggtacataaatccacgaagatggggagaaaccagcacaaaaaggctgaaaattccaaaaaccagaacacctcttctcctccaaaggatcacaactccttgccagcaagggagcaaaactggaaggagaatgagtttgacgaatgtgacaggagtaggcttcagaaggtaggtaataacaaactcctccgagctaaaggaacatgtgctaacccaatgcaaggaagttaagaacgctgaaaaaaggttagatgaattgctaactagaataaccagtttagagaagaacataaatggtctgatggagctgaaaaacacagtacaagaacttcatgaagcacacacaagtatcaacagccaagtcgatcaagcagaagaaaggatatcagagattgaagatcaactcaatgaaataaagcgtgaagacaagattagagggaaaaaagtgaaaagaaatgaacaaagcctccaagaaatatgggactatgtgaaaagaccagatctttgtttgattggtatacctgaaagtgacggggagaatggaaccaagttggaaaacattcctcaggatattatctaggagaacttccccaacctagcaaggcaggccaacattcaaattaaggaaatgggacaccagaaagatactccttgagaaaagcaacgccaggacacataattttcagatcaccaaggttgaaatgaaggaaaaaatgttaagggcaaccagagagaaaggttgggttacccataaagggaagcccatcagactaacagcggatctcggcagaaaccctacaagccagaagagagtgggggccaatattcaaaattcttaaaggaaagaattttcaatccagaatttcatatccagccaaacaaagcttcataagcgaaggagaaataaaatccgtcacagacaaggaaatgctgagacagtttgtcaccaccaggcctgcctcacaagaactcctgaaggaagcactaaacatggaaaggaacaaccggtacgagccactgcaaaaacttaccaaattgtaaagactatcaatgctgtgaagaaactgcatcaactaacgggccaaaataacagctagcatcatattggcaggatgaaattcacacataacaatattaaccttaaatgtaaacgggctaaatgccccaattaaaagacacagactggcaaattggatgaagagtcaagacccatcagtgtgctgtattcaggagacccatcccacgtggagagacacacataggctcaaaataaaaggatggaggaaaatttaccaagcaaatggaaagcaaaaaaaaaaaaaacccaggagttgcaatcctagtctctgataaaacagcctttaaactacaaagatcaagagacaaagaagggcattacataatggtagagggatcagtgcaacaagaagagctaactatcctaaatatatatgcacccaatacaggagcacccagattcataacgcatgttcttagagacctacaaagagacttagactcccacacaataatagtgggagactttaacaccccactgtcaatattagatcaatgagacagaaagttaacaaggatatccaggacttgaacttagctctggaccaagcgggcctaatagaactcttcaccacaaatcagcagaatatacactcttctcagcaccacatagcacttattctaaaattgatcacataattggaagtaaaacactcctcagcaaatgcaaaaaaatggaaatcataatggtctctcagaccacagtgcaatcaaagtagaactcaggactaagaaactcactcaaaaccacacaactatgttgaaactgaacaacctgctcctgaatgactactgggtaaataacgaaatgagggcaaaaataaagatgttatttgaaaccaatgagaacaaagacacaacgtaccagaatctctgggacacatttaaagcagtgtgtagagggaaatttatagcactaaatgcccacaagagaaagcaggaaagatctaaaatcgacaccctaacatcacaattaaaagaactggagaagcaagagcaaacaaattcaaaagctagcagaagacaagaagtaactaagatcagagcagaaaaggagatagatacacgaaaaaccctttaaaaaataaatgaatccaggagctggggttttgttttgttttattttgttttgttttgagacggagtctggctctgtcgccaggctggagtgcagtggtgcgatctcggctcactgcaagctccgcctcccgagttcatgccattctcctgcctcagcctcccgaatagctgggactatgagtagctgggactacaggcgcctgccaacacacccggctaattttttgtatttttagtagagacagggtttcaccgcgttagccaggatggtctcgatctcctgatctcgtgatccgcccgcctcggcctcccaaagtgctgggattacaggcgtgagtcaccgcgcccggcccaggagctggttttttgaaaagatcaacaaaatagatagaccactagtgagaataataaagaagaaaagagagaagaatcaaatagatgcaataaaaaatgataaaggggatatcaccactgatcccacaaaaatacagactaccatcagcgaatactgtaaacacctctgcacaaataaaccagaaaatctagaagaaatggataaatcgctggacatgtacaccctcccaagactaaaccaagaagaagtcaaatccctgaatagaccaataacaagttctgaaattgaggcagcaagtaatagcctaccaaccaaaaaaagtccaggactggatggattcacagctgaattctaccagaggtacaaagaggagctggtaccattccttctgaaactattccaaacaatagaaaaaagggactcctccctaactcattttatgaggccagcatcatcctgataccaaaacctggcagagacacaacaaaaaaagaaaatttcaggccaatatccctgatgaacatcaatgcgaaaatcctcaataaaatactagcaaacggaatccagcagcatatcaaaaagcttatccacttcagtcaagtcagcttcatccctgggatacaaggttcattcaacatacgcaaatcaataaacgtaatccatcacataaacagaaccaatgacaaaaaccacatgattatctcaatagatgcacaaaaggcctcgacaaaattcaacagtgcttcatactaaaaactctcaataaactaggcattgatggaatgtatctcaaaataataagagctatttatggcaaacccacagccaatagcatactgaatgggcaaaaactggaagcaatccctttaaaaaaccagcacaagacaaggatgccctctcttaccactcctattcaacatagtattagaagttctggccagggcaatcaggcaagagaaataaataaagggtattcagttaggaaaagagcaagtcaaattgtctctatttgcagatgacatgattgtatgtttagaaaaccccatcgtgtcagcccagaatctccttaagctgataagcaaattcagcaaattctccagatacaaaatcaatgtgcaaaaatcacaggcattcctatacaccaataacagacaaacggagagccaaatcatgagtaaactcccattcacagttgttactaagagaataaaatacctaggaatacaacttacaagggatgtgaaggacctcttcaaggagaactacaaaccactgctcaaggaaataagagaggacacaaacaaatggaaaaatattccatgctcatggataggaagaatcaattttgggctatactgcccaaagtaatttatagattcaatgctgtccccatcaagctactattgactttcttcacagaattggaaaaaactactttgaatttcacatggaaccaaaaaagagcctgcatagccaagacattcctaaccaaaaagaacaaagctggaggcatcacgctacctgacttcaaagtatactacaagtctactttgttactacaaggctgttttgttactacaaaaacagcatggtacttataccaaaacagatatataaaccaatggaacagaacagaagcctcagaaataacgccacacatctacaaccatctgatctttgacaaacctgacaaaaacaagcaatggggaaaggtttccctatttaataaatggtgttgggaaaactggctagccatatgcagaaagctgaaactagatcccttccttacaccttatacaaaaattaactgaagatggattaaagatttaaatgtaagacataaaaccatgaaaaccctagaagaaaacctaggcaataccattcaggacataggcatgggcaaggacttcatgtctaaaacaccaacagcaatggcagcaaaagccaaaactgacaaacaggatctgactaaactaaagagcttctgcatagcagaagaaacaatcatcagagtgaacagacaacctacagaatgggagaaaatttttgcaatctactcatctgacaaagggctaatatccagaatctataaagaactaaaacaaatttacaagaaaaaaaccccatcaaaaagtgggcaaaggatatgaacagacacttctcaaaagaagatatttatgcagccaacagacatgaaaaacagctcatcatcactgatcattagagaaatgcaaatcaaaaccacaatgagataccatctcacaccagttagaatagtgatcattaaaaagtcaggaaacaacagatgctggagtggatgtggagaaataggaacacttttacactgttggtgggagtgtatattagttcaaccattgtggaagacagtgtgccgattcctcaaggatctagaactagaaataccatttgacccagcaatcccattactgggtatatacccaaaggattataaatcattctataaagacacatgcacatgtatgtttgttgcaacactgttcacaatagcaaagacttggaaccacaccagatgcctatcaatcatagactggataaagaaaatgtagcatatatacaccataggatattatgcagccataaaaaaggatgagttcatgtcctttgcagggacatggatgatgctggaaaccatcattctcagcaaactaacacgagaacaaaaaaccaaacactgcatgttctcataagtgggagttgaacagtgagaacacatggacacagggaagggaacatcacacaccggggcctgtcggtgggtgggggataggggagggatagcattagaagaaatacctaatgtagatgacaggttgatgggtgcagcaaaccaccatggcacatgtatacctatgtaacaaacctgcacgttctgcacatgtacctacctcgaacttgaagtataataaaataaatactttcaacagtaaaaaaaagaaaaacgcccttagggaattgaggacctcgcacaatcctaattcttcaccaaaagccacctagcagacctgctattcagacgaatctgacttttttggtattttcaaacaacagcctcccaccctacttcaatggctattctgatgccactgccgtggcagtagtagtttcagtcaaatttgtttgcatttcttagagtgacattattaattcctgaaaatgatttaacagtatcaaaatgcctgaatataaaagttgagctatggtgtttattcggaattaaaccactcccttgtcctcttgaaaaaataacatatttcttttagctttactctgttgtagctaaataagataagtgactgcaggtagtctttttgggagaattgtgtgccgcctaaactttcttttcttttcttttctttttttttttctttcgagacggagttttgctcttgttgcccaggcttgagtgcagttgcacaatctcggctcactgcagcctctgcctcctaggttcaggcgattctcctgcctcagcctcctgagcagctgggattacacgtgcccaccaccacgccagctaatgttttgtgtttttagtagagacagggtttcatcatgttggccaggctcctggccaaatctcaaactcctgacctcaggtgatccacccgcctcggcctcccaaagtgcagggattacaggcgtgagccactgcacctgaccaccacctaaacattccatggccacactgttacagatccttattcacgacatacaaacaaccttgttcactcagcactgggcaccaaactatgtactgtatagtcatagaagcagaggctatgacttttatttatttattcattcattcattcattcagcagattgtagtatcttctactgatggtgggctggatacttcttaggcaccacattgggcctattgcatcatgggctcatagtaaaagttccatatgtccaggaatgatgtaaagccaacaatggaataatgcgagcaactatttttctagaagaagtagactttaccagaatgccaaaatgggctgctaaaggaagggcagcccatcagtgctgtcaccagctcctgaaaccccggggcctgtttactcccaccattgcagtggaggacatgtctgagcctcctgcttgtctttaacccccacattagttcctttgtcgtttcagtgtaagtagcttgggtaatgtgcagagaatttctttgccttgtattatttatgctgagaatcaactggttgggtcatcagttcctagggagaggctaatgggaaggtgatctatagagtgtgatagaagacaatctagctttcttgctgcatcttttcttcgttcagaacgtcagcttctcttttccctcccaactcccagcaggatattcctgattgaaagaaaggccaagaggagagaatgagatctagcaaaattgtaaacaaaggaacagagccacaaacctgttttacattcatataaaatgttacattgattgattaaacagtttaaaaatatcttcatagtatatggtacctttgatcataaaaccaggtcatgttaaggtgacctctattgaagagttctatttagggttactgtgtgccaaccaccctcattaaaatagtcacagatgtaagtagaggaaaccagataaaaggaaagatctctatctgcttccccgtagtaatccttacatagcataacttgagttaagaacagccagatggaagagataatggggcaaggtgtggggaaacagagcagagcttctctcctctgggagcgccaccctcccagcacctccatatgttcagcaacccagaagttcccctaaactgtcctattgagtttttatggaggcttcttttcataggcatgattgatttgatcattgaccacaactcctctcccttccaaggggttggggctggagctgaaagttgcagccttcttattgcatggttgattctccagcagccacccccacacctgtcacattagcctacaaaagacacttaccacttcagagagtccaagagttttaggagtcctgtgccaggaaatgggggcggagaccaagaatagatttattattaaaagtcacaatatgacaggcagtttctttaaaacctaagcattcacttaccatacaactcagcaattttactgttgggcatttatcccagagaaataaaaatatattcaatacagaaatttctatagtttcattcacagtgccacaaattggaaggaaagtacttaaatgcccttcagcgggtgaacagtgaaacaaactatgcatccatgtcatggaatactacgtggcagtaaacaagagcaaactggacatgtggagcaacttggattgatctcagggcattgtgctgaatgaaaagccttaagatgtcacatgaacgattccatttggtaacattctttaaataacagaatcatataaatgaaaaacacatgagtggttgccagaggttaggagtgttggagtgtgcagaggtatgtgatggtcagagataacatgaaagagaagtctgtggtgatggaatagtcctgtaacttgatagaggctgttgttacaggaagctgcccatgtgatgaaatgacagacacccgcacacatgcattgttgcaatgtcaggttcctggttttgctcctgtactgtagtcacgtaagatgtgagcactggggagactgtgagggagaattctgagcagaaggctcacgtggcttcctgcctcctaccatgccacccccaccggatgcattaaatttctggtctgagtcagcctgcctctgtccccatccatctgtctgtctgtctctttctttccctccctccctgcctcctcactgtttcacatggtcattgtaaaaaagaaacctaaaaaattaggaaatgtagataaattgaaaggaaaaattttaaaccatgaggttgttcctttcttatttaaatatggtggttcccttgtttcatcagccataggctttgggcctgggcaggatctgtagcccacagcctttgagttcttgacctatcctctgagatttttaggattcaaagtagaaagacttggtcccctgcttccagtcctatctggtacccactccctcatcttttctggctaaccattgtgcttcccagtaattatgtttaacattttctcacatagggattaacaacataggctctggactcagagtgcctaggtttaaatcttgactccaccacctccttagtagttattcagtctctttgtgcctcagtttcttcatttgtaactaacacctatctcagaagccgtgggaaggattaagggatgtgataggaagcactcactgactcttggatatcattatttatggttgttacttggtgtctctggctgcattttgtttgtcgctgctggttccgtgactgtccatcagtgtgccttgcgcctgttctgtagattttatttcacagtctcttggttttggtgggtggcacactgccctgagaggacggggacgtgagaaagattctgagccctttagttgtctctagtgctacatcatgattgtcatcattgctgtaaaccaaaaagtatatgagacaagtcttactcaatttagaacatgtattttgccaaagttaatgacgcacccatgacacagcctcaggaggtcctgacaacatgcgccccggggtggtcggggtacagcttgcttttatacatttcagggagacatgagacatcaatcaatatatgtaagatgtacattggttcagtccagtaaggtggaacaattcgaagtagggggtttccaggccagaagtagataagagacaaaaagttgcattcttttgagtccttgatcagccttccgatgaatacacaattgtgtctggctcagtgaacctacatttttacgtgaacaatagggcagaggaagcaatcagttatgcatttgtctcaggtgagcctcaaagggatgactttgagttgtgtctgtcctttttccataaggagttttcttgcgggcaaatggtgagggagggatgtaggttgttatctttgtagctatcttatttagcaataaaacaggaggcaagtttgcctgacgtagtttccagcttgactttttccttggcttagtgatttagtttcctttcgcattgctaactcaatcacaggagacaggagtgtggactgaatatagcaagaatgccaaagtatgtaacagtttccttagtcatgatagagactgagaaacatcggctcacctaagctttgaggttagctggagtccagtagaagagttataactaaacactggcccttgtctgtttccacttgtgcccattcattgaagctgagattggactgagtacatttgtgactatgtaccagtagcaaaggtgatagaagtcaaacgtagctcttagttttaggggctcatggcctcctggggaagggacccatcaggcatagctggcagtcatggccagggttgtggaagcccaggtccaggcagggttcaaatgctcctcagagtgtgccagcagcctcagcctcagggagagcttgtcagggggatgttttacaaggtctccaaaagcctcttatgccctccagagtgaaaagcacggcattgttgatgaagtcttgtggcaaatatgcaaggcacgtgtggatatttctttctcttggaggcttacaaggtagccccggtctcctggtgcagtgtttatagcatagtccactgggactgccgctctgacaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattgtgagtgtctcctctcctggagtgccctcttccaggtccagcgttcttggctgtctgttcaggagccatcctgagctggcccatacaattttattgactggactttgggtgggagttttccagggtggtagggctccgaggggctcgcagcgcagcatgtttagggagacaggagactgccttgtcggtaagacatgcagcgacacgcagatgggagggaggtgctgccctcactgtgagagcatggcggccccgtcttcagtaggttcctgatcacttggtaactaactgcattttcatcatgtcgtccgcaagggaggcttagtgttgtcattgtcagtaattacgttagaaaaattctgcagtctaaaacggcccaaagataaggggcagatgggttgggacagtgaaaaaaacaaattacagactgttggtaaagataaatatttttgttttgtgtaataatcaacaatttgaagtaagctaactgggtttcttaattgaatgaataaatatatatatcgtataagtagcagctcaatacacatatagaacatactgttaactctaaaaagctaggctaatttatattattaaataggttttagcaaacacatttttttaagaaaatgcagagtagccatcagaccagctcaagattattgacctcattcaaagttgtgagcttagaattactgcgtatcccaaatttgtcaagtaagagttaatgagaatttaactgacccggttctctacttccataatccgtgctctgtggtacagatgtcacttatcttcacaactcacagagagctctgtttgacagtaactggggaattgtaataatacagtaaccaatattttgactgcttggtgaactctcaagaagatttttggatttatacattgctgcattttaggaccaaacaatttgttttgcatacttgaataatggaaagcaagatatcagttgtgctgtgtgaggttgatttgtggaagtggatcagcttcatcagtcatgcctggcctgacttttacatataaatatctatctatctatcgatagatagatagatagatagatagatagatagatactcccccacttacatatttcttgtcatcaacactttttagtgaaaatctttttctaaaaaattagctaattaattataactaatctgatggtagctataactgtcactaatgacttttttaaagtaatttctgtcatctgtagtattaaatataaaatcaacatttaaaaaaaaaacaacaacaggcattgtgccagagggtcaaaggcaaaagaggaaagggaagcctgactggttcagggggcagcaaggtgattgttctgtttcctttttccccctgcttgtgatgaaaaggaatacttcttgcaaaatatatattatattacctctaaaactagcggatttttcctgtgtgtgggaagtaactgtgtgcttgtttttatgatgtatctacctatttcctaattctacttgagtatttgaacttaagtagaaacaatctatattataatgagtttaaactggtcagtgataatcaaacgttttaatctaagggcctcttaacactcttaaaaactattaaggttcccaaaggactttcatttatcagtatttaccatatgagaaattgaaactgggaacaatttaaaatacttattaattcatttaaaaacaacactaagcttattacgtgttaataatagtaaatgttaatattaatgttgtcatgaaaaataactgttttccaaaatggaagaggcttagaggaaaggatggcattgcgttacatttttgcaaatcttgttaataaaagtttctcagatttgtttctgcattcaacctattacagtctattgttttagatgaaatatatgaagaaaacatggcctcccacagagatgtagttggaaaagaggacttttctgcctcctgaaagggtcatggtgacgctgacattttgaaaacgactgatttaggtgataatgatccaggacattctagaatattctttttgggcttttttagagtcccattaagattgttgaggtttggtgaatcttttgagagggtttagaattaacaacagagccatatatatgagcagcatcttacggtttccaaatagtttaaaatactttttcctcagaacaataatgagaacagcactgagaatgaccaggcagatgtggagcttaccgtgctccttcatccaggaatacctgtggactttggtcagaaagagggaagaagcacaaacccctccagagttttgtaaaactgccacaatcatctggcttacggcaaagctgggcgatgatgagaattttacagattttttccccaacctacagtaactttgaaatgacagaatggaaattcattttaacatgaggcttgggccaggtttactgagcagtgaagctgcttccctttctcccttccttccttttttttgtgacattttaattctgcattcaaacctgttaaataaagttgagctttgacgggtctgaagtgatgaacatggtgtgtctgcacgcagttatttatggcaaggctacaaaacaggatgactgttttgtgaaacattttggggagaaaggcaaagggaaagttgtcttccagaggtgtggaggggagtgaagcaagtaagtggaaccacttttgctaaggaaacagcaaaacttggaaaccaataggggcaaggcagttagttactctgtttatagaatggagactgtctacctgtctgtctcactagttggttgtgaaaattcaggagaacattggtaataacttcatgaagtacattgattaaatatctggaaggtcagaagctgtaccagggaactagacacacaggtgtagagctcatgctgtgggtaggcctgtgaaaataaacttgccaaaaattgaaggaccgcttggcatgggggaccttctccatttctaggacttttaagaaataaataggtcttcacgtgaaatcctcatctaattgtatgcctgtcaaagccatgttgcttttcttttcctttttcttttttgaaatggagttttgttcttgttgtccaggctggagtgcagtggcgagatcttggctcactgcaacctccgcctcccaggttcaagtgattctcctgcctcagcctcccaagtagctgggactacaggcatgtgccaccacacccggctaattttgaatttttactagagacgaggttttaccatgttggtcaggctggtctcgaactcctgacctcaagtaatccactgtcctcagcctcccaaagtcctgggattacaggcgtgagccactgcagccatctgccatgttgctttccttcttccaaactgcacagtggttagagcctgagattatttattgaatgccttctgtgttttaaggtgtagtgaggctaccgatgggggaatttcccacgtcaccagccgcagcagtggttacttgacaacttggtgtcactttcctaacctatgaaacgtggtggtatccctgtcatgtcctttcaagtgtttgaaattcgtggtgtaatctgttttgattgacagtgtgattttatgagcaggggacctggatttctagtcctgcaccttcctttaactaattagccttgtgatgttggtctgatccttccatctctgtgaacctgttttgccatctgtaaaatgatctttattatgtaaaattctgtgattttaagatacattttataatattggtaatcaggttcgtcttaccgattaggtaacaggactggggcatcttggctggttttaaggctacttaagcagttgttttccacaggatttaatcaaagggataacccgtgtctaggttatatgacatggcatttagttgacatgcattttagattctgttctcagaagggaaagaaactggccttgagatgttgacttttggatattttaattaagctacttattaagctataaacccaattccttgagagcagcttgtaactttcatctctgtctcaggtgcctaacacatagtaggcactcactcatagtatattcagcaagaagaatgccaaaaatgttagaaacagaatcaaagtgggacacccttacagagcctcagatgctacggtaaagaggctgaagtgtccgagttcagagcatgtaaggaacaagcaagaaattgagctttttagataaaatagggtttttgtgatcagatagaatttgctgctcggttcttagtgttgtttgatcttcgatctaagaagtggctgacggtctgcaacctgctgttctttgcgtgttacagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggtgagttgcactggacaaaagcagggaggtgccattccccgccctcccgcttcctgcccttctttcctgaggcctcctccttcatgttcagtttcatgatgaaagactgaagtgccacatgcatgccaggtatttgatagctgtgaggtcagaggtggcatctctatggcccatatgggcagtggcgtgattgggacaccctcacagaccctgcatttgtattgctcagttcatcgtcctatttcagaacccagagtcccttatgacagagcctttcagacctaagcagctcagctccacatagaaaattctttccgagtcttcagccacactcaggccccccacacacctcacccactcctgtctctgtgtctttcccccttctcagaggaccactggacctgctctaaaggagagcgtgcggtgtacgtcaccccctccacaacttcccagcctcgagccaggagcgtccatgcatttattttctaagggaaaaaaaaataagtattttagggaactatactgtctacatttagctctcctgggtgtctatgttcttttctaaatatttgtttttcttgatcctcgggtgttagcatatggtctgcacttcctttgtagtgtatttggtattctcaacattaccgaaaccactttcttgttgttttttattgttttgttttgtttgagacaaagtctcattgtatagcccaggctagagtgtagtggcatgattatagctcattgcagccttgaactgctaagctcaagtgatcctccagcctcagcctcctgagtagctggggctacaggcacgtgccaccatgcccgactaattttatttttcatagaaacggagtctccctatgttgcccaggctggtctcaaactcctgggctcaggtgatcctcggcctcccaaagtgctaggattacaggcatgaacctccatgtctggcccactgaaactcctgtctcacagtaaacatgtattttgggggataatctagagatgctgaccccaggctataaatgacggtgagagtgaggtgtatgtgtgtgttagatcaaataggtaatttacttttaccaccttacttcttacatatttgtacgtaaatgcacatctatatatgataatatatgtatatagaattattttatagctggagatggctgctctttgatttcttcttttgcctagcagatttttatgtttccctgttatataaaccatgcttgagcaaggaaaggtagttgacaaagatcattggtaagtccattgtatgccactccggcagcattttcccatagaaacaaacatgagagtggggttcccaggccagcccacagaaaagctgtttaccccatcatgggtacatgaaatacagggctagcaagtatgtaataatgtcaacttggaaacagctttaagggtttgggttaaggaatgctattttattcactagcacacatttttttaagctcctattgtgtccccaaaacacacattcccaacaacaaaaaccttagcagtggaaagaggttttcgttttctcttttcttctagttctttttttttttttttaagtttatttctttaggcctccaaacatgctctatgtatcttcttacagttcttcctgttcttcctgactccttccctgggcagtgggaatcttttggacaaggatgatggatttagggatgggcaaatgacagttgtgaagatggacaggagcaggagaggccaatgtaccacagcagaagagggcaggagaggagctccagaggtgtgaatggaggcatcaggcatagagaccccctaccgaggctataggtagactgtgattagctggtgaggagaaggaataggaaatccctaggtgctgcggcagcaagaagagagggcgtttgctggtggtagtggtggtgagccatgactcaattcagttaaagggacctgaggacctgcttctacctcggcaccgtggaggcctggtgggactatggcaaggaaggaggtgagactcccaaggcacattgaagggaattctggaaagctggcttggagagagcatggtcttctcactatatgaatcccttctgtatccctcccttcttttttttctctcctgtagtccagagaggttgaaatgtctgataacatagcaggtttgcgacatgaaagagatgagaacctagctggtctcctagtatccaatacaatattctttcccttacatattctttttaaatataagatatttttattgaaatgggtgattatgacaaaggccttaggagagctcggtccaggggagcaatagagaagaactcagagaaaaagacaggctttgttttcccaaacattttccttatatccctggcttgctctttcccctgtgagcaccctggagctccagccctccgtcaccttctttctcccattttgcctgtgacttaggaacgaacatgatggttaagctaccttcattaagcagcatgaccgcttcctgagctcctgctgccgcatttaggccctgtcagctgtgaggccactggtgctgagtcagagggaaaagctcagaacagccttgagcagcgaagaataaagtgtgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaactatccaaggctgctaacaaataatcttcactttcagttatatccagcaataagttgttctccagaaaagaaagcttggaaacttacccagtttgccttccatttgggacatgactgatgtgcttcagtctttgtataataaatgcatcttcgccactctatatctttgttattgcttttgtctcgttatcacaacaacttccttccctgatttccacagcctctattttttcttttctctagaagactagttagggagacttagaaatggggtctgtgcactcgcttccccttgaaaatgtgatttacttttatggtataactttctggtactttgaattaaataggacattctcttccctttggccacagaggcaagtatagaatgagatccttgtttcctaaccacttaccagaacatatatctgaagaaatgagcaccagtatttctgtctcaactacagtttctcttttttttttctttcttttctttttcttaaaacagggtcttaccgtgttacccaggctggagtgcagtggcacaatcatggctcactgcagccttgacttcctgggctcaagcaatcctcccacctcagcctccctagtagctaggactacaggcacacaccaccacagccagataattaaaaaaattttttttgcagaaacagggtcttgccctgttgcccaggctggtctcgaactcctgagctcaagtgattagatgccatttccccagggaaataccctttcaacccagaggccctaacgctaactatagtggttcctaaatctttgtgacatccagcattatctccagtaaaagaagtattttaatttttcccataagaaaatacttttgggagtgaagtggagccaacagttacaagagtgatttaagtccaggaagtactgcagagtgggatggactgaaccaaggactagggacctggtgtgcagctgattaaccctgacttagtacatgctcagggctgggttctttgttggtgcttcacatttctctctccttagtttggatttcacaaatgtgtcccttttttcccatcacaaaatgcattaacagtaaagacccatttttttaattttttatttttatttttattttttttgagacagagtttcactcttgttgcccaggatggagtgcaaatgtgcgatcttggctcaccgcaacctccaccttgcggcctcgagtgcttctcctgcctgaggctcccaagtagctgggattacaggcaggcgccaccatgcccagctaattttgcatttttattagagacggggtttctccatgttggtcaggctggtctcaaactcccgacctcaggtgatccgctcgcctcgttctcccaaagtgctgggattacaggagtgagccactatgcctggccaggaaagacccgtttatgatgagtagtcttgtagcaagatgttttacaaagaggtttcttcactcatttactctgattattcaggaaggcagaaactgaaatggaagacccttccaaccagcacatctgtttatctgtggatccactcacttcaaggcagtttatgacaaaccagtataaagtaccaaaggaagatttgcaactttgcacttgactggaaatgagactttcagctggtttccggttctgagcttacttgaaagcagctcagaataattgtttcttcccctaaagggaatatttacaaaactccaaaacttaaaacagttagagccattcttggagctcatcttcccccacacagagcgacccatttccacaagcggtgggaccccagggttcttaaggcattttgtttataaacaatttggaccatactaatttggaccattaatatttctaacaggcttattgtattcgttgtttaaatcagtttggggatgtaatgtgtagttacctagaaaggctatatttatagaaatttaaatcttcccaatttatgattcttgatttttaaaaaattttatatcatagagttttactttggatcaacttctggcctttctctcaggctcaaaagttgagctatactatgtttgatcatttctacacactgtagaaaagaggcagctcattatagcagaagttctccacctggaattaacaatagttgtgacactggagaagcatagcccagagtgcaagagatttgcaggatgaatggtggcaaggaaatctatttctaagtcctcctattctggttttgaaggactcaatttctggatccttttctctttgcctgaaaacatatttatattcacaatagtacttctctcacattgcaaaagaaagaaatctcaaatcttactatcattaattgctccaggatacccatcaaaaaggattagttagggagtgctgaaacccataaggcttagtctttccctgccttatgtattttctcgttaaggagaagcttggctttaggaactgtgttggatattctgtattcaggtacagatatgcacgccccttaaccacagggaaatgtctgagaaaggtgtcattaggcaagatcattgttgtgcaaacatcagagaatgtatttaacaaacctaaatgtcatagcctacaacacatctagtctatatggtatggcctgtccctcctaggctacaaacctgtacagcatgttactatacagaatactgcaggcagttgtaacacaatggtgagtattgtgtatctaaaagtatccaagcagaaaaagtacagtaaatataccatataccatggtagtatatatggtccattgttgacagaaatgttatctggcagatgactgcatatgctgaatttagagacgtaggcagtagttacaacagctttcctttttaatttatttttattttttatttatttattttttttgagacagagtttcgctctgtcacccaggctggagtgcagtggtgtgatcttggctcactgcaacctccgcctcctggattcaagcgattctcctgcctcagcctcctcagtagctaggaatccaggcgcatgccaccacgtctggctaatttttgtatttttagtagagacaggtttcaccatgttggtcaggctggtatcgaactcctgatctcattatctgcccacctcggccttccaaagtgctgagattacaggcatgagccactgcacccagccaacagctttccttttaggacttagcctttttcatcccctgactaatttcagaagaatttatccattttaagggaaagctctgggagagcaaagcaaagagcgttggtaagaaattgtgaatgaggtggatagaaaacacaaaccattttccctctgcttgcacaccacaacaatcaacacaagttcttctgtgaccaaacgtgtgggaacttttcaccacacgccaagcaagcaatcagttctgcagtggacaccagctgggcgttctccaattcaattcccacactatctacctggagaccacagattgaggggcagcgccaggactgtcttctccttctgatgccaattgaaagccccagattgcttcacctgtccttctggctgacatgctctgtaaattgggaatcccacagcctcctcttctggttctattaatttgctagagcaactcacagagctcagggaaacacttttactggtttattattagtattatgtttatttgtttgttttgagacaaagtcaagctctgtcacctaaactggagtgcagtggaacaatcacagttcactgcagtctccatctcgtggactcaggcagtcttcctgcctcagcctccccagtagctgggactataggcacatgctaccatgcctggctctaccagtttattctaaacaatattaccagccaggcacggtagagcacacctgtaatcctagcactttgagagactcaggtgggaggattgcttgaagccaggagttcaagagcagcctggacaacatagtgagatcctgtctctacaaaaaataacaaaattagccaggcatgatggcacacacagtcccagctacttgggaggctgaggtgggaagatcatttgagcctaggagttggaggctacagtgagctataatcatgccactgcactccagcctgaaaaaacagggcaagaccgtttctgaaaaaaaaaaaaaaataataataataaaataaatttttaaaaaggatattacaaaggatacagctgaagagatacgtagggtgaggtatacaggggaaggtgttcagagcttccacaccttctctggctgcaccaccctctgggaaactacactgtgttcagctatccagaagctgtctgcaccctgtccttttaaatttttacggaggcttcattatgtaggcatgatgaattaaacacttggccactggtgatcaacttaaccttcagctcctctctgcctttcctgaaggctggagggtggggctgaaaaccccaaccatccgattctgccttggtctttctggtaaccagtcccatcctaaatctacctaggggctgccagtcaggaggcacctcattaacatatacagagacatcacttttaagattccaaggattttaggagctgtatgccaagaaactgggaggaagaccaaatatgtatttcacaatgtcacagtgagggtatgccatgagctagaacaaacagaccaaagcagtattgctttttgactcttgggaggccctagaggttaagcaacttgcccaagaccacacaatgagtctttcagccagattttgaacacaggcagtctggatccatggtcagtgttcttgactcctacttgtcttgttaaaagatgtttccaaattatagttaatcctaattttattttatgtatacagtgattatattttcaaccttctaaaaaaaattatatatatatatatactactgggctactttttagtgtttttatgcaatatacatctttctctttcatttaatacagaataaaagttgatcatttctatctaaattaatggagttatttatgagtttttacacagtcgtcttatggtatccacagaggattggttccaggacaccccctccaccccactcccacctcaccctcagagcttaccaaaatctttgaatgctcaagtccctgatataaaatggtatacttacttgcatataacctatgcacatcctcctgtatatttttcattatctctagattacttacaatagctaataaaatgtaaatgctatgtacatagttgttatactgtgtttttaaatttgtattatttttatttttctattggttttttttattgtttggggttttttcttccacatatttttttatccttggttgatcgaatccaaggatgcagacccagcagatacagaaggctgttttgtggtcattttgtttttttgtttctaattgacataataattacacacatggggcacagtgtgatgtttcaatacatgtatacattgtgtaaaaatcaaatcagggtatttaacgtatccatcaccttgtacatttataatttctttgtcgtaagaacattcaaaatatcccttttctagctattttgaaatagctattttgaaatattttgaaatgcaatatattattaaccaaagtcactctactgtgcaatagaacactagaacttattcgtcctaactgtaactttgtacccattgaccatcttctccccatcccctccactccattctccccagcctccagcaacctctattttactctctatttctatgaaatcaacctctttagattccacatatgagtgagatcatgtagtatttgtccttctgtgcttatttcacttaatgtaatgtcctacaggttcatccatgtcgccacagatgacaggatctcattcttttttatggccaaagagtactccgctgggtatatgtaccatatttttttaatccattcatccgctgatggaaagttaggttgcttccaaatcttggctgttgtgaatagtgctgcagtaaacatgagagtgcagatatctcttccacatactgattccatttcctttggatatattcccagtagtgagattgctggatcatatggtagttccattaattactgctaaaagctaaacatcagatttttatacatatagatggcatacattcatcagaaatatatcgtgcttcataaatacttgtacttttggctgcacattataatgtagtatggcatagtatcgagtaatagcatatcaatttattctcttctgttaataaactttaaaaaccaaatacattaatctgggcaaggtagtgtgtgcctgtaatcccagctactcaagaggctgatgtagaaggatcacttgagcccaagcgttcaagacaagcctgaacaacatagcaagaactagtctaaaaacaaaaagatacattaaatatattacagcttattcatttgaattaaaaagtgaaagctggacatagtagctcacacctgtaatcccagcactttgggaggccaaaggcgggaggatcacttgaggtcaggagttcgagaccagcctggccaacatggtgaaaccccatctctactaagaatacaaaaattagctggacatggtggtgggcgcctgtaatcccagctactcaggaggctgaggcaggagaatcgcctgaacccaagaggcagaggttacagtgagccaagattgtaccactgcactccagactgggcaacagagcgagactctgggaaaaaaaaaaaagttattttttctaggagaaaatctgctttggttggttcaacagtaagaactgactttgccagttaagctgtggtagatatgttcactaaattggatgcactaaatctatagccataatttgaggaaattgagttgacaactgatacattaaaaatggatatcattaaaaatggattttaataatcaaacagtgtatgacttttggcatataacttgtaaggagctcaaagactcaaggggagacattactataacatttctcacaagttagtaatgtgaaaagggcttcttagcatttctatattaaaaaaaaaagcaacacccaaaatagaaaatagacctagaattaatattgaacctgagtcttctagtggaaagccatattgatgcatgagatacatgaaataattgtgggaggaaagggcagccctactcatttcactatcactaagatatgcttttcaagtaaacagatagtataaaaaaattaatgtttatgtcttgcttgtcctatactaatcattctaatgataatacagaagaaaataaatgttaacctttacagccttatggattcagaaagcacattttaaaatttcatgttatatatattttttaattgcagaaaagtatgatagggtgatcagttaaagacaagtacaaaaatatactaggataaaattggagcacataaaatgaaaacattcaagaaatgaaagatgtaaaaatcttggctgttaagagaatgttttttaatggattttggtcattttaaaatgtgctaaggctgagcgtactggctaacgcctgtggtcccagtgctttgagagactgaggtgggaggattgctttgggccaggagtccaagaactagcctaggcaacatagcaagactcccatttaaaaaaataataaaatacaatgtgctagaatatttgccctttgtaaatatttgaggttacagtgagaattacagatatcgacctgaaaaatgtgggaggagagttgtatgtatgtgcatattttctggagggagaggtgatccatagctttcatcagattcattaaaggcagggtatttgagccagaaaacaattcagcacagtcagaggccaggtcaccagtccctgtaggtgtactgttcactctagcctctacttattccatatgtctttcctgtaccaacatgtagatgtatggatggtgcaaaagagtatctgctttttaaaatcccagtagagttataaattcttagagtagaactcttagtttagaaacatctttcctgtatatcttcatcaaataattatatttctcctgtgattgtttcgtgtctgtaagttggtggtaccctctctttcagtttgaaggaagaaagtactgtgaacatgactttcagatgctctttgccccttgctgtcatcagtgtggtaagttttactgctaaatgtcaagtaaaaagtaagtttccggccaggcgcggtggctcacacctgtaatcctagcactttgggaggcggagggaggaggatcacctgaggtcaggaattcgagaccagcctggccaacgtagggaaaccccgtctctactaaaaatacaaaaattaactgggcatggtggcaggtgccagtaatcccagttattcaagaggctgaggcaggagaatcgcttgaacccagggggcagaggttgcagtgagctgagattgcaccacttcactccagcctgggcaacagccaaactccatcttgcggggaaaaaaagtaagtttccacattacttcagtcatttcacactggtgaagtatcgatggtaaaaatggtttttagtgctcattatgaataactgttggatacttcatcactcctcttccctattgttaacatagaacaagctggaggagtatcaaaacctagagatcattgatttttaaggacatttaaggtagaggtattttgggatgaactaggactcctatcgggtggtgtttgggagtgttcttttcctgtgttaacacaacctttacctacttgcttttggttttgcccggaaagaggcagggaagaaatcagtgaggtgcttcagaagcttagggatgcttaaacattgcttgcacggcgcataagtgatggacttgcttgcacgttggccacttcactggttgctaatacctctgccaggtttccagagattgaagaaactgggtagaatgttctaaaggtttaatgaaagaataaattaagtatgggttataagaaactgtgctgtagatttcagttgtctatgttgacaatgaccagaaataaccaaaaggcattcaagagagcctagtagctcatttggaaaggaaagctagattcagagatgacacaaaacagcccaaaaatgtggctgctgaatcaaaaacaaaaattcagatgaaataaaaacttttttgctaatgtgcttactctggtagacacataaaaaaagttcttctactggccacgtgtggtggctcacgcctataatcctagcactttgggaggccaagacgggcggatcacctgaggtcgggaattcgaccaacatggagaaaccccgtctctactgaaaatacaaaattagccgggcgtggtggcaggagcctgtaatcccagctacttgggaggctgaggcaggagaatcgcttgaacccgggaggcagaggttgcagtgagtcgagatggtgccattgcactccagcctggacaacaagagcgaaactgtctcaaaaaaaaaaaaaaaaaaaaaagttcctctattgagaaaggcttcaacggtttttttcctcattgtttttccttaattactctctcagtaaataaagtgccatgcctgttacttaggatgttacttagtaacatcctttgtgtgttgctttcccacaggtgaattcatcattggccgagttatcaaagccatgaataacagctggcatccggagtgcttccgctgtgacctctgccaggaagttctggcagatatcgggtttgtcaagaatgctgggaggtaggtggattttcatccttgtcagatgtgggtggacaatgtgactgtgacaagatcatgtgtattctccatgtgggatgtaaggcagttctgtaggacactgaattgagggcatgggaactcagacactgcagtgtgttgactgagtgctgctgctgggagtggacccttgtgttgctgttcacagggcataactgctccatgcatggctgaactaccaatgggggatgtacctagatggagtttcttaaaaatcagtcatattagggttggaacacatttttcatgtggcttgattctgccccgtgaagcacaggagtgatttttttaagaaatggtttgtttaatttcttttcagagataagggaagcatatttctttttaaccattagaaagaacctaaaattttaaatttaagttttgactctgtttagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggtactggaattgtttcttttttattacacaagcagtgggaatgaaagattacatttatctatatttctgttactctagcaaaccaaattgtttttctcccatttttagtctagaaaattttaaacctatagaagagtcaggagaatgatataatgaaacctgtatacccttaatttcatttcaccagttgacattttgccatgcttgtgtgtatacagtccacattctcgtttcaccctcctatgtatgtgtgcacatgtgcctgtatacgcatacctctaaaatttctcatgactcccagtatgcatctcctgagaataagggcattttcctatggaaccatgatacattttgtaaattttttttttccttgagacagggtctcgctctattgcccaggctgaagtgcagtgggcaatcatagctcactgcagcctcaccctcctgggctcaagcagtccccccacttcagcctccagagtagctgagaccacaggcacacaccacccttcctaatttttttaaattttttgtagagatggagccttgctgcgttgcccaggctggtctcaaactcctgggctcaagcaatctactcatctcggcctcccaaagtgctgggactataggcatgagccactgcacctggccagaaccacaatactcttattatgcctaagaaaattagcaataatcttataatatcaactatcagtccatattaaaaatattcccagtagccccagaaatatttgtcatcactatgtttttccaatcgaagatctaaaaacaaaaaaaggtcttatctctgtacatgcataacttttacagttgtaataattaggtattatcttaaaagatgttgttacatttatttaatttggcttggtttatatctaaaagaaatatatttaattttttgtcttcaataagttatgataaattgttgggctatgaatttttctcagtttgctgcctagtataaaaatttagtggataaagattcttggccgggcgtggtggctcacacctgtaatcccagcactttgggaggccgaggcgggcagatcacgaggtcaggagatcaagaccatcctggctaacacggtgaaaccccgtctctactaaaaaatacaaaaaaaattagccgggcacggtggcgggtgcctatagtcccagctacttggaaggctgaggcaggagaatggcaggagcccggaaggcggaggttgcagtgagctgagatcgcaccactgcactcgaacctgggagacagagcgtgactccatctcaaaaaataaaaataaaaaaatattctttactgtagttaatgtgaacttacttgctaaattatagtagggatggagaagaaacagtaagccaaatactaagaaaacagtttgggccaggtgcagtggcacacgcctgtaatcccagcactttgggaggccgaggcgggtggatcacgaggtcaggagatcgagaccatcctggctaacatggtgaaaccccatctctactaagaataaaaaaattagccaggcgtggtggtgggtgcctgtagtcccagctactcgggaggctgaggcaggagaatggcgtgaacctgggaggtggagcttgcagtgagtgtggatcgcgccactgcactccagcctgggcagcaaagcaagactcgtctcaaaaaaaaaaaaaaaaaaagagaaagaaagaaaacagtttggttgtataagttcagccatctcatcttttgtgattgaattatcagtttgtgccttatctcgttttcttgcctgtccttcctcttggggattcacctctgtccacttttcattagcatctctcctagagaattacataaaagggatgaaattcaaacaagtccatttgactaattgggaccatctctgaccaaatgtttattgatgcaggagactgaaaataatatttaatttgagtatttggagaaggaaaattctgggcattttgttgtttatgaaaataaacctattaacctataactcttttcaacagcttgtgacaatttaaataattgttagtaaatggaactagtctcccaacttctcagtttgcttggaaaggtcgtgtgttagtctattttatgcgcctgtaacagaataccacaaactgggtaatttgtaaccaacagaagtttatttggctcatggttctggaggctgggaagtccaagatcaaggggctggcatctggtgaggaccttcttctgcatcattacatagcagagggcatcacatggtgggggaagaggaggggggaaggaagagaaggaaggaggctgaactcatccttttataaggaacccaccccctcagtaacagcgttaatccatctgtgagggcagagccttcatgatgtaatcaccccttagaggtcctacctctcaacacctctgcattggggatcatgaactttggggacacagtcacaccatagcaggtagtattactgagtctaccctcagcactgtgattattccctgtagcttttaaaggaagacaaatggactaaaatggaatgtgataatacaagaaggaaattatgaatatgactggtgtggtggtatgtatctgacctagtcttgcatcttatccttttaagatacagatgttttggtaggagtctgaaacctgttcgggcctattaattcaggttattctgatcacctctaaaggggaaaaaagaaatttgcagggattgtcatagtaatatctttaaaaaccttctaaaaagtgtgctagccccatcggttggccatttttctctcttagtattaagctgggtgtctttctcacagacaggaaggatctgactgccgatgcacaggagctgaaaggggagctatactgcctgccatgccatgataaaatgggggtccccatctgtggcgcttgccgacggcccatcgaagggcgtgtggtgaacgccatgggcaagcagtggcatgtggaggtgagttctaaatggtaaagggtaaccaatcctttcaaatctccatgattaaggggtaaccaatactttcaaatctccatgattcaggggtaaccagtactttcaaatcttcatgattcaggtgtcctggcaagattaggagactctaaagattaaacgtggacattttaaagacaattgactttgctgacagctaagaatatagaatgtacactgcttttgtgaatgtctcagtaatgatacaggatgtgcacttttgctcctaaagccttcttgaagcaggaagtgccatggtctgtatccagcagcagctcctcctttataggtgctactgagatgctcacctctattctctttttgggctattataataggctgtgtcttaaagtaaccttcaaagacagacacctgaattacaactgcagaagtattatgttatggggccacctatggccaaatgaaatgactgtctcaaactttccttcatcttctctgaaaataggttaactctggtgtttactttattagatataaaatatggcaattcaaaaatgacctatagcaattttttttcagcattttgtttgtgccaagtgtgagaaaccctttcttggacatcgccattatgagaggaaaggcctggcgtattgtgaaactcactataaccaggtattgaccttagtcactggatgctagatagacttttatgaacctaagcttatcagtagtttagctacaaggaaatctcttggaagatgtacattgttcagtagagatttgtttttaactttttatttgggaaataatttcagactcagaagctaactataaaatatacaaagaatacctgtatgtctttcattcaagtccacagtttgctttatcatttcccaagctcagtcttcctgtgtaaaacacatagttacgtaaatattatatacaagtacgatggctgttttgccaataagttcatcatactcctttatccctaaatacttcagtgtatatttcccaagaatatgggactctctaacataattgtagttatcaatattgataccgtactctaaccatttattccagttttgtcacttgagtcaatatcctcacagcattttttccactcccagactggacccagcctctggctgtgatgtttctttagccttcttaaatctggaacgtttccagagtcttttaaaatttttgatgacattgacattttggagggatgcagagggcccctaacccctttttaatagactactttccacttgggttcacctggtgcttctctgtgcttagatgaggttatacacagcaggttgtggcctcatacagtggcagggcatcttctcagaaccttgcccctggagcattttatacctctcctgccctggtgatctcccaggcatggtgctggctgataacatcactgtgaattacaatttccttccctcctctgtaagaaagaagcaatctgtgggcaatcattctatgaccatggaaatgtcctgttcctcatcaacctgccctagattcagcaccccttgatgattcttgtctctgcgccagctgcaaacaatacttctccagccccatgccctccacccatagtctggtcctcagcgctctgcctgagcaagaacccacctcctctcccgtctataggtttattcatttatctatttcttatccatatggactcacagatttctatattttgcatcacttatttgggtgttcaaactgtcatccgggaagtttttcttttaattgatgagagtgaattactttcattgtaagaagtaaaaacttgtcaaagaacttttactaattttctctagtagtgataaatcctcaatttagatagccagctatttttaaatgttcagtgttctaaaaattctaacacatcttgaactttgaccacctttttttattttcagctatttggtgatgtttgcttccactgcaatcgtgttatagaaggtgatggtaagtatctgtgtgagttttagattggtgccactttgacacaaaaacacttggggaatgtggaaattcaggttggtgattgctatggtttgaaatgtgatcgttatcagttactttttctctatctttggcgtattttccaagtaatctgtagcagtaagatgataatatcaaagagttggatttgttactgatttatgacactacttttggccactgctgtagtgttgtatgccagcaatcatgggaactgtccctggtggaccctaagacctgtttctgtgtccagtttcaggaagctctagaacaacgtttattaggaagagtttaatctgctatcgtagttagcaagaggcactttaacctgcacatgctaaaagctggcagttatcagcaagcatatctaggacttaccacccttgtactgtggtaattaggctgggctgattgattggaacagaaaggaagcagctgtgtttgctaagactcgctaacacacttctgccagagacttcctggcaaagttttgaacgatactgttttcagcatgattcatggctgcctgcagacatcacctaattcaggaaatacttttgaaactgttcatgtgcagtttgtgaaaacaatccaggaaaacaatctttagtgccattgaaaataaaacttacctccctcctctgtgaaatagatgccaggtgaaagaagctgcagaggaaactgtcttgttatcatcagctctggaaaaaagactcctacagaggcaaataagttaatgtctggatttttgaaaattatttacctagttcatatttccatgttgggccaacagcagtagggacagaaacagcaagctcacctaaacaacatgatgcatggacagttgccacatgtgcccaggccaagggggcacagttgctggtgtaagacatggcacacatcatttataacttcacaggatacttaaggatgggggaagattaaagtcagccctccgtatccaggggctggatccaaacatccgtggattcaaccaactatggatcaaaaatatttagagaaaaataacaatataacaatacaaatagtacagtataatgactatttacatatcatttacattgtactaggcattataattaacctagagatgatctaaagtatacgagatgggaccaggcgcagtggctcacgcctgtgatcccaacactttgggaggccgaggcgggcagatcaactgaggtcaagagttcaagaccagtctggccaacatggtgaaaccccatctctactaaaaatacaaaaaattagctgggtgtggtggtgcatgcctataatcccagctactcgggaggctgaggcaggagaatcacttgaacccgggaggcagaggttgctgtgagccaacatcacaccattgcactccagcctgggcaacaagagcaaaaacttcgtctcaaaaaaaataaataaatgtatacaagacaatgtacataggttatatgcattttatatcaggaacttgagcgtctgagattttggtatcctcacagcatcctagaaacagtatcctgcacatattgagcaacaactgtatacataaaggttgagggccgggtgtggtggcttacacctgtaatcccagcacttaaggaggccgagacaggagaatttcttgaggccaggagttggataccagcctgggcaacgtagcaagacctccatctctacaaaataaaaattaaaaattagccagatgtggtagcacacacctatggtcccagctacacaggagaatgagatgagaagattgcttgagcccaggagttcgagctgtgatcgcaccactgcaatacagcctggacaacagagcgagaccctgtctgaaaaacaaaagaaaagaagctctcaagaaagaggttcttggctgggcatggtggctcatgcctataatctcagcattttgggagaccgaggcaggtagattgcttgagcccaggagttcaagaccgtcctgggaaacatggcaagaccgtgtctctataaaaaatacaaaaattagacaggtataggccgggcgcagtggctcacgcttgtaatcccagcactctgggaggccaagacgggcggatcacaaggtcaagagattgagaccatcttggccaacatggtgaaatcccgtctctattaaatacaaaaattagctgggcatggtggcacgcacctgtagtcccagctacttgggaaaatgaggcaggagaatcgcttgaacccaggaggcggaggttgcagtgagccgtgattgcgccactgcactccagcctggcaacagagcgagattccgtctcaaaaaaaaaaaaaaaaaaaaaaattagccaggtgtagtggcatgcactgtagtcccagctactcaggaggctgaggtgggaggatcacttgagcctgggaggttggggttacagtgagccaagattgtgccactgtactccagcctgggctatagagcaagaccctgtctcatttaaaaaaaaaaaaaaaaaaaaaaaaggttcttgagaacctccaccaagtgccacagacacagtcgtagttctgttttggagttgaaattctaagctgccctgctccccatactgatgtatttccatgtgaccagatctctttcctctttctccagtggtctctgctcttaataaggcctggtgcgtgaactgctttgcctgttctacctgcaacactaaattaacactcaagtaagtgtacggttttgtccagtgtgaatcctaagactgaaaactttggggagacacttaaaaaaaatcctagaatttagaaaaagagaattatttgatttcttatttcctctttctgttcaggccttctgaaagtaaaggttcttcctttaactgttccctgttctttcttctattccttctttgtcctactcaaagggataagtttgttgaaattgacctaaagccagtctgcaaacactgttatgagaaaatgccagaagaatttaagaggcgacttgccaaacgggagagagaagcaaaggataaggacaagcagaaaaagaaaaagccagtctgtttgtaaacttttctatccctgtgtcatcattttcactgctttctcctttggttagtcctttggaatatgtttttgttctgtttctgtcttttgctttcttccccccctgcaacttttgggcatgtatttgtagtcatcagagattgaaatacaagtatttgtcctatgtagaactggtccttttgcataactgctaaaattacaaaaattaaatgaatacactccatacttaatacagttttgtggtcatgtatttcacttactctgtagactcactcacctcattttttaaacaccatatagtatacatttctttcatttttttttaatggatttaaagggaagaattctaatctcttaatagaccctggaaaacattttaaaggatttttgtctgattaactgtagcttttaaaatcctggtttttggtttccttgccacgatcatttaattgataaattataagtgttgtttgatatttttaaaaatgcatatattctaagttatgtattaaattatttcagcatggcgaggcatggtggctcacgcctgtaatcccagcactttaggaaggcagagtggaaggattgcctgagcccaggattttgagaccagcctggactacatgcctagaccccatccgtcaaaaaaaaaaaacaaattagccaggcgtggtggcccatacctatagtcccagctactcaggaggctgaggctgctgcagtgagccatgactgccactgcactccagcttgggcgacagagtgagactctgtctcaaaaaaaaaaaaaaatctttcagcatgtttcatatctaagcaaagtccatctgatttacgtaagacatcttcttctgtgatgttcgaatgtgcattcatacaatacccatatgctactgtttatgaattcatttcctcaatgtcttcaaactctttttttattcctgatttttatgagaagtatttcaatctttgaaattcttttgaattaccagcatgattgttccagttttccctcatagttaccattgtgtttggagctctaaaaatattttgttccagtttacatgtttccttctataaagaggaattaaatgtaaatgtaagattaaaacaatgaggccgggcatggtggctcacgcctgtgatcccagcactttgagatgccaaggcagcagatcacttgagatcagcctgggcaacatggtgaagccccgtctctactaaaaatacaaaaaaattagccaggcatggtggcgggtgcctgtaatcccagatactcgcgaggctgagacaggagaatcgcttgaacctgagaggcggaggttgcagtgagccgagatcgtgccactgcattccaccctgggcgacagagtgagactctgtctcaaaaaataaaaaataaaaaagattaaaactggaaagcttgctaaggtagtctgtctgaaaacaggaataatttttttcttttatcaaaaaaatggcagttttaatagcttttgctctaagatgaccttgggagaaaagccgtaaagtaattcccagtgtagtgttttaaaatagaagatttttcattttagatatgtgtttaggaatttcctttgttactaacattgtcctttaaaatgatcttgaagcaaagtctagtttaatataatgtttaaatgcagtaaaaatatcagcagattttataatttttgtcatagatagcaatataccactagatttatttcacaaatgctacctgaatataatttcacagacagtgaacaagttaccaagttgtatatttactcaattcaaaattaaacactctggatttcaacagtaataagctcctgtaattacctgttggaaatgcattacagatgatcaggaggctatctgaaaagttgtcttctccaggaccattttaaaaataaattgataatgtgtgttgctctagcttttcaaaagaatagttgagttcttcaaatagctaccgcttacaatgcaaccacaggtgatctggttacatttatgttaagagtgattaaaaactttcttccaacctttctgtcagataaccaaaataaccccttataatttaaaattaattaaacctcatggctacctaatttaaagtactaagtaagatcatgttgcctccaataaagaaatcattcacattataaaaatatgattctttcctttagataaatttatctttaaggtattctaaaatgtgattaccatcctaggcaatacgacaggaccctgtctctacaaaaaaaaatttttaagttagccaggcatagtagtatgcacttgtgtcccagctattcaggaggctgaggtgggaggatggcttgagtccaggagttagaggctgcagggagctgtgatcaccactgcactccagcctgagtgacagtcgaggctctgtttccaaaaaaaaaaaaaaaaaaaaagtgattgactgtacttaagtaaattatatttacattagatttcctgtttacttagtactgaataaaatgtaatctacagtctgtgttacacagatggatgtatagaaccaatttataaggacttttttttaaaattatactgaatttttatatatatatcacaataagaattgaggttaggattatggtttttttactaacatgaatataatatcatcacctagttgccttcgtttagttcagtacaattactgcacatcatttatatatctttgttgaatatgtttccactaacttctttttttttataattttttgtctttaggaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattattccttcaaatgattacttaacgcagtagtaatagctagctgtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaacgaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggtttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaattttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatgacctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacctgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagt

SEQ ID NO: 15256 - DNA, 5534 bp, Human
aatcccacgttttggaaagctgaggcatgaggattgcttgaggctaggagttcgaaactagactgggcaacacagcaagaccccatctctacaaaaaaaaattaattagctgggtgtggtgatgcatccctgtattcccagcttctcaggaggctgaggtgggaggagcacttgagcccaggattttgagaatgcagtgagctaggaccttgccactgtactccagcctgggtgacagagaaagacaccagcttttcttaaaaaataaactaaataggctgggcatgatggctcacgcctgtaatcccagcactttgggaggcctaggcaggcagatcacgaggtcaagagatcaagaccaacctggccaacatggtgaaaccctgtctctactaaaaataaaaaaattagctgggcgtggtggtgcacgcctgtagtcccagctattcgggaggctcatgcaggagaatcacttgaacccaggaggcagaggttgcagtgagccaagatcatgccactgtactccagcctggtgacaaagtgagactgtctcaataaataaataaataaataaaatcagtataaaattatattttttaaaagtctctccacaaaaactccacccccaagaagtaactaccaacagtatggaagtccctttctctctcatttataacatacagattttttattcacaacagtgaaatcatggtatacacactgctttgaaacatcttttcttcttcctctttgattttgcatgtgcttgaatttatgttgttgcattttccaatctacaacagtattccataccaatgaaacaaaccaaaatattctaccccttttctctttggataaccagtggtaatgatttgtcaaggtgcccttcttcaggctcatacataaccatctttctatacaccctccttcttcagactcacacagacacaaagatatgtaaccataatgaaagcttgctccctaaaatgcagaatggggtcatattttatacctttacttaccaggatatgagaaacccctctagggcaaggcatatagactcatacacctcattgatttctttggtcccatgttataccaagcgaaggatgcatcataattcatccaactattcccttaatgatagacactatagttattattgttttcaatgtttgtttttatgcataatgttacagtaaatatctttgtgcataaattatttccagatgcttttatttctgttgcataattttctggaagaggtattggtggggaaaagagaatttcccctgtttaaaattagtttaagttgttgtttggtgaaaaatattatctcattcatatttttccaaaatagttttttattgagatataatcaaaataccaaaaatgcacagatcttaagtatacagttcaacccattttaataaatgtatatacccacaccacccgcaccccaatcaagatatgaaacattttcattaccccagaaagttccctcttgtgcccttttcagtcaatgtctacctccagggacaaccgtttttccaatttctattactctagattgattttgcctgttgctggacttcacgtaaatggaatttcacagtatttactttcctgtgtctcgtgtcttttgctcaacataatgttttgagattcctccatgtggttgtgtgtctgtagttcatcattcttttatgtctatgtagtaatccatcaggtaaatacactacaggtggggccaggtcatgcaggccactagctgccttgggtcagttgtccagctgacttagaagtccatccccctgcacagagtcccctaggcctgcttcttataggagagctgctcatggacaggtgtccactgaagggggagttgggtgagtcaggtatgtggacaggccagattcagtatgggcactacaccactttactcagggacaccacatctttcaatcagagtgacactcctgtctggccttcctttttctaggaactgtgggggattggaaaaaccacttcactgttgcccagaatgagaggtttgatgaaatctatagaagaaagatggaaggaacctccataaacttctgcatggaactctgagcaagatgtaaataaaattaaaaggtggatggcaagagtgcaaatactatcttcaatccttcagtcccagccagaagaatctctgaaagcatattgtgaatgtatacaatgtagtacaaacaatctctgtgatgattaacagtatgtcaccacttcattttttaaaaaggatcacgtctaatgcccattttcccaactattctttccaaagtaagatataaggtagcttaataaactaagtaaaacgtatgacttgagtacaaaaggattgttttaatccccattattctggaaagtgcatcctagtctcccagtctataacatcataataccttgagtataagtccaaatattaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgccctcactggtgggtgggaataaaatggaagtgcacagaggagatgtcagaagaccaaaacttggtgaatagtcccagtgctaggtcatataggaaacagaaagcatgacagtggccttttgggaacccaagttacatcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatctatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattttttttaaaatagggtcttgctatgttgcccaggctggtcttaactgactgctttttattattaccatgcactggcaattccaaacaatgtcagtgttaaaatgcttctccctgaaaaagagaaaaaaaaaaggaaaaaaagaaaagaaaagtgaaaagaaaaactcttattggcctaagttctaaataatagctaggttaccactgagttttaactatatgtatatgagcttcaaataagcacctttttattatgtaaataaataaaagttatctgtatccccactgcattgtaaaatttttgttgttttgtttcatgtcttattcacctttgtatggaaattaattcagaaaccccaagcatagagtctacctctttaattccagcaggcagatgtagttctgcctgcttccttccaaggttaagttcataacagttcagaatcttgcaagctcacttcaggtataacctgtgtctccaaccctgcagtatttggatattgctgtttaaacagtagatttggcatagatgatggtggcacaatggttgtaaaggaaaagaagcagaacacctcagtttgttcaattctctcattggggttttcagttgtatccagaatttaaaacagtaaaatttaagagtgtgaacagcaacattcacactttgtttagtaagtacaaagttgtgctcatacaggaagtttactgactttgaataataactttaaaaacaaaatttactcttttctaagtgttaattatttgttttaaaatttaagaatgaatcaagaaataaaacattacaccagtggtatgatttagtaattgtctgacttatactttttgtagacattttagttttatttaaattggcattctgatttttttactggtcttgagtctatacacaaaagttgaataaaagaaaagtttcactgactacatttctttactattattattacttgtctctattcatgatcaacactgaaaataattttgttgtatacggaagtaatgttgatatggttaggctgtgtccccacccaaatttcatcttgaattgtagctcctataattccctcatgttgtgggagggaccccgtgggagatcattgaatcattgaggtggttttccccatactgttctcatggtagtgaataagatgtgatgattttataaggggtttcctctttcacttggctctcattatctcttgtctgtcaccaggtaagacatgccttttcaccttctgccatgaatatgaggcctcctcagccacatggaactgtaagtccattaaacctctttttctttataatttacccagtcttgggtatgtctttatcagcagtgtgaaaatagactaataaagtaaactgatactggtagagtggggtgctgccataaagatacccaaaaatgtggaagttgctttggaacttggtaacaggcagaggttggaacagtttggagggctcagaagaagacaggaaaatgtgggaaagtttgggacttcccagagacttgttgaatggctttgaccaaagtgcttataataatatggacaatgaaatccatgctgaggtggtctcagatggagatgaggaacttgttgggaactggagtaaaggtgacccttgctatgttttaggaaagagaatggtgtcattttttccatgccctagagatttgtggaactttgaacttgagggagatgatttagggtatctagtgaaataaatttctaagcaggaaagcattcaagaggtgacttgggtgctgttaagagcattccattttaaaaggaaaacacagcataaaagttcagaaaatttgcagcctgacaattcactagaaaagaaaaacccattttctagggagaatttcaaaccagctacagaaatttgcgtaaataacaaggagccaaatcttaatcaccaagacaatggggaaaatatctccaggccatgtcagagaccttcatggcagcccctcccatcataggcccagaggcctaggaggaaaagatggttccatgggctgggcccagggccttccctgctgtgtgcaccctagggacttggtgtcctgtatctcagccactccggccatggctgaaagaggccaacgtagagctcaggccatggcttcagagggtgcaagccccaagccttggcagcttccatgtggcattgagcctgcaggtgcatggaagtcaataactgaggtttgggaacctccacctagat

SEQ ID NO: 15257 - DNA, 8374 bp, Human
gcgctgttcggcctccaggcttctgctcgtgctgtgcctcccgcctaggacgcctgctttgcactccgtctctgaccatccaaatcctccctgtccttccaatcctggcctatgcatctcccttagatagaactgatcactcctcctctgggctgccatgctccctctgctaggacacagaccatagtccactttgtatttctatatgtccatctcccccaagagcctgggggcttatttaaggcacacaatgagttgtacccatttctgtggcagcctgactttgcagtggggacagaggacatggacgtcaggtttagccagccgtccatcccaccacaggccagcgtgggggcttgcgtgcatcatgccctttgcagggtctcggtgttcccactgtggagcagggatgatggcagtgaccccacaggactcttatgggcggcaaatgacacccaagcccactgcaaggcctctgacgctccttcagccaatcctctccttccctggaccttagtatccttatctgtaaaatggtggcggtggatgagagagcttggactcgctgatcggaggtccctgccagctggaacagtgctgggtaccccattgcaaaaggaaggtggctggtttctcacagaactcctcagggacagctgggaaaagctagtgcccagggctgggagattgctgagaccaggcttcttgtaaacaagaaaggcaggaagacggggttccctcctcgaatcgtcaattaatcaataacttggcctgagaaggggcagggccagtgacctccagactgtttgctggcggcgcagccactatcaccctgtcttccaactaattcacaaaccctttgcagcgccctccccagcccccacaacctgccccctgctgtcttatctgcaggctccctgccctggccccagattccagacccttgtcctgtcctggactttccctctcagggagcccctctgcccacagcgtcctctccattgcccgaaccagccaactcccggcagcgcttcagtcaccagaggcacagccccggaaaagcttcccggtgtctcacatctgtgtccccaccaggtgggcttccttcctctaggcctccagattcccgctctggtttctcctcgggcacttggacacttgtggagttatttacagcctgggcttatctctctcaacttagagcgcagctcctccgggaaggggctggtgtttactcctctcttcaccacccccagccccctgagcaggcactcccttcagctcggcaccaagcctctctctccctcctacccctgcgtgaataatttctatctaaaggaatgccctgcacatgtgcacagtggcatctgacagcttctgaggtcctttcaggagcctcttctcatctgatttgagggaggtggggagtctcaccctcctgtgacagaggaggacaaggaggccccaagaagtagagtgacactttcccaaggtcgcccaggtggaggggtcaggagtgtctcagcggaactcccgctagggtcaaggagactgacggacaaggaccgctcctgggctggccgctctggattgcgccccctgaacagaatgtctttttccatctgcccctgcggaggtggccagaaactccgtggcccttgcgccaccgtcagctgcacaggaccaggcgcttccattgtggtccacgcccgtctcactcccttttcgcaagcctgcgggaggcagggacattttacagaggaggaaacagaggctgagggatgacttgcccacgaccgccaagccagcttaggctcccgggtcttggtgcgctcgccccatccaggggaccccaaaacgccctccgccgccccagtccccggcctgtgcgcgtggacgcggggtccctactcacagccacttgatgccatagcacacgccggtctggagcgccagggcgaagagcagcgcctcgcagacctgcggccgcgccctcatcgtcgcgcggcgggcgcgcccggggtcacacccaggaggagccgcgccgaagtcctccgcctgcacggccgccgctggtcctgcacgccgcctgcagccggggagagcggaggcggcgggttaaggcggcgcgcgggcgggggaggcgttttattcaaattacaaaggaggggtcggggcccggggaggccgagcgcggcgggcgtcccctcccgctcctcccggccgggggacgcgtcccgcgcctggctcgaattaggcgcggccgaaggcgtgtctcccagcgtggccccgggccccaacgcgccttcgagcccctctggccggggcagccggaaggagggacaggaggcggcagaaccggagaccccaggagagaccgggcagacacagcgagagggagaaggacgctcagaggacaaggctgagagccacggagacagagggggaaacccggacagacgcagacctgggacggaaaggagaggaatgaggaatcaggagtccaggcgaggcagcagagtcgaggacccggagctggggcttatccctgcaatattgagcattagttaatagggcctcggcaattctccttcccaaacgtgtttcagtttacctcctcagtaagctggggcaattcgggcacaattccgcttttataaagaacgttccctggccgggcagggtggctcacgcctgtaatcccagcactttgggaggtcgaggcgggcgggtcacctgaggtcaggagctcgagaccagcctgcccaacatggcaaaaccccgtctctactacgaatacaaaaaattagccgggcgtggtggcgggcgcctgtaatcccagctactcgggaggctgaggcaggagaaccgcttgaacccgggaggcggaggttgcagcgagcggagattgcgccactgcactctagcctgggcgacaagagcgaaactccgtctcaaacaaacagacaaacaaaaaaagttccctaacacgatcgcatctgctcctcccagcaccccgtgagataggcactatcgctgcctcatctcacagatgaggaaactgaggcacagaggtggggttcagctagggagcggcaagccgggtgtccggcgaaatcaggaaatggggcttgctcggggccctgctttctcggtgtgggaaggggaggatgggaaacgggatggtagggctctttgtacagtgaggattccgagtctccaagtccgtctttagccgctccactttggagggtgggagtggaagcatgcgggctgggactgggcagccccgccttagcgaagcggggaagctcgcggggctggcgcggtgttgcctctggcctccaggcggcgccctcgggccgcggaggagaggctgccccgcccgcccgcagcccgcggagcagctatctccgctttttttctccttcacttcattctcacctcattaactcccttcccagcttctcccaaatttaccaacacctggcgttcgcccggagtcagacacagccccagcccctctcccctcgggaggagcagagacaaagggattcctttctaagggtttggggagttggaaaaggaggcgcccacggtagtgggggcgctggagcagaaaagggacgttcttatctggctctgtgagcttgggcaagccctcagccaccccagcctcggtgtccccttccataagaacgaggaatggggcttcgccgtgcgtcccccgaggaccccgtctccctgcagcctgcggggctcagcgcccctctgctatttgcaccgcgacgccacctgcgtggcgcgttcctgcgcgtgggtagtcagcacgcagagatgggaagccccactgttttctggagcctgacggcaaaacccacaggaaggcgaggagaagcctggatcgtacagtttttttcctccgcagagccccgcagctagcgcccagcacaggggcgcctgcgacaaacatgccgtcaaggctgggggtctcagaggggttctcggtgtaacccagtcccgtcctcccacccagcctgtatccaaatcctttgtcttcctggtcctgcaagtttcttgcacttctcagaacgagaaaaatatccgctggatatggaggggggaatcaaaactccagtcaccgtcttcccctctcccaaagtgcgccgccccccgaaggcacccggcattcctgggtggggagggggcgggggcagcaaaaggacggaggcgcgcggactcacagcgggggatctgtgtccagcctggtctcccagggagaggaggagccccctaggtcgcacagcggacggggacccaggcctccagccccgcccagctctttcggtgcagccccggctgtcccaaggctctccctccgccgcccaagctcgtcgcgcggggaggcagcgcctggcccgagcctctgggtcctgacggactgttcctgtcccttgtacgagcgcccgggacagccgcgcaggccacggggtcaccttccgcatgagctcgcgggtcagggtgcacgcgcctcctgaagcccccagcccgccagggggcgctaagccggggctcgaggagggggaatcgcggctgcctcctgcgtcgcgggctggggtcaagtcctcttcctgggcccccgcttctccgtctggggatgggacgacgtgtcgagggagtgccccctgtgtcctggtcgttctataggacacttgccgtgggccgccctgacctgcccggccccttgcttggggccgggcgcgtagtgggccgcgccaggcgtagcacctttggagagcgagcggtcacctcctcgaagttggtccgagctaccctgcctgcagcgggcccgggaggcggccgcctggggctgtgcacagggagaacaccacgagcgcagcgccgcagcccagcgccaacagatggtcataggcccggtctgtggaggactctggaaagccggccgctgggaccaggccacgccggcgaggacttgcggggtcccccctaccccgacgccccacgggcaccgtgcaccggggccgattgtccgcgcggcgcgcaaggtcggcacgggcgggtcccgaagcctcccgccacgcagctcacggagctgaccccgccaaccagggacgccgagcgacggcttcaaggttacctgcggggcggggcgaggccgggcctgccacccggctttgaccccagccgtgaggctttcgagagtcgtctgcttggctgcgcacgcggcgccgggtcacccgggagacgggttgttttggaagtgggaagggtgggtgggagcactcgagatccctcctgctaaccccctggagccggaccctgcacgcccagggccttgagggacaccgaggcacttcagccccgggggtgggaggcgtggagctcgtgcgcgagctcagccagatgttccgggcggttgcagatgtgcctcggggccggggacaggactttcctcctccctagcccccagcctggagctcaggtcagtaaacaaactcggttctccccctccccccgccgcccctgggacccgttctcaaagccaggcttctgcccccatccccaatttactaggcgctgccgcatttctttgccttttgccaccctttccccccgcccaccacacacaccctctgtcgcgggatccaagtcccccacccccgggggtggctcgggcatgacctcatccgccgaacgactgggaaggagggggtcgcctggggtgcgggggcagaagaggggggccgggccgggaaagttcgaggagggccgcaggaactgcataacccaccaccgtcccgcgtccccctaaaccccgcgtccccaggctcccgaggcttcgctccgcaaaggggaactcttcggagtgctgcgggggaaaggtatggaggagcgcttggtttgcttacccgggagtgggtgcccaagggggtcgtggcgggtgcgagaagcgtcgtccccctcggactcgggcgcccccagccctggcgggtccccgctgagcggctgcccgctgcccgcgaccactgctcacctcccggggcgctcgccaggcgcgccctgcgtgcccgggtgccccggcctgcccagggagcggcgagtgcggtttccagcgggcccgtgcgcactccggctgggcgagcggcgaaggcgccctcttcgtgaagcggcgcgagaaggacgccggggatcctggcaagctgcggccggctcaggacccgcgcggagtcaggcgcggactccggctgctctctgctgcgctcagctcccgtggcctgtgctcgccgctcgcccgagctctcctcctcgcctggcgcgatctccggcgcgagcctcccaaactgctttataaggcgggcggccgctttgatccgcccacgtcagcgcgtcgcaaccccaccgggtggccccggccgcgcgcggggggcgggggcggggtccccgcggacgccactgaccggcggcgcccgccgctccagagaacttagtactctgtcgagttacaaagggggactcgctcactacagctggtgtttactaagcgtgcgtgctgcgtgcctgcgacacgcgtggggcccgggtaaggcccatctcgaatcgtcgcagcaaccaggcaaggagcctcaactggcagggggaagtcagacttgggtctcagtctggagccggggcatccttaggtgttggtcgcgcagcgtggttactgtagacgtctgaggtcccgaaaccggccttcgtgtcctagtcctggtccttcggggggccatctcttctggcctctggttccagttgtggaaaaggaatcaacgatcctgcaagagaaagagacacgaggactccgcgctacaaagcccgctgtaaaccttaggtgtggagctgggcggcgtcccagccgttggggtgactgctggggagtgttctggacacaggggagggggagcagaggaggactgggtttcctaagttaaaggagcctagagaggcacctcctgcgtcgagtagcccaggcgtgtggtgcttctggaccccctcacttggcctcccctgagcagaccagctgcttaccccacaacatgactgcgatttctaactgcccatcgggtgctgtgggttcatccatgtctccccctccttctaggggcctcaatcccaggacgtcctcaaggataactggttcattagcagaaagggaaatggagacttagtgaggacacggagcctgtctcaggtcccccaaaatgcctgacattcttttccccattctttgcagctgcagatgaagtggcactcctaggctgccccacacccagctacaggtacctccacatacaacacaaacatctgggcccacagtgcccatagcagcctcccagccataccagtactcccacacagccagtcctcacacacaggctggggcatatcaccccgcatatggttacaaacacactcgggagataccaggacatatcatctgccctcacacacagtagcacagaggtgtgaaatggccgtacacacatcatgaaggggaggctgcacacagaccacctgcgcgcacacagttcaggtgcaaacatgcgtgagcttccatgcacacacagctcccaagtgtacaatgcctaacatgtacttctgcacacaatcacagggatatcctttggaacatacgctgggacacccccatctctcatgccagaacactggggcaatctgatcaaaaaagcagtggaaagacagtggggcttggggcattgaggaagggaaggcgggggctattccacctaagaggcagagagcaaaggcctccgggggcccaagaatgtcttcagctcccctgccccaggccccccggccacttcagtcagagccattccaggtggtctctgtctgattgggatgcgcaccctctgcccgtttaagaggctcagtcagttgcctccaaacatttgcagcagtcctgccagaaatcccctctggctcccggctagagtagaaatggaagaatttggagtcatgtaaacttggattccaatacagattttgcccaattttatttttagctgtgtaatcttgagcaagttgcttaaattccccaagacttagttttctcacccacaaaatgggaataatacaatcccatggaatcctctacttctccaagatcaggattagtattcccatttcacagatgtggaagctgaggctcaaaagggagctgatatatgaacccagatctctggctcagactccactatggctggtggctcccagtgaacacatgggggaaggatagtgactttccattgtcttgtggggagttgaaggaaaccagcagaacatcccatactcc

SEQ ID NO: 15258 - DNA, 48149 bp, Human
ctagaacagactttccctcagaagcaaccaatcctgccaacaccttgatttttggatttctggcctctagaactgagaaacaaacttgttatttaagccaccctgtttgcggtcctttgttatgacagcactagcaaattaatagaggcaaaaaagtcccatccctgcagtaggttggagccatttaaggatcattccggcagcagcactactgcatccatttcagaagccaccgtttaacttaggcttagctctccccgtgggttctactcaggctgtgagcacatgggagcacacttagataagtagctgatgttctggagcacgcacggacagacaggcagacgacacgcgcaggctcaccacgttcatcaggttctcatggtccccactatgctgtcgcggcttcttttccctgaaatgaaaagtgaaatgttgtaatgtcaaatgtgcccccttaaaatcaagcgcacactaccctttcctatcccaattcttatcagcttttaaatctctcgttttaagaaccatgtttattttgtcaacaaagacaaaatcagacagtgatttgatggcccgtttgcaggtgctggggaagaggagttcaagcctcaactagggactgtccacctcccctggcaccccttcttccgggaaaaaacatacaagttcacaaggagaggaccgaggcctgggcctgcgtagaaattgtttatacctaaactagcagagtaagttatacctttttttttttttttttgagaaaatgaagacaattatctgagtctctgcaaagtcacacactgcagtgggatggagaaaatacagatttttggcacgccaggaagggtacatgctctcagggtgagtcatatgtacttccagtctatgggaaagtctgtcaagtaaaaatagaatttgtttttactcgggacagtctaaagaaagccatcagttgtagagaatacgccgcccatccacgttctctataaaacaagggtgacacctagtgggaacatgagtaactacagaagcaggccgtccaggccccgggaagccccggccctgcggcctctttgttcatcttcccaatcattcagactctgtcccagccacagaggtctgggtccaggctgggcagggattaggaggctagctgggttcagagggtcttggcttttctcctcctgacagattttagggtaggaagctatttcagaattttaagtgacgctcctggagttgcttccatggtggagggagagtttggacagggctggctgacggtcagctggtctgcatgggcctctggtggcatctagcctatcagaaggttatgtgctttgtaacagttccagaatgtcctgaaacatcacttctggttagaaagaacttctctctgagcaaagatttctcttgttgggggtactgacattttatatgagacagaggagagagagaagtataactctaaaaaaaggacactgatgattatttcatatacagcatgttcctctccttggaaaataatctgtttcttgagaaactgaaggtctacactacacatttttaatcataaacaatccctccgaaatcacgtagcagcaaacattctgtgacttccgcagggtggtggcaaaaagatgcgcatcacacaagatttcaaaatgcccgcacatgaaaaaagacaaaatccattttgacaagggtgtgatcgaaagaacagcaagactttcattctgggaagtttaaaatataagggctcttctagttgctccctagcaaaaccaaatatgggttttccttcagtgaataaagaatgtcccgagacgctctgcagcagagagaagagagttaaagctaatgcacaagtttctgggacggctctgtggcgggattccattcctaacaggctttccacagaaactcttctgggtacaggggatgtattagtttaaggcacaggtatatacactctggttctcacctgtcacaactagagcacaggaagatgaggaaggtgatgacgaagaaaatggcgacagcagccagacttccccacagggtgatctgcatctgtccgctgcccagcaggctccccgcgggccccatggcaggagcaggcactggcaccagccgagggaatcagtcagtccttcaaaggtggtgacatggaggcagagagctgtgtcctgcaaagagaccagtgcgtttggagagtaattctcgggtaaagtggcagaatctgtaattcggtccctgtcaggagcaagacctttgcgcaaagtcagggaagcgtgtgctggatgctgaggagagccccggactggacttgaaattggactctgggcaagtcccctccatggtctaggtcttcatttttcttacctgaaaacgaaagcgggaacatacagctgcctggcccagtgtttgaagcaatggatgtcttatcttgatatgtttgggggtggattcttcttgttcttttttttttttttttttcttcaaccagggtcttgctctgttgcccagagtacaggggcgcaatcatggatcactgcagccttgacctccctgggctcaagcaatcctctcctgaaccacccccctgccccccactgctgggactacaggcatgcgccaccattcctggctaatatttttattttttgtagagacgaagtctcaccatattgcctacactggtcttggactcctgggctcaagtaatcctcctgcctcagcctcccaaagtgctgggattacagtgtgccactgcacctggcctggatggattcttaatgtcttcaaataaagatttcaagtactccatagcaaataaatccatgctcatttaggttcattaaaaaaaatcagaacagtatataacaattcttatatagcttttgcaaaaatgcaactcatcacctgcccctgccccccactgccatctctcatctccctaacccactgccatctctaatctccctaatccactgccatctctcatctccctacccactgccatctctcatctccctcacccactgttgtctgagaaggtttaaggtcaatgtaactaatgaaatagaatgtctttatattcacctgcatttatttattctgagtatgttatgtattctgagtatgtttacactaccctgctgtgagtacccaataaatgcattttcaaatgaatgaatgaagtatgtgctaagaatacatccctgggaataaataagacctatttataaacaattgcaagagaagcataagagctctacctagtacatttccgtacctggtatgtaccagggattctgctaaatgctttcctcatttaattgctgtcaccaccctgtgtaggaggcactgttaatcccccttttacagagatggaagctaaatcccagcagagcggtgacttcccctgagtgtcacaggagctaagtggcagggagggatgagtccagctgtctcagactccaaagcctgtgctctgtgtccatcaaggaaagctcgttgtcactgtggggatgctgggactcacagggtcactgcaccctgtcccaatacttcgaaacagaaatggtcagattccttgtgtgaaatattttaagagctacagatattttaaaaatggagtcgtatatcaaatgatctgtcatcacagaggccttgtttaaagaatatttgctttgctcaattctagaacattctaaatgaaaagaaatagcctttaagttggtctcaagtgtcatgaataagcaaatactttggttttttgataatagtgcaatatcttctttgaaaaagtatttacattttcgtttgcttcagtgataaagctgtgactgttttcagccatccctgagcacagacatcaagacggcaggggtggcttcgcagcaaaccagggtgcctcctaaaacggggagaataaaagccattttggcaaatgtggttcaattggaccaaatcatctccaggtgaaacactgtcacatttatttgaatattcaaagttaaagaatattaaaaagctgaagaaaaagagacttttacctacaatgtatgcagagagagttctgagagatgaagttgttttcctcaatctttgaatcaacatgaacgtcttctaaggctctataattatataaatgcaggactccctgcgtaatacagaacttctttcttcctatgtttgattgtatgtatattgtgcctgtaaacacgacaggcgtacagtaataacaagtcaaattactttgcatgtttgcccccagacagctataaacaaatgaaaataaccaccacttctgtgatttgttgatgcaaagaataattcactttaaactgagactacaaattggcaccacaataggttttaaaatacattcaagcaagcagctaaatcatgatgaccaatgaaaatatataaaatacatttttatacacaggtccaaagcatacaacattttaggaatcacagacaaaaggtatctatctcctgtgcaggcatctgtttgttcttcattcattcatacaacagattaattgatgcccatttataaaatgccatgttcttaaaaagagtttgctgtgtgagttattcaaaagccagatatccattcatgaaacctagtgtggaatcgccaacaactctctcctttctgtacatgtttctcttctctctctcctctctcctaatagaaggaggtcagtagaatatgatgagagatgtgggatgcccagcctattagtacagtgcagggagaaagaggatgaaaggggattattacaagctgtggaataaaggatggaaccaagagaaaatgtgttgaaactcctggctcactccccttcaattagaattgtctataaagccactgaaagactttttcccaagttcttactgtggacaaaattctcacagcgaacagaatgatcatcatcaggtgcacgtttctgagtcagatgcactgcagtcctcagggacaaaggccccagttgcgggggcagctttctcctcttggaccctctaagtgctgctctgcaggaggactgtgggacaccagtccccgtggtcgtgggcagtgctggcgggttgagtggctgcaccagcaactgccacctactcttctttaggggcctggcagagtgtgtgagtgttggtggtggggaggtgggaggagtggtggctgaggggatctagactaacataatctttgatccttacagcagacgtccttggtggacggttcccattttggagaagatctgtgcactgctacccttctctcctggtctctctctcttttttctggatgtttgtttccaaaattctgctgcccatgccttctctggctatctccttaaattttggcagctcatctacaactgagccaagactgcctcccgctcaccctcctgctcacaggtctagatggacttcctggtaaatgtgtgtcggtggaccggctcctcccctgtgcatggggatggcccctccccatgtgtgcagatgtacatggatcactttgtgtttcaccttcttggagcagctgagggtagaggcctcatgcagagggcccagtgctctgcccctaggctggaccctcatgtgtcggtttaactgcccttaaatgcagtgcttgggggtcctcgttctgttcttttgagtgaggggaaggtggagggaaatcagtaccctttcagatggccagcgaggcttttcttaggatgagtgatgggggagacagtaagcggataggaggcatagtgtatggatagtaaaagctaccctgaacaggaaggtccctgtggcaatcatggcatttccagactctacactgtgccacccaaggcagtgctgtcctgtgacaatcatggcatttccagactctacactgtgccacccaaggcagtgctgtcctgtgacatggttatggtccacaaggaccatcttattttaggctgattcaatatcaagtaagttatgtcttgactatcagggatgatctcttccagcagaaatatctgagccatttggaggagcatcccctatgtttttttcatgaagacatttaagtctatttctccgaatcctgttcttacttgactcaataaacttgcattcaactatataatattacatagaatattatttcttcttttttttgagacagggtcttgctctgtcacctaggctggagtgcagtgctgtgattactgcagcctcgacctcctggaatcaagcaatgctcccaccgctgcctcttgagtagctgggaacacaggcatgcgccaccataccaggataacttttttgattttcagtagagatgaggtcttgctatgttgccaggccggtattgaactcctcccacctcggcctcccaaagtgctggagttacaggcatgagccaccacacccagcctatttcttcaaagtttaaaaaatttctcttatcagaccacatgtgtaaatattctttgagttattcaacacagggcaaagaaggaccatttattttaattgttaactctactaacacttaattttggcacctgaatgctgtactaagatgagccacagaagatggtaatattaatgtgatcacagatttagattaatagttgtacattaattctgtttgctataaaataggcttcattattggctgcattgatgtaaagtcatggctggagactgtaatataatacaagcatatagtattgctgtaaaagactcagtggtactacctcaatctccaccccaattttgtataatttcgaactactgtgagaacttgttgtttagccttgagaaaggtcagtgcttatggttaaaggactttcattggggattctttcaaagatttatctcattaattattttggactaaaaggtccatactctcttacccttttatatccactaatttgttttaatgcataagtgatttaatcactagaaaaaccactggcctttaaatttaacagcaggtgtccttttttttttttttttttgagacaaagtctcgctctgtcgctaggctggagtgcagtggtgctatctcagctcactgcaaccttcgcttcctgggttcaagcaattctcctgcctcggcctcctgagtagctgggacttcaggcgcgcgccaccatgcccagctaatttttgtatttttagtagagacggggtttcaccatgttggccaggatggtctccacctcttgacttggtgatccacctgcctcggcctcccaaagtgctgggattacaggcgtgaaccaccatgaccggccagcaggtgtcacttttaaccacaaggtggcagcataattctgttctcagccctatgcagcactttctttaaggaaagctgctcaattattgttggtgccttatgcttggcatttgaattgtcttcattagcctgcactatcagccaccaaaatcaattccaacaggagaaaaaaaaaaccacacaaattaatgaaaggtgcagaccaaatggcagctatttatttctttggccaaacatccttaacaggtaggttctctgatcatagcaaattctataaataataatttggtagagatgggatggccagtgagattagatatggaaacagacactttagagttcttttgaagcaggtctaggtcagtaatgatagtcattacctttttacagctgttgcagttgacacataattaaacatgatagaaaccacctccactcatgacccctcactgttggatgaaatatggtcaagggcccaatcccagtgggaattcttccttcctggtcattaccaggcgtgggaaccatgtggtaaaatgacactttatgggctctaaattaaccagatttaatgatggcggaggaagcagattctttggtgggttccctggtcctgtgagcacactgacagctgcacaggctaagatgaaataaactctgaacagaatcctcaagccccagaaagagttttaagctaaagtgtgcaaattcaggtagtcttccgttcaggttacagggactgtgctacagaaaagcctgccacactgaactctgcacggatgagtgtctgttggaaacacatggggaatcacctacccagatatttactattccatcctgctaaggtacaaaggcttttgcctacacatgattgttatcaagatcgccctattctgatcctgcactgagtcaggggcagaacacacccaaagcacagagggtggtggaaggtaagcttttcttgtttatagattcctgaatccttttctaatgtccccacccagtgatatcttgacatctctttctgcagcagtttaagaatgagtgtagatgaaagaaacctggaatgccttaacatcaccagaccacagtgaccctgctatcaggactcactgctcatgggagagagaccggcactcatcctaaaagcaagttataaatcctcatggctgtctgtcagcataacctggtcactttttgtacacaccaaacctatcgatctgcacagaaaacaggaaagctgacccttttggtggaggggtatgtggggctgtcacttgtcttcaataatacattaaacttacatcacagaaataatatagtttattgtttataaacacttttgccccagacaagccaaaaggcaagtgaatttgatgggtaaggaatcacttctaaggttggtttcccccaaattctgacttggaagccaattctcaaggttcatttttaatggtgaagagagagagacagagagagacacgagagagggagggaggcagagtgcaagggcatggtctttctagaagtacgtatcacatgcactctgacagaaccctgagatgcgcttctatttgggctaatgcggtacgttctacactgactgcataaggagcacgggtaatggggattcactttgcacaagaaggcttcatggaatgtttcagacagtgtgtattttgggctttaggttctatttcttcctgccttgcatgttggctcatccaatctaatttccttgagggcagggatgtctccacctcacttcccaccatattcctagcacctctatgacctgggaaataggagccagtcaggaatttttattgaatacatgtttctgtaggaagaatggtgagtagattctcaagcagattctcaaaatgcaagtttaattcataatttataccacaaggaagggaaggagagtaatagggatgagcgcactaagcaaacaattaaaaaataagctaagagtgtcttaaggcaaatcctttttttttgagacagcatcttcctctgtcgcccaggctggagtgcagtggcgtgatctcggctcatgaccctttaaggtagatgttactgaatcgattgtaaggactcctgggtttaagtgattccctgcctcagcctcctgagtagctgggactacaggtatgtgccaccacgcctggtaatttttttgtaattttagtagagatggggtttcaccacgttggccaggctggtcttgaactcctgatctcaagtgatctgccagcctaggcctcccaaaatgctgggattataggcatgagccaccgcacctggccttaaggcaaatccttcactctggaatgaacacagccatctggcttctctgtattgtcactgaagcagctgaacatctcctgagaaaagtcacagcaccgtaatatcagtgtcttcatcccccgcagcaggcctgtcaactccagtaatctcaccatgtccccaagcttagtgttcttctgacccctctctgcaatgacaatttcacaccttctccagctcctaggttcctcacacaagcctcaagggggctggaccttccatttctaaaggaaaaaggagccttaaacattgttggctctctttccaacatttttcatctgacaaatctaagcatcctatgagtctcacttccttggggcagctttcctgatgccaaaaccctcccacctctcaggtgtggctgaggcccatcttttacaagttttttccttccttactcaaaattgaaattatgaagcaattcaagtgtctcctctgctgggctaagccccaggagggaggaacttcaaactgacctatctggttcataactgtagccgtagtgtgtggcacacagtaggcacttaatatttattggatgaattaatagttaagaggaagaaaaggaggcaagaggaagtgcatattggtcagatcttcaaaggtggtaagagttggaagaaacccttttgctctgtcctctcaagtgatgctgaaacttgatgggggcacaaggaacctacaaaagcctgcttgcccgaccacctggccagggtaggttggtctccatggtgctcctgcttgcatataatccattactgtggctttacccaagttccctccagggcccccaagaggctcgctacataccagttttgactcataggcttgacataaaaagcaccgaaaaatggaagtgagcacagactgtgtgtctgccagctactttactgtgggttattttatttcgtcctcatgaccctttgcggtagatgttattgaatcgattctatggatgaggaaactgaggctcaaagttcagtgccttatttagggtcatgcagctacaggctctgtccccagcacttcctcttctaacacactgcccagcatgctctcagccccaggtattcacaacctccaggcgtctggcctgtctgggacagcagcagacaggtgaggatgtgagagccacacccatctccctggcaatcttaacttcactctatcaggacttgttttagggccagagagaagaatgttcactcccatctggtacacccactgcttactcccagccatgcattaatcataaacctccttccaaggtatctggagggctttacaaacatcccaccagctttgctgtgatggatgtggtgtctacaggcaggccagtttactgagaccagcactatttgcagtcacgctctgttaagcattgctttgcactgtttttatttggcttctgagggcagtaattcagccacctttttttttttcataataaaagacttaaaaaaaaataaacttcagtttctttgccaagaggttcaaaaatgtaccacttgacacaaatgcctctcaatcaaatttcctactcgtggctcatgatattgaaaagatccacttccttttagcacttgtttagcctgggctaactacaaatgccccctttcggcagacagctactacctcactgggactgcacagtaaaagatgcttgatctgggaaaagtaaaccctcaagactggagaagtagaatttaagagcagatggtcatttcatatgtcaaaggaatgtcaacagaggagtttgtaacaccagttcactgtgagctagtgccaaattagagaacgcgtcctgtggtctctcccacaccattagatgtactgccatcgtaaggactgctggcttaacagtgctaatattgtacccagcaatggcaaaaatgtggctgaaatcattacgcagtacttaaataatggctatctttatgaagttttaaaaatattaatagccaggcaaaatatttcttgattcataaaaatagaaccaaaatcctcaaaacacacatccctccaagttatttactggtgttattgtgaattacttagggctggggaaatgtttcaagagagactagcttgattagagaaagtcagaacttgtatttaaaaatatatgtccagagcttatcctcacagctttctgcctggagagggcagggaaggcagatgactcaaggggtgtgactcctaggccccttgtagaggaagggacagggtcatggttcttgtagaatggaacttccccaagggtggtcccagttagcagcacctgggaacttgttgaaatgcagaattctgaaccttcccccagacttatgactcagacactcgggggtggcggggcccggcaacctctgtattaacaagccctgcaggtgatcgtgacgcactctgaagtttgagaagcactgttctagaagagctgctagatgtatatatggtgatctgggatcttgttacagattctgatttggcaagtctggagcggggctcaagagtctgcatttctaactggcttccaggtgacatccaggctgccagtctgtgaactacatttgaagtagcactagtacagatgctgaaggttatacagccggatccctggagctggaacctagccttcagtttactcaaagattatgggatgataaagtcagagcttttgtttcctaggagccttcttgattcccttaaaggaacttgaatataaggcagctctttcccactccagagtctggtaaaatggcagtgatcgggtacattgctgctacgtagaagtacagaccaggttctgctccattcttttccactgaattgctgtgtggcctgaagcgagtccaagccgccccatgcctcagtttccccttctgaaaaatgtggtcatttcaaaagaagctaagggttcttttgaacccttagtttctatcattttataagttgccagtgattcctaaagtctaagataaaaattcaggactttccacacaaaggagaatgttgctccagcaagaatcttaaattcttaatgtgatcaatagtttcaactcccagaaagcacagtcttagtaattcagaggcaaacctgatgaggccacagcagttaggtggatgtcaggaagagaagccatggacggcctttttagtcagcatgcagtgccgggaatcactcccgacagcccttccaaaacaccatttgcactctggcaacatcaccatggtacaccggctgcagggctgacttacaagtctcgttattttttcattaacatgtacttggcatatttacatatttacaattcaaatttagagtagcctttcaacaaaatgcgaagacagaaccaaaacacacagatggtgcacggacaggtaacgcagaaagaaaacacttctcctgaaagcttccgaggctgattaaaggcatatacccaaaatattgaaaatcttacacaaaaagcaagttggaaatggatccatttaatttctaatctcaggacttgataagcttgaggaggttccatatgtgataagagattctggaaagcttctctgtttctcttactacaggcagtctgcaactcgggttggtttcactggtttcttgaccaatacctcgcatgatattttctacttgctgacactctgtcattcattaaacacataattgataaatacctactatgtgccaggcacaatttcatcttctaatcacaccatgaatatgaaacaatattggaccactataaactttgcaagaggtaaaaacctgtttaggattaagttcctaatacagagctgtattttgaccacaaatgaaaagccatttattgttgaactccaagcttgtgcaatcagaacaaaaaagccacaagttctttcacttctaccatgttgcactagaaacaacatttaatcacaataattgctgcttgattctgtttagcctggcggcagaggctccatggcattgatgcagctgcaatgcccttggactgatgttgtttcaagctgagaactgtccccaatgtgtctggtggattccaaagacagcctttgcatgttcacacggtggaaaggactccctcccacgcatgcacttgaccacagccagggccagccggcctctgaggatgggctggatcccagggaccaggaaggtgctgtatagagcctacctcccccactttctgaatggaagaaaactgatttcactttacagttaaagtgaaagcttaaaacagaaaatattcatgcaagaggtgacacatgcattcaaaatcacacagaacataaatgactggcaacagaccaagtcacctggtgaggaaaagaggggaaggagaaggatgagagggctgaggccaggacgcaggggccttgtgcatctgagagagacaggacatgggggaatagacttagggggctttccaggtaattgttttctgcttcacctctttgcctgtggctggccttaatccagggggaattctgagagaatggcatatatatgtatgtatgtatgtatgtatttatatactccaatacattgatctccctctcctccattctccaatttagggaagttaaaattaagtcaacacaggtgggggaaatcagtacaacagaatagtaacactcgtgcagatcttgttctttcagtctgacatggctgaatgtggaactcagtgatcagaatcagtcatgctctttggaagaggttcttgttcatttcaaaggctgctaataccttggagagccaaaaagaccttggacccgatacaaaaggcaatatggagaaaactggagggtctctagtagagacacaacaatgggacagaacatttctgagcaagtgcgtgttctgtcaactgaagtgataagtgtgattgtggccctatggaatacccagcctccatctgtatcagagcgcgtgtcctgcaggtccgttcagcacacctgcccctccatctgtcagcctcataggcttcacttgccgtccttcccaggcaaagatgccctccagaatccctcactccctgacgttctcccagtcctgccttgtaacacatggggcaatttgttaaagggctgaggcccagatataatagagttggagaggggcccaagaatctatattttaatttttaaatttaaattttaattattttttgagacggagtcttgctctgtcgcccaggctggagtgcagtggcgcgatctcgactcacagcaacctctgccacccaggttcaagcaattctcccaccttagcctcccaagtacctgggactacaggcatgtgccaccatgcctggctaatatttgtatctttagtacagatggggtttcatcatgttggccaggctggtctcaaactcctgacctcaagtgatctgcctgcctcagcctcccaaagtgctgggattacaggcatgagccaccatgcctggccaagaatctatatttttatcttgcatcctaagtgattcccaagtaggtaattcactagaaaaccctttgaaggacacaggtctcgtgcttgtgagtcctgcactgcccaatcctgaatctgttctctatcccttctctctctgtgtgggcactgaagtgccacctcttcctggtccctttccatctcactggttctgtagacaagcctcactgtgttcctggttcatagtgtgaaagtaaaaatctaatctcatagcgggtccccaggggcagaggcagtgaaactccagaagtccacagggagaactcagaaaactgaccctccttagaaagccatggagccaatgggattacaagacctcatgcaccaaaaagaatgcaattctgaacatctttaaaatcacactgtcttcctcgagattttccattttttttttctatttggaaatcatgaataaaatggaagttatgggttaaggctgtgtttatgaaaagtcttggagtataatgtgaagagttttacattttgagtgtcacagaggttttcaagttgaaggatcatatgtggaactcacattgtatgccacagtattaagaacttttttggagaggccttagaatatggattcattaagctaacattttaaagagagcctttccctgtgctgagttcaaagccctttgtatgtaaggcagtcaacatggtcactctacccccaatttccattttctttggaaagtagagaccaaggaaagtcttcaggttgtacaatgagaacaaatatcacagtatggctctgacagccctgcccccttcacttctctatgctacgttttcactctttttctggaaagggtattttaaaggcattcaacagagaggcagagagagagagagtagcctatgatacagcggcaaggtttgcaggtagggacaggcatatattagagacatgttgtgggaagtgcgggaaaaaggtgccaacaacatcttctagaaatgtggaagttatttgattttaagttaatttatcataaaagaaacatggatctcatggagtacaaggttctattaagaacttaaaaaataggccaggcatggtggctcacgcctataatcccagcactttgggaggctgaggtgtgtggattacctgaggtcaggggttcgagaccagcctggccaacacggtgaaaccccgtctctactaaaaatacaaaaatacaaaaaaaaaaaaaaaaatagtagacgggtgtggtggcgggcacgtgtaatcccagctattcaggaggctggggcaggagaattgtttgaagccagaaggtggaggttgcagtgagctgagatcgtgccactgcatcccagcctgggtgacagagcaagactctgtctcaaaaaaaaaaaaaaaaaaaaaaaagaacttaaaaaataaaacacgggagcttgaagaatgacacatggagtcaggaatgtgagttcacacttctctgccactgaggctttgaggaggtctggctgtactaagagcatagactatatttctgtgagtggcacctcctagaggcatgaggtttgcactaaatagccgtggcagtggccctgccaatgcttactgtgagaaatataacagtggaatctggtccgggggaatcactgtgtgcttatttctcatgcatctattacaggaaaacttcaagaaaaatatatttacaaaacaggacaagaagatgtgtttttaggacaaaaagaaaactcatctaggaaaatcaaggtagccactgacatctagtaattgctattgggaaaagaagttagtatgtatcattttgtccatcggattataatataagctatgtggtttcattctagttctttttgtaagcaattatttctaacagttacgtgatttctagacacaaattgtaaaacaatatgctattatcccataaacaagaataattcagtctttttcacatcacatattttagacctttctccaaactcttcaaaattctacttcattatacttaataaattgccatgttatagtgtttcaggaataaacaaactttaggggcaactggctcactagtagtcactggtaacactctgcttccctttacgaagaacataattaagaacaatgtaaggtgttctgcagtagccacttatctatcatacgtttttgattctgtagccaggatccatctaagacaccaagatgtatgactacagtatagttctcaaactattaatactctcccaaagtataatactacatataatatatataatactacatattatatactaatatataatatatataatatagtagtatatataatactactactgtaagaatttaaaagggtaaggtgaacctgacagatcaaattccaatctcacgtttcctaacagagtggtgttctgctccacttcctctcatctgtgacttcgtatggctttcagatgaactgaaggacatgctctgccacagctcactggaataccaacatcctccaggactgcagctggcacagtcctactgacatgagctcaggactctatgaggtagcagctgaacctactgatgaagtaatgtcataaaagtagcttttataaaatattaatataagaaattatcttgatttatctgaatttctcataaaactattaaatgacattgttctactgtgtggtacataaagctttatgtgtctgtgtgataaactcctagagattttacttctcagaagaaggttttctgtcctggtgaagtagtttgcctttttgtataaaagataaactacacatacaaaaatcatatttcctttcttcttttcccctcacatggctggctggatgctcaaagctgtaattatctttaattatagcaattatcttcgtctagctctttctttcctctgcctacaccaatgccaattacaagttttttatttcatatgttttaaaaaaccttatgtgtctttattataacaacttcaatatttttagaagcagatattaatttctgaataatggatacatgaaacttgaagtttaattaccatggactattcctttatagattttaaaagttctcaatctccagattatgctttagaaggaaaatacattttcaaaagagcaaagaataaaaggaaaaaggaagtcagaaaggaaaagactttcccatcaaactaaccttagggaccataagctctgatctctaaaaaaaataatgaagtattacccagatgataagatatgagatatagagactaagatgctgaaaatcaaaccaacggtatcctaaagactatggcgacctattaaattagaccagtggttttcaaccctggctatccattgccaactttttttttaagacaaggtctctgtcacccttgctggagtacagtggtgtgatcatagctcactgaaaccttgaactcctgggctcaagagatcctcccacctaggcctcttaagtaactaggactacaggcatgtaccaccacatctggttaatttttatttatgtattgttgagatggaatttagctatgttgcccaggctgggcttgaactcctggcctcaagtgatcctcctaccttggcctccgaaagtgctgggatcacaggtgtgagccactgtgcccaggccaaactttttacaatacactaatgccgaggtctaactctcaaagttggcttaatagatcaggaatggggccttgacattgatatttgtgaaggtgtccccagggtatctgaatatatgtttggggctgagaatcactgagctagactattcattcatatttctaaactcttaactagcagatgctattccatcttatttctcttgtagtattggaacatgtcataatcaggatgtggcaatataaaacagatacagctcattgttcctcttcccacataacgagtctatgctgcaattcacataaaccaaagtttctcacatgtatatccttaaagcccaggccaaaacagatcatgttttgaatctattccagagggtggtatctgagctcacacaacataaagactcagatttagaagatagggattttgagccacacttttttttgcttgtttgctacattatttctatgtagttttctctgcatccctcaaaagttatatggctattgtaatttattatagaaattaaaatagcattatttttaagcattttcaaatataaaaatttcaacaagaaatatataaaatctcttggcctgttacttgtttgagggtaacataccactgtttttaagcgtatgtcaaagctgatccaaaatacatttctctatccacttgcaaaatgatccataattcttagaaagaatgtacaataaatcaacacattattatgacaataacttttctttatgatttaggctattttagcttttctattgaccttcattgtttaaacggacacagtacactttgttcagctcagtttgaccaacattcattgaagggttctcatggggcaggtggacccaaccattccagcctcagctggttccttggtctccttgaccatgacttctcatgtgctttttctttctagcccttgaccatgtcaagcttcccctcacctggagcttttatactagctgtttgttttctggaatgaacatccttcaggtcatcatacagctggttcctccttattttttcagtcttgcttaaagatcgtgttctcagaaaagcattctatgaccaaccattctgaaactctcccgtccactccactacactcagccttcatctcattaccctgctgtcttttcctgttatccttatctgaaagcatattatttattggcctttgtgtttattgttgtatgtacaacctctagaatagaaccttcatgagcacaaactctatgtttgtctttgcagctataactaaggcactgatatggtttggctgtgtccccacccaaatgtcatcttgaattgtagctcccattattgccacatgttacgggagagacctggcgggagataactgaatcatgggagtggtttcccccatactgttctcatggtagtgagtaagtctcacaagatctgatggttttataaggggaactccttttgtttggttctcattttctcttgcctgccgccatgtaagacatacctttcaccttcctccatgatcgtgaggactctccagccacatggaactgtgagtccattaaacttttttttttataagtgaccagtctcaggtatgtctttatcagcagcatgaaaacggactaatacatgcacttacagcagagcaggtgcttagtaaatattgatggagtgaataaatgcatatctttgcagtcttactaagaatagtaccaaatacaatcctgtattctttaaggttgtaactactgatggctaatagataatgaatgtgtacagttgcaatttcattttaagctatagtccctcatgcaatatgcacatgttgggattttaattagattcacagtgccagctacttttgcagagaaggcgttttgcagcctgtgctttgctgacctctggctggctccaagcttctggtagagagggcttctccatttgcacattttgcaatcttagttgttcctttcaatttccagcagaaggcagctagacattaatgtctgaaactgtacttccaatcgtctgttgaggtttctttagatcactttatcgggagtaacaccatgtttatttggcatagggtcctcagtctgccatggtaaagtttttgggtctcttgcaattgttcatttccatacatgtcagcttgagatgggaggtacattgcagaaagcatccatttaatgttagtggactcattatagcctgggatcttttgttagtaatcttatccttccattattaccacatgatactgagagtactggccaagaagtcagctgcaatatcttcaggacaaatcctactgacatatggaatgacagttgggcactaccactattttgaggcacttctgtttggtctagactagcactttaagccatattgataacacactctgccagccttccaaacatgtgcctatgtttgcatgtcagctccattcagtatcttcagtatttcagattgccattcagcatagaaaagtatatttgaaacccctaccaaaatcagctacatttgtatcttgtgcaacatgcacagttcagtgcccttgcccagagtaggcacccagtaaatattaactccttttgctgcttccctggctggtttaacataatcttattttattcaaaaacatacttaaagaagaatctgcatcttcctgcattcaaagcagctgattcttctattatgatttataatttataattgaatttaacacagctgtaactaaaataaagaaataatcagataccagctgtccatttgaatatattatatatacattgagtttttaaaataagcaggttcttctgaatccactgatgaattttaatgtcaggaaaagaggcacaaccagacattgtattgtgtgatgcaaaaggaaaccctgggcactagctagaaagtctaacgataatgcaaactcgcattgatcaagcctctaagtctacataccagaatttaaaaaattttttttcacttctgtcacttaaatcatcaaatagcaagcaagaattttgcctacccatgtccgtcaactcacatccacaagacagaggtttgtgtataagtttctgtgagaaaatatcagaccaaatttcagacactgtataactatccagaatcattatcatccatatgccaacttaaaaggcagaggtatgggtcaaaggatgatgccaaattatggtaaccacacatttgagaaaacaccccaggatattggctcctctccctagctatgaaataccatagttgtttaaggtatggtcttgggttcttttcctgattttgctgcatattatcttcctggacacatcatccaaaaccatgccttcatttcccatcaggttgccatgatcccagatctgtatctctggcccaagcctcttttcagagctgccatcccatatccagctgcacctgggcttctctgcctgggtgtcccccaggccctcggcctcagtgtgcgcaaggctatactctccattgtaccctgcccctggggtcatcctccagggcccctctctctggaaatggtgccaccttcagctagttggccaaggtcaaatcccaggtcctccctgtttaccaccctctctgtttcctcccatatccaactcaacatcaagttccccttgccctttgtttttgagacagagtcttgctttgtcacccaggctggagtgcagtggcgtgatctcggctcactgcaggctctgccttccgggctcaagcgattctcctgcctcagcctctggagtagctgggattataggtgtctgccaccatgcctggctaatttttgtattttttgtagagacagggtttcaccatgttggccaggctggtctcaaactcctgacctcaagtgattcgcccgcctcagcctcccaaagttctgggattacaggcgtgagccactgcacctggcctcaagacatatgcttaatataaaatgttcaatataatataaattctctacagtgccagtataaagaaccatagaatgttcagggatctctgagatctctgaaatctagttccacatatttgcattgacattttatttactaaaaaatcattgcggtaatttaaaatatttgtagggtttgccagggtaaaattctcagattttgggcttacaactttgtacataacttctagtttggcaaacaaacgtaaaaaatatggaatccccctaaaagatattatgtgtaaatagagtcatcaaatttagaatatcaagccccagatggcttatcagtagcaacaaaaactgctttccttgccaacacaaattttataaaccggaaatcattctcaggcatgcaaagatagacatatcaggtctacaaatacttattactatgtgcttagcactatgttaggtacttcattacatggcccataaaacattactttaaaaacaaactgagagttcaaaacaaactatttactctgtagcaaaggcactgaagcctttccagaaagtgacccatactccagtgctgcagagcaagatggggactagcaggctttgaaagccaaagcaacaccatcagcaaacctgtgttgggatgtcttgaaaatgttaattaatttatatttgtttttcttttctaatgacataaatcgttggggattcaatatttctgttgttgttaacagcaaatgactctaaatgtgatggaatggccacgtaaacatgtctttgtacgaccattattaaggaaataaggaaggaggcttgtagcttcagaagcttcccctgtcactcagagaggaagaaagtgagagacatgaggatcagagccacagttcttaatcactccaccactaagactttctaaaatcttaagaggaacaagcagtacagtggacattcagtgtttgggaatgaggtgcaatcgggcggatagagggcccttttgtgggctttggagcttttggaggtggtgggttgggtaaagcaggctgaagtcaggaggcagagcgcaagaaccatctgatctctatcatttaaggacttagaagttccataattataaaaaagctggcaccaccctcaatgcacatttgccatatttctgcactacacattcttgaataccctttgatgttctatttatttcaaagagtataggtattttttgatccagttcacatcactgattagaggtattttagctgccagataaataaatctccattgaatgcaatttatgggatccaaaagcaatgtgtggatcaatctagaactatatgaggcttagctggttttatgaaaatactcataacagtaaaagaaatcaataacaatttattaaggtttttgttctttgtataggttttgaaatgagttcttacccattataaaaggccttgaatattttgggaactgaaacattgtacttgaccgtctctggttcttttcctgagttgaccctttatgttgaataagcatattctacacattgcagctgccagactgtcaggccaagatacacatgcactcagaggcagtgagctttacccacttacattatatttctgcaacagggaaagaatgtataatgtttaacctttgtaagaagcacttggaggttcatctgatattctataaaagtaagcaattaaagaatttggcttaaaatctgatttctaattttcataggaaaaagttaatactttccatgtattgaacatctatgattagcctggtactttttaggttggagcctcacctagaaaaatcaagttatatttaactttttcttcacaggattgttgtgagctataggtaggtatagaagattccctagatggtcacaagtcttcccctccctgtatcctcacttcttgcaacgtgactttggagctccttccagcaagaaatgctgtctgtttctctactcttaatggtgggctgatttgtgactccctttagctcatggagctcattggaagcaatggtgtgtcaatgttgaacccagcccacatgctttgaatgattctactctcactctggaattctgctgatcctctatgtgaataagcccacactagcctgctggatgatgagaaggtggtcatccagttgtccttattgttcccccagtagccagccaatcctcagaagcagagacatctagctgactgcaagctgaccaaagacacaggcatgagcccaactgagaccagaagaacctccaacctaagatggcccaaactataaaactgtagaatgagctgctgagtaaatggctgttgtttttaagccgttaagtcatggagtggtttgttatgcagcaaatgctataggaggtattattgtcctcatggtactaaagaggcacagtaatttgttcaaggcaaactagctggtaaatggtaaggctatcaggttattatacctgctttaagggcctacactcttagtcacttcactgccctttgatgtaaatgagaaagtacatgctgagtgccttccacatgctcagttgtcggctagacatattttctacgtttagggaacttactacctccattttgtttttcactaatgaaagcacaatttgacagttctccttatgctattgcctcacctgaaatatattttctacccttgaaacctgctcaaatgttaccatttctcaggaacaccctctaatgtcccaagatagaactgaagttttctacctgtggttgattgcaaaaaataaccattaattgctcactgtttcctttctccttgccctttaaaatgtgactttttagtaccttccatcaagaaatgaaatctctttccccactccttgtgtctagactgggcttgtgacttgctttggccaggaaatgtggcagaagtgatggtgtgcccattctcacaccaggcctaaggtgccgtggatacttaggcattctctaggaaaccctaactccatattccaacaaatctaggttgaccctgctgatgactgagaggccaaaggaacagagcttggtcagccagcttgtctcagttaaagctcccagaaaagtgagagagccccaccaagatcagcaaagctgaaccacagctgaccattgttgcatgagtgaacctggccaagacgagaggattgcccagctgagcccagcctaaactatcaatcacagaatcaagagctaaatacatgttcatctaaagccactaaggttgttatgaagcaacagataatgaatacagatcctttgtattctttgggcatgtttaaacttatttttggaatagcatatgtattcaacaaaggtcaccagatgaataaagaaatcactaaatatttatgcaattacactaagatttctctaacaaaacagaactctgactttttatttctaagtgaataattctatctttcctggctgtgagacagagtgatgtttatagcacaggacctgatacttagcaggtgcgctcaataaattttagctcccactgatcttgtaggtgaaataagatgccaaacaaaagtcaaagcaaacaccatgcgttgacaaaagcaggatgttacctcctaaatcctttcaaaatcaggacaaactctcctggtatttgtaggatggagacttagggcaagcaacacgtgctttctgcccctctccagatattggtaagtttctttctttttgaaaataatcttctttaaagaacttcacagctactcaagctacccaattacaaagagcaggagcattccactacagaaagacctccccaggaggctttccttgcttgttctcaaggcctgtatttctcaactttggctgcatattcaaaggaccttgggagctttaaaaaaatacctccagagatagacttaattagtttgagggtatacctgcacatgggaatttaaacagccccttgggtaattttactgagtagccaaagtggacagccactactcaaccttttcctagagtgcctctactagtcaaataattatgatcagatttaattttaaaggcagtcctaaataaaccctttttatatgtctataatcaaaacccagcactgaaatactacagctggaaaataatttcttataaaggacaatgactggctcaatagaaattaagaaacaatgatcagataagtaacttcctgataattaactcgacaagcataatatgaacatttggcaaggtctcaactgtcttaaaggccttaacataattaggtattcaaaactttattggcctaaattaaataccacataacattattgactatattgaataacaaattcaagctaaattgcatttaagtgtacaatcttaaagtacattagcctaaaatctttctttctcaaagtgtacattatcatttggatagtaatactttatcacaaattaaggcacaatttaatattttaatatgattttgagctcagattcaacatgggtatttcaaaacaactggtcttgctttcctagtacataagtgactcacatggcaatatggtttggctgtgtccccacctaaatctcatcttgaattgtagttcccattattcccacatgttgtgggagggacccaatgggaggtgattgaatcataggggcaggtctttcccatgctgttctcatgatggtgaatgggtctcatgagatctgatgtttttataaatgggagttcccctggcacatgctctcttgcctgctgccatgtgagacaggcctttgcttcttctttgccttacaccatgattgtgaggcctcccaagccatgggtaactgtgattccattaaacctctttcccttataaattacccagtctggtgcatgtctttattagcagtgtgagaacagactaatacagtaaattgggaccaggagtggggtgctgctataaagatacctgaaaatgtggaactgactttggaactgggtaacaggcagaggttggaatagtttggagggctcagaagaagataagaaaatgtggcaaagtttggaacttcctagacacttattgaatggctttgataaaaatgctgatagtgatatggacaataaagtccctgctaaagtggtctcagatggaaatggcaaacttgttgggaactggagtaaagatcactcttgctatgcaaagagactggcagcattgtgcccttgccctagaggtctgtggaactttgaatttgagacaaatgatttaggatatctggttgaagaaatttctaagcagcaaagcattcaagaggaagcagagaataaaagtttggaaaatttgcagcctgatgatgcaattaaaaagaaaaacccattttctgggagaaattcaagccagctgcagaaatttgcctaagtaatgaggaaccaaatgttaatcaccaagacaatggtgaaaatgtctccagggcatgtcagagaccttcacagcagcccctcccatcacaggcctggaggcctagaaggaaaaatggtttagtgggccagggcccccctgttctgtgcagccccgggacatggcgccctgcatcccagccgcttcagttccagccatggctaaaaggggccaacatacagctcaggcccttgcttcagagggtgcaagccccaagcattggtggcttacacatggtgttgggcctatgggtgtacaaaagtcaagaattgaagtttgggaatctccacctagatttcagaggatgtacagaaatgcctggatgtctaggcagaagtttgctgcaggagtggcaagctgatggacaacctctgctagagcagtgtggaaagaaaatgtggagttgatacccctacacagagttcccactggggcactgcctagtacagccatgagaagagggccactgtcctccagaccctggaatggtagatccactgacagcttgccctgtgcacctgaaaaagtcacagacactcaacaccagcctgtgaaagcagccaggagtggggatgtaccctgaaaagccataggggtggagccgcccaaggccatgggagcccacctcttatatcagcatgccctggatgtgagacatggagtcaaaggtcattttaaggtttaatgactgccctattgaattttggacttgcatgggccctgtaacccctttgttttggccaatttctcccatctggaatggatgtatttacccaatgcctgtacccccattatatctgggaaataactaacttgtttttgattttacaggctcatagatggaagggatttgccttgtctcagatgatacttaggactgtggacttttgaggtgatgctgaaatgagttaagactttgggggattgttaggaaggcatgattggttttgaaatgtgaggacatgagatttgggaggggccaggggtagaatgatatggtttggctatgtccccacccaaatctcatcttaaattgtagctcccatgattcctacatgttgtggacctggtgggaagagattgaatcatgggggcgggtctttcccatgttgttctcataatggtgaatgggtctcgtgagatctgatggttttataaatgggagttcccctgcacaagctctctcttgcctgccgccatgtaagacgtgcctttgcttcttctttgccttctaccatgattatgaggcctcccagccatgtggaactgtgattccattaaacctctttcctttataaattacccagtcttgtgtatgtctttattagcagcatgagaacagactaatacacgtggcaatagggttcctttttgtgattatttaattcctttttggtagagttcaaaagtgccgaaaatgatgggtaatcttatgttttaagctatatattgcatatataatgcatgcaaattgctttaatgccaaaatttcatccttaataaactctatgctgtaatcacaaatggacctccaacacacattcagagtcagaattctccacgccacaggttctgaaaaacctggttcgaccctctgacttcacagatacgaaaaatgacatccagaaaggttaaataagtcaaacaatgcccacaacaccaaatggctgggaatggagcccagatcatctgagcctgcatcctcttgccccgctaggggcatctggaagataacagcagaagtgtgttcaagccctacagaaacagatggcagggctggatttggtctccagcttttgccaaatacttggattttgccagcctttgctatagatgactatgttcagtagaagacattgacaacaggagatatcattatcactttgtatacttcaattcttcttatcacaaaacaggctgaagtcaactatggtttttaatacgttagttataaatgaatttgctgtattttttctagtctattattaacaacttacgtcagcatggtacatgtgttacaattaatggaccaatatcggtacattattattattatttggatttccttagtttgcaccctatgtccttttatttttggttccaggatcccatctaggatgctgcattacatttagtctgctcatttttcattacttcaagtgtgtgtgtgtgtgcatgtgtgtgtgtgtgtgtgtgtgcctctgtgtttgtgtgtgtgtgtgatagagagagagaaagagggagaatacaagtatttcttttctatgtagcaaattaagggcaaaatcctacaaattacaattctcacgttctctaatgtaaaagaaaagggcagatgttaatgaagtaatctgtggtttcaattatgaggaaaacattgtggattaaaggaaggttaggttaaaaagaattcgacatttagaaggacctggaaacagagtttctgattccagcatggattaacaaaatctaaaaagcaaggaatgtagtagagtagtgtgagaatttaaagtaataaaagtcagttcacatagaagcatggtaacgcagaagaaagaaaaaacattgtgcaatttgtcaccatttactttagaggagtctgcattttaaaatccacagaaatgcagtgatagtttccttgccagtatttgtgtaaaacattttccaaacaagactgattcatcttactctgaaatgaattgttagatcacaacagtgaatgttaaggcatttgcatcccttatagaaatgccaaacattttactatgcctgatgctgtactataaatagggaaattcaaatgctaaaaatgttctctaagttgccaaacatagttctttaccatgtacttcctggtacaaatgacttgttcttccaaagtctgaaaatgaaagctaactgcaattcagaaaaatgttgcaacttacttcaattaatcaaatgtaaaagttatttcatttctgtatatttctttttccttagatcatatttactgaaaggctcctttagacatttaccaaagttttattaaatcatagttagtctgataacagttgggttttaaaattaacaattggaacagccaagcaatgtcaatattgctggaaaataacgatgcttatctaagtcattctgaattgttagccacatttggatgtaatagtagatgtaaaatttacttactatattttttctaaataatatatgggcacaatagtgtccataaatccatatattaaaggtaaaaggtatttcatttcacaataatgcccatatattattgggaaaattgtactaatttataattggcatttcaaaatagtatgaatatctatgtatatcttcaataaaaagagaacataaaaaacagtatagggatttgtttaacatatttaagattagtattcatttgaagaggtgatccctgattttcactgagagctgggacaggaaattataggagatttttctatgatgtggacagggcaaagcacagcaagaactgctttataacatgttcttcaaatcagctgactaccccattggcctttaatctcccttctgcaactgaccagacctcatattatccaattaccagtaatctactcaagaacagcaaggttctctttaaattggatacaaataattattttaatatcttttcctggcttctttaaagatttcatgttttttgacttgcataaacttttgcaaacctccatggaagatattttaattattttaaaattttatggcacataagaagtgccttaagtaaaattacttgattttaagttaattattattaaaggttacattaacaagttcatttaaatacaaattttactaattctagtttgacttttttcttatttaacagtgatgtgctacttagtctactttaaattcatcatgtaatgaaatgcatgacttgtttttgaaatttttgaaatgacaaatttttgaaatgacaaatgggcatatacttggttttgggaccaattatataaatttcaagctacaattaatatgtcatgatagataaagagataaaagttttcattcatgaatatttggtaatcttgcattttggacaaaaataatcaacctgcaataatttttgtgtttaattataaaataatgagacaagataaagctttaggctgctgtttgtatgcatttctctgcagtatatatatatatatttgtgtttcatttgactctgttgtcagcttatcaggaacaatgtaaggagagagagagagagaaagagagagaaaaaaagggagagagagggaaagacagagggtatgagtgatatttatttctaataaatcaaggtcaaattacatatgattatcattactttttcttttatcaacattgaattttataccatataaatgtcctaatagactaatataaaactccacaaatacattaagatatttaagattaaaagaataatgcaataaacacaggtttaggaaatacacacccagtttaggaaataaaacattatctacaccatgaaaagtctgtaagaattttgaccagatgactgcaaatgataatcgtcacaacatcagttgcttcttctgcttactgtctgtaatcagttatccattctatgtataaagtaacagtaaatgactaattataaaaactaattaaagcccccatgggggcttgcagtgtttatgtgagtcataagcatgttcactcatctgactggcactaatagcttcacttacattaagaggtcctgaagcagtattattttctaaaacgtatttaagctatcattttatttattaataattacttaaaaaatagaacctaggtttgaacctttaccaccctgaacaacacaaaacccctgggacagctttgcatcgctgtgattttgtgaaaagcctgttggaaaccccgatccaggctcggccaatgctaagttagagatgcaggaaggagaagggtgcacccagaactgatgtgaggatgcacaaaggaggccatctggagagcggctgacacccccgggctcctggcacacggcccctccaggatggagagaatactccggagtccagagtcaagacccaaacacctccacatatacgcaagttgggctgggctacaacatgtaatggttccgtaaatgaggatgatgtatattaaatgtatgtatccacaagacctatgaagtgtatctactgaggttccaaatcttggtgccatcccaccacagagctgaaatttctacctaaaagactaaagggccataccacagagttaaaagccatgggaaaaatttgttcaaactgggaacagttgtttcttttaggaaaatgtttgtttttagtttaggagtctgttaattacaaagctgtggtcatagttcccttttcaaactgttccttagaaagcatagaaccaaatttggttctatcatattaaccatgaaggatttcacagaatgtattttgcataataacttccctccttcttccatcttttctaccttacattctctgtgcctcattttaccctcaccaatttttcatttgatgtgttgtgtattgtatcttattcttaaaactcttctggaacaaaacagtcaccagcttataaggatgaaaaaagcttagggataattcagttctatcctccatattttacaaatgagaaatttcaggctctaaggtcccaatagctatcagtttaaaaagggactggaatttagagaccccaaatgtagcttattgattttccctcaatatctgtttgcctcctatgacggtggatttcttttttttttttacctctccttaagacaacactgaccaaatgatgttgacagacattttcacccacctgagaaaatataaaatgtaggacattctgcattctacatgttgctttggagagtcacaagaaaattctgagaaatcctgcaataagtaaatcaatttaattttgctgaacccatgtctcccaaacatatccaaccatgaataaacctttgtttgttttctcttttgggggcgcccaaatgagagagagctgcacccatcaaactcctcagattccactttgggaagttctgtgttaagacaaggcctccaggagcaactgtctaaatccccatggcagtggggagggaggaattgtcaaatgtccatcctggagagcggctgctctccacactggcaggtcgtgctacaccaccgtgcccagggccatggtatgtcaaagggcccaggacccaccagtgaagaagctgtaaaggaggggcagggcagtaccctggtcctttctctacatgctgctcgggcgttcctctgcaggcatgtcacaggatgcagttcaccctgacagccacaggaggaggtgcctggaatcctgtttaccatgtaacagggattagtccgcacccactttgaattctagaaggacagggatgacaaattcttcctccactgcagcaaatgccatcagtcaatggggatagagttccaaaaatgacaacataacatggtgtgtgtacctctgtgggggcagtgtgtgtgtttacagaccctaaaggggcctgacagttaagcaagctctgctatggtccaggagacacccgtgtttagacgcatggagccctaatgcctagaccctggagtagatgccaatgctgtttctacccttccttggcaagtcacttaccctctctgagctttagtttcctctttggtaaaacaggaatgttaataatagtaatagggtgatcaggcagattaaagtttaatacttgcaaagtgcttagaccagtgcttgcctcgctgtaggtacaatatgagtgtttgttaaataaaatagtatcattcacctatagtcccagctactcaggaggctgaggcacgagaatcgcttgaacctgggaagcagaggtttcagtgagcgcagatagcaccgttgtactctagcctgggcaacagagcaaggccctgtctcagaaaaacaaaacaaaaaaaccccaaaataaaagagtgtcagtaagtgtttactccaatttccctcgaccgataaacattttctttcatactagatggtgacacatagcattggtgaaacaaggcccttgcacgccttgctttagggcatcctcccccgagccacgatgatgacacacatgaggctggtgcccacactgacttagctgcctgcaggctctcccagctttctggcgaactgtggtcacagggtatggagacccagctgtcactggtgtgtgctaaagatcaggtctcagtggttaccggaaattccgcaggaaaggaacaagcaggcaggataggaggcatggctgctgagtcacagatgggccagcaattaccctgcacacgaaggtgtcttccagggacctgccagttctgctgctgcaggcagcacctccaaggagtccctggagggagcaggagaacctggccctgcctcaacctcacgtccctcagtaatccttaactcagctgtgaaaaacaataaaataaaaactgcttgaaaaacagaccaaaaaaatgtaccaaatggaaagaataaagggagtttattcaagccttggtggttttttcttgctatctttgtgatgtacttcaaaatatcatcatataaatatatttctatacttttttttttgagacagggtcttgctctgtcactcagactggagtggagtggtatgatctcagctcactgcagcctctgcctcccaggatcaagagatcctcccacttcagcctcccaggtagctgggactacaggcatgcaccaccatgcttggttaatttttgtggagacagggttttgccatgttgcccaggctggtctcgaactcctggactcaagcaatctgcccacctcggcctcccaaaatgctggaaatttaggcatgagccaccacagctggccaatttctatacatttttaaaaagacgaacaaatgcatcatcaaaaagattgtctaacaaatacattttaaaagactgagaaacttaaaaacaacaaagcagataatacgtgtgaatcatgtcacaagtggtggagtaaaggacctgcttttgttacataagattaacccttacacaggctacataaaaagggatttgcaataatccaatgctctactgtatagtgacactactacggatagaattttaaaagtctcataatttatattatgtagtttttataaaaatatccagggagctgttcttaagaatataggccaagaggccgggcgcggtggctcatgcctgtaatcccagcactttgggaggccgaggcaggcggatcacgaagtcaggagatcgagaccatcctggctaacatggtgaaaccctgtctctattaaaaatacaaaaaattagctgggcgtggtggcggatgcctgtagtcccagctactcggcaggctgaggcaggagaatggcgtgaacatgggaggcggagcttgcagtgagctgagatcacgccactgcactccagcctgggcgacagagcaggactccgtctcaaaaaaaaaaaaaaaaaaaaaaagaatataggccaagattgggcagccatgagaaatttctctttaagcctaaagacgagggtcccccacagctgctgttggggctgctgggtgtggggcaggctctcccactctctagctcacactgtctgtgaacacagcagcctggcacacatgcacacacacaaggtccccagacacctggggctatcagggcccatcatattgtgcagtctctgtgctcagggagaagtgggaacacatagcctcaagaagcagaaatgccaggcctcagtcacggccagctcagtttccagttcacggtttgcatgctgctttgagcctttgcttttacagttgttgcctttaaagttctgaacatttggagcatggctccctctcactagcagtgcatctcttacctcaatgcacatctttaaatgcgtcttttttctcttatctttggcagcatacacttgcttctgtgaaccaccagatgacgtacataggctaattttcatttgtaccaatgtgaatgctgacgtacaaagggcaatatcaaagcaggtctagtgtgttcatcaagtatttctaaactttcatgattttaattcttgttactacagtacttggataggcatactgcatcttaaagacttttttcatgtaacacaggcataatgcaatgtgaagaaaattatcactgaaaggaaaactgtttctccaaattatgacttacgtctacagtaatgagaagctattaaaatagatttttgcaaaatctctaagctgatctgctgcttagaattttgagatttcccactgctctgctattttcccattctgtacgcacagcacagattcctgccaagcctattacagtgaacaaacaatgtcctctctgtcagaacagagaatgaatagtatcacaaaattctcctctaatgtacagcctacatttccctcaccccaagcccttcagaagagaataaccaggatgaggaccgaggaggaaaacaggactctcccctggccaatctgaaactgccttccagaacactaagggctaggtagtatcaaccatatcatattaacttctaaacagagaaagttgacaagtttattttcttttaagggggatcatatgtttttgcatttctgtgtgcgggtacacaaatatctttataaggaaggaggtgtttcatcagataaaacaagacagcttttagctacagactgagcagcgacaggggaacttcatagaaatgacacagcaatttgtgctaaaacattggcagctaattcatgaatgccaaagctgactatgaattcagctgcttctgttaagcctttattcccactaagctcatgattcacaaagaaagcgcctagagttactcctctgaaacctatagtatcatgctgacagatccttctttggtctctctctctctctctctctcacacacacacacacacacacccccctccccacaagaggcattacagatatgatttccaaaacaagaacttcatgaagcattcctcacaaaccaatgaaaggcttactaaaggcttacttagcaggtattttcatagaagaacatggagttccttaaaatctttcatacttgtctcagttggtgtaaaatattatgattcaggcttttccctcttgtgacatgaatacagcatatattttattttaacctctaaaggaaactactcatttttttcctcataaaggatgaaatgttattttcataatcgaaccccgctggcttttgtgttcacgagtatctgtaacacgaagaaaaaaggccagcctcttctttcctcctcatttcccacacatttttcctacagctcagtgagctcccagattctgatggcattctcctggtaacacatttagaagaggctgcaggataccccaacagcactgctttcttctctctctctccctctctctctttctcttatgtcactctaggtctgtatgagactaaacaattaaacctttgtgctgtaccactgccattcaaaaattctagtgatgtgtccctttattggtacaatggtaatatttaccttggaggaaatgtttgtccagtagagtattccaagttctggcaatgtattccctttgaaatgttgtggtgagagttctctcttctttcttggcctatagccaaagagaaggaaagttagaaaaaaaggcagatggatatacactgtgaaagatacttgttcagttcactgtaaaaatgctagtgtacttatgccaaacactgagatttatattcttatattccttcctgaacaaagcaaactgaaatgtagaggcacaactatagacagtaataattaaataaaaaaatttcaataaagaaaacttcctatctccccatccacccaaaaatttttaataaaaaagccacataagtgtctaatcaaatacaaatcaatttacttgctctttctatatttttcctagtttatgccaagtaaacctctgtgttactacagtgatactaaaattcaaataactgttttctgaatttgaaataaaacaagtgatttatttgaaaagagcatttatactttttggtaaggtaagctgtgattcagttctgaaaatttcttattagaaggagactttggtgcagcgtgaacagtgtcacctggacgacatgcagatctagccccgagttgtcccttcacgcattctgctgtggaaatggggaagatgttcagaaaagagaggctacatgggcgacttccctcgctctccctcctgattcaacagctccccaatcctacctgctgttctgctgtttttggtgcctagcccttcctcctgcccccttcctctctagttctcttcccatcctcaaataagtctctcccatattgaacactcactttacataagacaccatgacaagtgcagtaagaaagggaggaggggagagggacggaatgaatgaatgaacgaacgaacaaacggatgaaagaacggctgtgtttatgctctaaggagaatatcttggctgttgactaagattcagaacctctcaatcattttaaccaactgaggcataattcctgatttctgacataacaaacggagtggaacgtgagccttctagatttgcatctactgatgttcttttgttagaaccacatattatcatcttagactgtgtgttgctttctctgatagcagagtcagcagaatatttatattatcttgaggtatatctattgtttccctgacagttagaaagtgagaaactgctgtcttttgtttgccactgcatttagctacattattattttcttttaataagtttaaaaagatcagaacaagacacacaatcatgggctgtcttcttctaagccgactccaggtctttctgctgtcaatctcatcaactaggagacagagcttcgctgggtgcagggcttgatagacaactgagttcccaagccatcgttccactcttttattagacttcaagtcaagcctccttctgaacccctgccatgcagatatatttagatgtggattccaaccataaacctctccactttttcttgtcatcatggtcaatccagggaattctcctgaattagccagaaatatgagcaagatttaattatctaaatcaaattgctgcaattaaaaggtaaaatttaaagaactaacaatttttttaaaaatgtcaaattctattaatgtgtattaaaaataatgtttggatgtgctttctctatcaccagatatgagtaagatcctgacttgaaaactggagacaagatttgacagttaatttaataatataaaaatggtgcacagttttgaattttcaaaatatacattttgcgacttaaaaatattccaacgaaacaaggtcatcaagacactgtggtgcagtcataaggatagacatacagatcaatactttagcatccaggaataaacccatatatttatattccttcaattatatggccagttgagtttttggcaagggtgccaagactattcaacggggaaagaacaggctttttcaacaaatggttctggaacaactagacagccatatataaaagaataaagttggatccttaactcagaccgcagaaaaagttaatgcaaaatggatcaaatacctaaatgtaaaagcgtaaactacaaaactattagaaaaaaaaccaaagggctaaatcttcatgagctcagatttggcagaggcatgtgaccccaaaagcacaagccaactagagaaaaagcagataaactagatttcattaaaataaaaatatttgtaatttaaaggacaatattaagagaatgaaaagacaacccaaagaatgggagaaaatatatgcaaatcgtatgtgataagggacttatatatggaatatataaataactcttataactcaataataaaaagacaacccaaccaaaaatgggcaaaggatctgaagagacacttctccaaaaaagatacacaaataatcaataaacacatgaaaagatgctcaacatcacaacataagtagccatcaacaaagtgcaaatcaaccacaatgagataccacttcataccttcctagtgatttgctcttggccataataaacacgtctaagctaataacaagtgttaagaggatgtagagatatcagaaccccatgccctgctgatgggaatgtaaaataacgcagctgctttgaaacagtctgttagttcctcagaatgttaaacagagagttaccatgtgacccagcaattccactcccaggtatatagcaaaagaaatgaaactatacatccacacaaaaacttgcacatagatattcacagaagcattacttgtaatacccaaagaagtagaaacaatgcccctcaactggtgaatgggtatatacaaaatgtggtatatccatacaaaagaatagtattcagccataaaatagaataaaatactggtacatgttacaacatggatgaaccttgaaaacatgctaagtgaaagaaaccagtcacaaaaaaatattatatgatcctgtttataagaaatgtccaaaataggcaaatacatagagatagaaagtagatttgtgttccttagggctaggggagaaggggtgatgaaaatgtcctaaaattgatggttgcactttaaatggatgacttgtatggtatgtgaattgcatctaaataaagctcttatgaaaaataatattccaaggatttggatgttataagtaagcatcagtcatttttcagatcagtcttaaaaaaaaatggcaaaccccaaaacaattttagctggaatcatgggagttgttacactaagcagataacctagctccattgcaaactatcatgccctgactgggacaacttgagtataattctgatagaccaaacacttcttcaggtctcctttcatcttgctgattatttccaaaggtgatagagataattaggttatcagggtatagagataataaggttaatcactgcaaatgattattgacccaatcaaacagaaatcccataccttcaatattgatttctttttccaccgaatggaattttaggacttctgatactgacgatttagtcaaacatgacctctccctgaaacccacatatcctgtccatggaatgccacgcccagcagtttctgttacatctggctctctgacagttttcatgaggacggttggtgacttcttaatactaatgatgacattcataagaaggcccaagcaagtgaactccagttcaggatgtgtttttaccaaactaacctgaactcttgttctggctaaagccacccagcagaactgaaacagagctccattctgggacactgaaaccctgagggatgagatgggcacctgacagatggcctgggctgagcccccgctggcagtgctgaggagggtctaaggaaaggagtgttttctcgaggttatatcctaacagtctcttctggggaaggagtaatgatgttgagagtgtatctccctgctatctgggtagacaaatacagggattgaggagaacagacttcagcaatctactccaaattcatgtctgacttttaaaaactgtacctggaggcaagataactactcagtatgagaccagaatcatgaaactcaattacagattctcaaatttaaaagaaacttaaaggtcatccataaatcaaccccacttgatacttgaatcctttctacaatgtctgtgacatctcatcgataactgcaatgtcaaaaggacttggttaaatagaacagttcaacgtactgagcatggaatgaatcacagtgcttggaatatagtaattgctcaatatttattcactgattgagtgaattcattttaaaaaaatcagagtaggctcaaggatgttgctataataaaacctctctcactcacagtccctgaagacagagaagagagtaggattaccggctgctcatgactggcatactgctgcagcaatatttcccacatgcaaacatcattccagtaaatacaatactttatctatgttgcaatggaaataaaccaataaacaaaacttagacctgctaatctacctatgctgaattccctgccacaataaagggcttcctccatcccaaggaatccctttctgtctctgagaagtgttgttaaatttgagctaggagtaagaaaggttcttctgtgctccagaggcttagtggcttcaaccttgtttgagtcgtggttttaaggtctagggccatgcagagcaagtccaatagttccctgacatggcaacccttcagatactggaagacacctatttaaagaagttcctcttcccctgctcttgagctttccttctctattccaaagaatacgatttcatgtaccacctgccataactcaaaagaacacaaaggctgccaggagaagggagcgggtccctggccaggtctgctcacaagagcagagtagaagagcctgctgcagctacaaagcccaacctgggaggggagcccaacaaccaagcacaacctccaaggaacaaggcaacatcgacctgatttaggaaataacccttatttgggtgtcggtggtggcggtgggtggggatttttggggcccagctatcgcagggaggcaaagctatcagcaaagagtaaataggttggtgaagtcaggagggtcgtccattaccatcctggaggtctagtcacagcaacagaatctagccactgagcagctactcagagtaagagccacagttctcaagaagatcacctggcaagaccaacacagactatgagacccaaagaggatcttcagtcccagacgcttggttacacagacacagaaacagctgaaacttggaaggccaaggagtaaggattatgggagcctgagaatcatcttaggataccagagcctacatctgcatgacaataacatcgctggaatgtgacatagtcatcctagtgttcactggggcaataacatctcaacatgggagattcagcaaacaaacacagctggcattgggcaagatactactgtgggcgaggcacagagagagtataattagtgatgtgctccagtggactgtggggtaggtttaaacatttaaagtgttttctgctttagtcagaacaaattcagatttggggagggcaacgatggcacatgcaagaggaacaaatagtgagggaacaaggaaggcaggaggagatgtactgggggctggcactgtcattttctggatgttctcttctaaaagatcaagctcaaaggcaattctccaggtgaagaagcacttcatcagtgaagagtggaacaggtctcttatttctgtccacccacattatttagaaggccaaagatcacagaagcctttttaacagctaccctgacacacatacacacatatatacacatgtgtatatatgtattaacatatatatacatgcatatatacacagttataaacacatattaacacatgtgtatatacatttatatttgactaaaatctaaatttctgtgaaatatgatgctgctaagcttcatctctccttactgttcctttgcaatttaactgggggagcagggtgtttatactgatccctgtgacatttctgcttcttagatttgggtcactgtgttaaatgtcaagatggtcctaattctgtttccatcagtttttacatctgctatctctcccaactttggggcatgcatttatacagttttactcatgtgaggcctaatgtggactaagactggataaagttaaaataccaaaaacctctcttcaggaagagagcaatttattaatcagtgctctctggatatgcctaccaaaccagttattaacccagctaattacacacattccttatttgtccaaatactaaatgttagcaatttgatatacttttggtagaaaaaaaaatgtatccttaaactaatgcatgatatttctcattaacctgtctgaattccctgacaggtttagtacattatcaatataacagagatcaacctcaaagtacagatatttcattgatatttcaatattcagtccatagtaatcatgcaagaaaactgtattaaatatgctcaatgacacagcaattaaagaggtagccaaagacaatgcatatgggctatgatgcactgtgcaatattggaaaaacataactaacaacgcttctgcctcccttatcctcggattcttgttttcatcagccgctcttctccccctgctaagctccctcatgtttcctggggctgctttttcttgctgcttctcccagctgtgcctctcgttttttccactccccagctgctttggctcacactttcagcctttctggtatttactgtgttaacagttctagtcttcatgccatctgatgtctcctgtttcatttttcacacactcgaacagctgaaatccctgatgtatgcaaagcagcagtccattaaaagagggttttctgggttttatttttttttcgttgagtacagaaaaaatggaagcagcaagaaagagtagttcacagagctgccaaaagaggccactgtgaagataagatgaaggcaaaatataataataatcagatttctttaggcatcaaaaagattataagtatgacaccggaaaaatagttctttctgcaaatcctcttcagtggtgtggtttaatgaaaactctgtaatctcctttccaagaggaccataattttcttgaattctaggaagctgaagataaaaatccttaacgatgtatccttatactatctacaacatacaggactcaggtaagacagatacagttataatacatacattgatttttttaaaatgacattttactagcaaaaatcttctatttctaagcatgctacctggaaagaggcttaaaatgccataatttagtataagccttatccgtatgcatccatcccaagtgtggcttggatatgaattccttgcagtttcaatatcagcagagaagtaatcaaatgaccgaagtgttcaaaacaggaaaagaaatctttcttgttggcacagaatagaatagtttataatgtgcagcacgatgtgtttaagagaagctctatagcatgcttctcaggcatctgaatacaaagtaagattagattcagtacttaaatgttgctttagtgaatagaagacatataaattgactcctctaattattagcttataaattgatagtaaaatacagaatttaaaacatcttcttttaggcaatgtaaataagcatgagataatagccagcacaactacagaggatattcattcagtcatttgttcattttctttattcacctctcaatgttatttccttgcttatgaatacaatgaacaaaaagtaaatattattccagtcctttccactctgcacatttaggaactttcttttggactgggactttagctgtcatttatagagctttgattgtcttggcctaatgcacatgccctatcctgccattgtgcatcatgggcagctaactgggtagccacctggaacaccgggttgtctctcacaaagcctcaggtctgcctcaggcatttcctgatgagaaacagttctctgacttctaagttatctaatctggggatcactcaaggggttatggggttggagggttgctgccccagcagaagttgtgtgaatgggtatgcatgtcggcggggaggggcaggcaagaaagacttccctttccccaggaagccgagaaagttgtggggtcagtaactaacttgaagtctgcccaggtatgtgtttgagatgccaaacattcacaaaaatctgctgtgaagttcctctgctatgaaaagtcccagccacggggtaacttcccagccacagaaaggaccctggcctccgttcttggggttctgcaaaactggctgggctgtttgtgttgacctgaggcaatggctctgcctgtggggtcaagagagagacatttaagctctggttattcgcctggcagcttccacattttgaaagattgttgtccgtaaaatgcctgagtttcagaggggtatgcggggccgtgtgtgaactgggggttggtaggttggcattttacagatggaccatatgggataaagtagtttgaagtgtcttccttgctccttcacactctgtatatgtaatgagtacatatatatgtatgtgtgtgtgttatgagagagaacacacacacatttgaccacttcaatcttagactttcaatgctgcttgcagataccacaacagaactctgccattgataatgtgcccgtgtgtacactctcgcatgacttagggtggttttaagagatgctaacatatgtatgacatttagtttctctgaaggaaagtaactactaaatgatctacatggaactttagagaaattctgagacattcagtgagatgtaatgctcactatcacagagatagtcaaggagattcacttgaagggaaatgacacatgaactaatgtatgtttaaacaccctaacaagagttttgcaatagttaagtgcccagtaaatgttagctacagtatgattggtaaaatatggtgtttagaagaactacaagtatcatgatggactctaataagagtccatgttcacagggtggccacaattagagaatcttatactctgtgtgtgtgtgtgcatgtgcctatgtgacgcttttctgagcctgttaggtttgatttatgtcccccaaaattcatgtctctaagtcctaacctccaggactgcagaatgtgaccttacttggaaata

SEQ ID NO: 15259 - DNA, 10807 bp, Human
  misc_feature (1)...(10807): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaggcctcaccttaatcaagtgatccaagtgaacatcatcaataatggggcaaatcaaaactgcaaaaactgaatgccacctgaaaggatgcagtgagaacatcacttctgtggtattcctaccaaagatgcataacttaatggaatcgagagaacaccagaaaaaccttaggtacattctataacataactagtctgtggtcttcaaaagtggcaaggtcataaaaagtccagaaagaaacaactgaggaaataatccagattcaaagagacttaaaaaacatgacaaccaaatacaatatgattctgaattagatgcttttgttatgaaggtcttattgggacaatcgatgaaattgagtggaatctgatgactaggtggtagtaatgtatcagtgttaatttcctaatttggataattgttttgaggttttatgcaggagaatgtctttataggaattacacactgatgtaatcagggccattgggtatcatgttggctatttactctcaaaacagttctgaaaaataaaagatctttgtacagtacttttatattttttaaaagattgagtttatttcaatgtttttttaaaaagtggaaaaacctctgtcattttggaagttatattttggtgagaagagacaaataagtaaaatatgtagtatataaaattattatagacttgagccctgaggcactctcacatttagaaattaaatagcagagaaagagtgagcaagaaggactgagaaagaacagtcagtgaggtaggatgtaaataaggaaaagccaagggattaaaaaactgctaaaagtatgaagcggttcactttgtcaaatgctgctgagatgaacaagatgatcactggaattagcactgaggaatcatgggagaaatcctggaggagcagtttcagctgggtgaggatagaagccagattagagagggttgaaaagacactgggaggtgaggtcatggagttggtaagtacagacatacttccccagaagtcttgctgtaaagggagcagagaatggagttgcagtnnnnnnnnnnnnnnnnnnnnttgcagttggaggattatgtagggtcagtggagtatttgttgtaagatggaaggttactagggcagactgtagaatgatggaggtgatccagctaaaagggacaaactagggatgcaggaaacagcctgacttggagtagtgagagggatgggagggaaactgcatgtggagtcagtgctgttggcaggagcagaggctcttcatcctgataataggagggaaggaaggaaggatgggcctgtgggaaggtatgactgctgctttgggatgtagaagggaaagcttggtatgaagttgcttttgttttagaagtgtaatatgaggccaggttatctgctgagagcagaggagggtggaggataagggggcagaggaggaggctgaatgtgtgtcttgaggctttgaagagagaagaggaaaagtaaaatagtaacagtcattttggagactagggacataaaaatggaaggattgtagagaagtaactaaaatggtcaggcagacttgagggctcatttgagatttatggttatgaatttaaagtgagacctgtcagcatgcttgtgaatttttctccagcaatatctgactatttaagtgaggtaagtgacgatataagagatattaagagcaccaaatcatattttttcaaatatctgtattcttttcttcagagacactataggagtctaaataaaaacagacaaggcatgtgttgcaaagcctttaattagaatgtttgtattttttacatcatgcataacttcacatttgtgattaattagtaattatttcaatacttgtaagctcatctgcctcagatttaatcataatacatgaattaaattaatcaaattaaggaacagcaatttagaaagaaacacactttaaaaaatcaaaattctcaattcaggcagtctgtttctatcatttggtattctactcctttaaaaatttcatattgcccaacaaaaagtggttatttttactgtttttggagatgactgaacagatgaaggcatcagatgccttcatcagctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggccgaggtgggtggatcacaaggtcaggagatcgagaccatcctggctaacacggtgaaaccctgtctctactaaaaatacaaaaaattagccgggcgtggtggcgggcgcccgtaatcccagctactcgggaggctgaggcaggagaatggcgtgaacccgggaggtggaggttgcagtgagccgagattgcgccactgcactccagcctgggcgacagagcgagactgtctcaaaaaaaaaaaaaaaaaaaaaaaagaacggaatgtactggagatgtatttgataaccaaggttttaggtaaattttcaccagtattagttctatttgcaaactgaaaaatgttgtaggcttaatataaaataaccacattagtgaacattatatctcttagaagaaaggccatattttgctcctgcttctgtaaaaatattatttgtttgaaggggaaataatggtagtgtgacctttcacttaattcctactcccttaatgtgagagagacaaaatgagctgaagaaggaaaattctggagttacactccacaaccttgaacatactgacggacatctctgttttgacaacgatttctccatgccaccctgtagaaaaagatgaagcaaatggtgaaaggttaaaacatatcttcattgtaatatacatacttcgcactccttggggaaacaaaatattttatcaatagataaaatagtaagatagacccagctattgctatttattaaatgaagatatgtatacaaaatacttcactcctacccaaatttctcagtagagcatagaatgccgaacataaagattgagtaatgtgcgttgtacagcagcaactgcaaagtgaattccacgtttattttttatgtatttatttgagacagagtctcactctgtcgcccaggctgaagtacaatggcgcaatcctctgcaacctccacctcccgggttcaagcaagtctcctgcctcagcctcccgagtggctgggattacaggcacctgccaccacacccagctaattttttgtatttttagtggagatggggttttgccatgttaggcaggctggtctcgaactcctgacctcaggtgatccatctgcctcggtctcccaaagtgctgggattacaggcgtgagccactgtgcccggcccacacttacttattctaaaaagaatttcaagatatgacaaggaactgatagagtgtgaagcatcttaaaactctagaaatcccctaaaataaattgaggagtaaaagagtaagattctggatcagttaaagtagattgtttcttcaaggatgtaggtaatacatcatttagcataagccaaaagctgcaattttgaggtgtcattagcatactttggtctttaaaagtctgctctcattgtatatatcaacagtagagtaagatagttttcccttttaacacttaaaacataccatgctctaatgccttgtggatcacggacaaccctctttgcacaagctacagcatcagcgatgttatcttgcagcaaagctgaaagacaggtggtaaggaataaaaactttaatagatattttattttaaatttaggtttagccagcttttttctgttaggctgtggaaagaatggtaagatattattttctatgagtccatatatgtgtaattgttggggaaaactctcttcattctctcccattcagcatgaaatgaagcatttttttcttcatttaccaaagtcattggaagctctggaagtattaacaaaatgattaaaggtcttctttgcactagacactgtaaaaaaacacctagtgatattttactcagcagttctattattgaaaatttatccaaaagaaataagaaatgcacccaaagatgtatacaaaaagctattcatagcaatttatgagggaaaaatggaaacaacctaagtgctcaatagtaacaattggatcagtaaattatagaatattcatatattaaaattctagtcattcttttaaaatgatgatacagatttgtatttttttctcatctggaaaatggagcaaaagatcattaaaaaccgatttgtatttgctgacatgcaaataattttgtgtgataagaagcaaattgtaaagccgtgtgtataatacaatttaatttttgcaaaagcacacagtatttacatgtttgtatgtgggtttatatgtgtatgatataatttaacattcatacacatgattgatatacattctggaagaatatataccagaatttacccatggttataaacctctgggtagtaagattatgggtgttatttttcttatttgtattttctaatttttatttaatgaccaaatattattatataatataaatttttttaattaactggattttagaaataagattaatgttctttattgggaattttaatatttaacaatttaataatatcaactttgcaagatttctgcaatatttttgacactgaggattccacatggtatttctatttttatgagttcagtaaaatatttgtttcactccaaataaataaatccttaagttaatttgttatttacaataataattctacaggaactgtattttttgaagatgtaaactaaagaatttagaaatggaatatcatcatgttcctaattcacttaaaagtctctcagcagtagccaggtacagtggctaacgcctgtaattccagcacttaaggaggctgaggtgggaagattgcttgaactcaggagttcaagaccagcctgggcaacacagaatttgcctgtactaaaaatttcaaaaatttgccaggcatggtggtgcacacctgtagtcccagctacttgggaggctgtggtgggatgatcacttgaggctgcagtgagctgtgatggtgccactgcactacagcctggggacagggagaccctgtctcaaaataaaacaaaacaaaaccaaacaaaaaactctcagcaaaaaaaaaaaaaaaaaaaaaaaaggcatagaagaagcaactatggcaaaatgttaacaacttttaaagtgcataatgggcatatggctgtttattatactaatgtctctaattttctatacatttagaacatttcataaaaaaaaaagtaaaacaattgaaaaaggaccatacaactaaattatcccaaaacctccccaaagtaagcaggagcaatggcattgttctggacaaagcatcagtaaggccattgacagtaaattaataggtcattccagaaacttctgtatattaaaaaacatcaaccttttatgataccacttctttaatttcttactcagggaattatgaggaaaataataatgactttctggaagttgagatgtagtttttctaggtccctcatgaacctttcaaggctttttcatttgtattgagtctcaattcttgtaagtataaccagattggtcaaatattagcttgtcttaccactgcaggataaatgacaggcattaactgctcctggggttttgccatcattacaccagtagcggctattgatctgaaatatcccataatcagtgcttctgtctccagcattgtagtttgtagctcgtgtgttgtaaccactctcccatttggccaaacacatccctgaaaagaacttatttttagtaataaacagcaacactaagtgacttatactctatagcaaaatcagttctacttagctacttctattttactgatttgttttataagtataaagatttacttataaaatatcttagcactttagtgttaagataagggacttgtaagagaatccttttgtaatgcaaatcatcttgtaacaccaacgaacaatataacatacttttaaaatattaaaatacatgtttcttccattgcttttacccttcccgtgctcccatccctcaggcaacattcagccaagaacagaaaaatcaacagagctgttgagtagattttgtaaattcatagcagatacataggctgatggaaaaatgctttttttaatcagaaaaacataaggattttctgatagaaattttcttataatatctaaaggtgaatttggatatcaagttagaatcttgaaaacaagactattccgtgatttcatcccttcactcattcattcaaaaatagctattgaggggaaatgtctgaattcaatctgaaaactacagagattattacatcgacaactatgtactaaactataaaataacttttcctcatggcacatcttgaattgtgtgggagaaaatgaaagatagttaatcaagtagagtagataaaaataataaaacatttcatgctgagtttctgggatcctatacaaagagtgactgaagggaactaggttcctactgctcttgtgtagggaattcaatatattctttaaaaacatcactgttaaaaatcccatgtcggctgggtgcagtggttcacacctgtaatcctaccactttgggaggctgaggtgggcagatcatttgaggccaggagttcaagaccagcttggccaacatggtgaaaccccatctctactgaaaatacaaaaaattagctgggtgtggtggtacacacctgtagtcacagctactcagaaggctgaagcacgagaatcacttgagcccagaaggcagaggttgcagtgagctgagatcatgccactgcactccagcctgggccacacagtgagactgtctttaaaaataaaataaaataaaataaaaataaaaataaaaatcccacatcacggcaggggacttgaagacaagaaaaatactgcatcactctaggctctcagagcccaagttcaaaatgggaaataactggagtcacataccaaggacttgagagagctctgccaggtcctcaaatgtatctttcagtcagcttacatgtgccattgaatctcaggcacccagcaaacttcctagcactagaacagtacaacaggtcctgttttacttagaatggaattttcccctgccatgcccgtattcctttatcgggtatctctggttataaagaaccaaactgatgtttttagccattgtaagtatacaaacccacaaagaaataaaacatctattcactcaaagccccttcttcttcttccttctctcctagtgtctgttccatacgtagctaattctctggaattatggagagtagacttacagtttgctaggctgattcccctgtagccatccattcccaatcttttcagagttctggccaactcacacctttcaaagaccttgccctggaccgtaacagaaaggaggacaagccccagaacaatgagagccttcatgttgactgctaggtcagagtgctaggctgaccagggtgagctggccccagtatttaacatcttttaacttccttcttccccttgtggtttgggggctccaccctttcagttgtgtggaaaacaggaactgtctattgatccactgactctaaagagatttttttaatgcttgaagagagatatgctgatgtcctaagaattagtctacaggaaaataatgaaatggaattgtttaaagtactggctctggaagaattggggcatagcactacttccaagacaggaactttcttctgtttgattatgaatttgagcaattataaagaaaaaaatgactattttgtgcagcttaaaatgagctgtgatttttgagtaacattcaattttgtgaaattgttttgtatgcattcacttttttatatttatcttttttacttaaaattattttacatatcttttccacaaaatggacatgacacatgtgcctgttgtcttaatgggtgtatagtgtgacaccacgttgctcagctagtttcttactctagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15260 - DNA, 18893 bp, Human
tgggtaaatttaagtgaatattaccacagaaaacagtaataataatgttgtatagggcttaaaatgtctggaagattaaaatgcctgacaaaaggctagaaggagacaaatagagttaaggtattctaagatctcagcattgttttggaaggcataaaagtatcactattacactctaataaatcaaggatgcatgttgtaatctctaggtgaactactaaaagagacataagtccaatgtgtgaatttattacaggtctatctttctcatggtgctatttcttagtatgcttagaaatttttgctggaatgctagagattgtgtatgaaaaaagccaaaaggggagaaagtgaataatacttgattaattcaaaagaagcaaggaggccaggcacaatggctgatgcttgtaatcccagcactttgggaggccaaggtgagtcaatcacctgaggtcaggagttcgagaccagcctggccaacatggtgaaaccccatctctaccaaaaatacaaaaatgagctgggtgtggtagcatgtgcctgtaatcccagctactcgggaggctgaggcaggagaactgctttaacccaggaggcagaggttgcagtgagccaagatcatgccatgcactccagcctgggtaacaaagtgagaccctgtccccgcccccccaaaaagaaaagttagaaaaagaccagcaatttaaaccccaaaatgtggacagaaggaaataacagagtagaaattaatgtcatatacaacaaatacaatatagaaaatcatcaaagaaaaaatggattatttacaatactaaaagttgataaaccaatagcaatagtgaacataatacaaattattaacatcagacttgaaaaggaggacatcactacaaaccctatagacactaaacggtaagaagatatgaaaaattttttgtgattaaatttgaaaatgtatattaaatagacaaattcctagaaaaacataacttatgaaaactgataatagaagaaatagaaaatttgaatattgaagcatgcttcttattcatttacaacagacatgtttagctaggtcaaagaaacagagtttggctccatgactgccctgaaataatttcttctctctgtagtcatagagttacacagtgaaaaaccagaaaagagtctgatcctgcaggttactgatacacaagataagttgaattcactgcttcagcaggtttcttaaataacaattagattattttggaagaaagaatgcaaacccaaaaagtagaatggtgatatctgagaacattacaatgaccaagtacccaaaacccaaagatctgccaacagaagtagctcctcccctatctaatgagaatggttctgattttcttgaatatcttgtaatgaccacacctcaggtagttatcttctaaaatagtccccattctcttcatttaccactcctaccacctcttatttcttctgacctatgacaaggtgaaacaccaaattctctataattccaaagtcaaaccttggaaaagaaagtttacatattaacagaattgtaagaatttcctaatgtattggcaaaatcttaaggaatatgtgtcagcaagattctgaggattctagaccagggaaggagaaacacagtttaaactgtgtttattgatatggataacatttaattgcaggtgatcatgggtgataatctaacccatgtcccagccatgcatgccaggtacaattctgtctcccctcctctaacagtaactagatcctcactgccttgaaaccagccaggtcagataagtagttcaagatgtcatttccttaaggatctgttgtctgtactattttcagacaactcctctagctagtttaagcaaaaagaattttttgagcaatatagatcactcatggaatcactcactgaaaaggctgacaaaatggagtctaagctgagttctaggaatgactcctaatcccataccacagacatgaactcacaaggtgcatctgctgcttctatggtcaacaagtcacctaccacatcagaaagcctccatccaccatcaccaccagctctaaaaccacaccacactggtaatatccaagcctgcacagtagatacctcaggccctgcttctctccctgcgtaattcagttctgaatctaagtctcacatgagtgcatctaattagaggaattttagttttgcttggaatctcagctctgaagggatctggaaaacagtttttggctttccagaatctacagtaaggaaagcatgataaaggggattgacatctacagcatgccccttgtataattcacgttaatatatagctagggatagataataaatgatcagacaacaggctttttaacaatatgtcttggagatattcctgtgttagtacatatggtttaacctcatcctttttaatgacagcattgtattgcttagtatgggtgtgccatgatttctccaacatttcctttctggaaaacacttagattttttccatcttcacttaaaaatactggtgtatttttctatcctcaccacacatccataagaaaggactaggatcctgtacataattttttttacatatgtatgagcatttccataagatttctaaaagtgaaattactgaatcaaagggtatataattcctaaatttgtttggacattgccgaattacctttgaaaatagtttttgccaattaatacttccaactaaaaaatttcctctcttcccctaagcggcctggggtgatctgtgaaaatggttctctagtcacttgacccaggaaaccccacaaaatcatgcaaatcaagaggttcaaatcttcatgttcactaagaacactcgtgaaactggccaggccatcaagggtatgcatatatgaaaagccaccaaccctaaagatgtcactttacagaagcagtgtgttccattccgaggttacagtggtggacttggtaggtgtgcccctgccaagtagtggggctggacacagggttggtggcccccaaaacagtgctgaacttttgctgcacatgcttaaaaatacagagaggaatgctgagcttaacagcttagatgtagattctctggtcactgagtatatccaagtgaacaaagcacctaagatgcaccacaggacttactagagctcatggtcagattaagccatacatgagctctttgagatgattctcactgaaaaggaacaaatccaaaaccagaaaaggaggcttcctggaagcaaaagatatcccagaagaaagtgaagaaacaaaaacttatggcatgggaataaatttagcgaaaaagaaagtaattaaaactttttttttttttaaagcgtttcctttcccttaaacctaggttaggacttctaaatctttgcggctttatggccaaaaacaatacaattgcactttcttattactcatgaggtggagtatgttttcatgttctattgtctattgtatttcttttttctttgatggcttgcctgtttatatcttttgctgttttgtgcttttaaaaattaatctgtaggtgtttttttctattctgcttgttagtcatgtttttctccagtatatcactggggtcttaattttggtcataaatttaggtcttgtttaggaaagccttccccaccccagcatttaaaaaataattggtgaattttttacatttatctctttaaattcatctggaatttacttgtgtgtagtctgaggtaaaaatataatgttttaccaaacggatagcaaattgttccaatactgttaattgaatagtccattctttctctactggttgaaatgccaactttatattatatacaatatatttatatctatataccttattctggactttccattctgtactagtgagttatttcctatgccaataacaattattattttttattttactttaagttctgggatacatgtgccgaatgtgcaggtttgttacataggtaaacatgtgccatggtggtttgctgcaccaattaacccgtcatctaggttttaagccccgcatgcattcggtatttctaacaattattttaattactatagccttaatattttggttcccaacaggacaagttcccctcatagttcatcattccccaaaaaattcctggctattctcttatgctttctttttcaaatgaatttgaagttgtcaagctccataaaaatccttttaagatattgaatggcatgttattgaatttatagttataaaagaataatttaataattgtatactatggaatctttccatttaggttcatgggtcacctttccacttattgttcttttacatcttttttttttttttttttttttttttttggagatggagtctcgctctgtcacccaggatggagtgcagtggagtgatcttggctcactgagacctccacacctccttggttcaagcaattcccctgcctcagcctcccgagtagctaggattacaggcacatgacaccacgcacagctaatttttttgtatttttagtagagaaggggtttcaccatgttggccagagtggtctcaaactcctgacctcaggcaatctgccagcctccgcctcccaaagagacaggatctcaactctggagcccaggctgaagtacagtggtgcaatcatagctcaatgcagccttaaattcctggctcatgcaatccttcacctcagcctctggagtagctaggactacaggtgcgcaccaccacacccagctaatgtttaaagtttttgttgaaacaaggtcttactatgttaaccagactggtctcgaattcctcaagcaattctcctgcctcagtttcccaaagtgttgggattacaggtatgaaccacagcacccattctatctttcaaatgaagtttattctcttttcatatagactttgctagttgttggatttattcctaggtttatatgattttaatactaaggtggataggacacttttctcatattttgcagtttgttatgcctaatatacagaagagctatgaaaatgtgtatgctctctttgtactgggcaccttgttaaactctcagttcttacagtttttcagttaattttcttgataattgtcttcaaaaagggaaagtttatctgtcttatttccttgactaggatctttggtacaatgtggaatacagttgtggagaggacaacattgtcatgtccctttaatggaactatatatgtctaatagtttaccactttgtggattgttcactggtggttttggttttttgtgtatttttgtttgtctttttttgagatggaatctcgttctattgccaggctggagtgcagtggcgcgatctcggctcactgcaacttctgcctcccgggttcaagcaattctcctgcctcagcggcctgagtagctgggactacagatgtacaccaccatgcccagctaatttttgtatttttagtagagacagggtttcaccatgttggccaggatggtcttgatctcttgacctcgtgatccacccaccttggcctcccaaaatgctgggattataggcatgagcagccgcatccagccagttcactggttttttaaaaatttatttgttttaatttgcctttttatttttttgagacggagtctcgctctgttgccaggctgtgacatttctgataaacttttaacattcaaattatcatgcttttccttttatatggaaaactttactcctttttctctggctaacttgtattcatcctttaaagttcagtttaaatgtcatttcctgagtaggggggttccaagatggccgaataggaacagctccagtctacagctcccagcatgagcaacacagaaaacgggtgatttctgcatttccaactgagctttgaagagagtggtggttctcccagcaaggagtgagatctgagaacggacagactgcctcctcaagtgggtccctgacccccgagtagcctaactgggaggcatcccccagtaaaagcagactgacacctcacatggccaggtacccctctgagacgaaacttccagaagaacgatcaggcagcaacatttgttgttcagcaatattcgctgttctgcagcctctgctgctgatacccaggcaaacagggtctggagtggacctccagcaatctccaacagacctgcagctgagggtcctgactgttagaaggaaaactaacaaacagaaaggacatccacaccaaaaccccatctgtatgtcaccatgatcaaagaccaaaggtagataaaaccaccaagatggggaaaaaacaaaagtcagaatgcctctcccgctccaaaggaacgcagctcctcgccagcaacagaacaaagctggacagagaatgactttgacgagttgagagaaggcttcagacaatcaaacttctccgagctaaagaaggaagttcgaacccatcgcaaggaagctaaaaacctttaaaaaaagattagacgaatggctaactagaataaccagtgtagagaagtccttaaatgacctgatggagctgaaaaccatggcacaagaagtatgtgacgaatgcacaagcttcagtagccaatttgattaactggaagaaacagtatcagtgattgaagatcaaatgaatgaaatgaagcaagaagagaagtttagagaaaaagagagtaaaaagaaacaaacaaagcctccaagaaatatgggactatgtgaaaagaccaaatctacgtctgactggtgtacctgagagtgacagggagaatggaaccaagttggaaaacactctgcaggatattatcgaggagaacttccccaacctagcaaggcaggccaacattcaaattcaggaaataccgagaatgccacaaagatactccgcgagaagagcaactccaagacacataattgtcagattcaccaaagttgaaatgaagggaaaaatgttaagggcagccagagagaaaggttgggttacccacaaagggaagcccctcagactaacagcggaactcttggcagaaactctataagccagaagagagtaggggccaatattcaacattcttaaagaaaagaattttcaacccagaatttcataaccagccaaactaagcttcataagtgaaggagaaataaaatcctttacagacaagccaatgctgagagattctgtcaccaccaggcctgccctacaagagctcctgaaggaagcatgaaacatggaaaggaactggtaccagccactgcaaaaacatgccaaattgtaaagaccatccctgctaggaagaaactgcatcaactaacgagcaaaataaccagataacatcataatgacatgatcaaattcacacataacaatattaaccttaaatgtaaatgggctaaatgctccaattaaaagacacagaccggcaaattggatagagtcaagacccatcagtgtgctgtattcaggagacccatctcacgtgcagagacacagataggctcaaaataaagggatggaggaagatctaccaagcaaatggaaaacaaaaaaaagacaggggttgcaatcctagtccctgataaaacagactttaaaccaacaaagatcaaaagagacaaagaaggtcattacataatggtaaagggatcaattcaacaagaagagctaactatcataaatatatatgcacccaatacaggagcacccagattcataaagcaagtccttagagacctacaaagagacttagactcccacacaataataatgggagattttaacaccccactgtcaacattagacagatcaatgagacagaaagttaacaaggatagccaggaattgaactcagctctgcaccaagcggacctaacagacatctgcagaactctccaccccaaatcaacagaatatacattcttcgcagcaccacatcacacttattctaaaattgaccacatagttggaagtaaagcactcttcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataatgaaatgaaggcagaaataaagatgttctttgaaaccaatgagaacaaagacacaacataccagaatctctgggacacatttaaagcagtgtatagagggaaatttatagcatttaaagcagtgtgtagagggaaatttatagcactaaatgcccaaaacagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcagaaaatcaatgaatccaggagctggttttttgaaaagatcaacaaaattgatagaccgctagcaagactaataaagaagaaaagagagaagaatcaaatagacgcaataaaaaatgataaaggggatatcaccaccgatcccacagaaatacaaactaccatcagagaatactataaacacgtctatgcaaataaactagaaaatctagaagaaatggataaattcctcgacacatacaccctcccaagactaaaccaggaagaagttgaatctctgaatagaccagtaacaggctctgaaattgaggcaataattaatagcttaccaaccaaaaaaagtccaggaccagacggattcacagccgatttctaccagaggtacaaggaggagctggtaccattcttctgaaactattccaatcaatagaaaaagagggaatcctccctaactcattttatgaggccagcatcatcctgataccaaagcctggcagagacacaacaaaaaaagagaattttagaccaatatccctgaagaacatcgatgcaaaaatcctcaataaaatactggcaaaccgaatccagtagcacatcgaaaagcttatccaccatgatcaagtgggcttcatccctgggatgcaaggctggttcaacatacgcaaatcaataaacgtaatccagcatataaacagaaccaaagacaaaaaccacatgattatctcaatagatgcagaaaaggcctttgacaaaattcaatagcccttcatgctaaaaactctcagtaaattaggtattgatgggacatatctcaaaataataagagctatttatgacaaacccacagacaatatcatactgaatgggcaaaaactggaagcactccctttgaaaactggcacaagacagggatgccctctctcaccactcctattcaacacagtgttggaagttctggccagggcaatcaggcaggagaaagaaataaagggtattcaattaggaaaagaggaagtcaaattgtccctgtttgcagatgacatgattgtatatctagaaaaccccactgtctcagcccagaatctccttaagctgataagcaacttcagcaaagtctcaggatacaaaatcaatgtgcaaaaatcacaagcattcttatacaccaataatagacagagagccaaatcatgagtgaactcccattcacagctgcttcaaagagaataaaatacctaggaatccaacttacaagggatgtgaaggacctcttcaaggagaactacaaaccactgctcaacgaaataaaagaggacacaaacaaatggaagaacattccatgctcaaggataggaagaatcaatatcgtgaacacggcgttactgcccaaggtaatttatagattcaatgccatccccatcaagctaccaatgactttcttcacagaattggaaacaactactttaaagttcctatagaaccaaaaaagagcccacattgccaagtcaatcctaagccaaaagaacaaaggtggaggcatcatgctacctgacttcaaactatactacaaggctacagtaaccaaaacagcatggtactgacaccaaaacagagatatagaccaatggaacagaacagagccctcagaaataataccacacatctacaaccatctgatctttgacaaacctgacaaaaacaagaaatggggaaaggattccctatttaataaatggtgctgggaaaactagctagccatatgtagaaagctgaaactgggtcccttccttacagcttatacaaaaattaattccagatggattaaagacttaaatgttagacataaaaccacaaaaatcctagaataaaacctaggcaataccattcaggacataggcatgggcaaggacttcatgtctaaaacaccaaaagcaatggcaacaaaagccaaaattggcaaatgggatctaattaaactaaagagcttttgcacagcaaaagaaactaccatcagagtgaacaggcaacctacagaatgggaaaaagtttctgcaatctactcatctgacaaagggctaatatccagactctacaatgaactcaaacaaatttacaagaaaaaaacaaacaaccccatcaacaagtgggcaaaggatatgaacagacacttctaaaaagaagacatttatgcagccaacaaacacatgaaaaaatatcatcactggccatcagagaaatgcaaatcaaaaccacaatgagataccatctcacaccagtgagaatggtgatcattaaaacgtcaggaaacaacaggtgctggacaggatgtggagaaataggaacacttttacactgttggtgggactgtaaactagttcaaccattgtggaagacagtgtggtgattcctcaaggatctagaactaaaaataccatttgacccagccatcccattactgggtatatacccaaaggattataaatcatgctgctataaagacacatgcacacgtatgtttattgcagcactattcacaatagcaaagacttggaaccaacccaaatgtccatcaatgatagactagattaagaaaatgtggcacatatacaccatggaatactatgcagccataaaaaagggtgagttcctgtcctttgtagggacatggatgaagatgcaaatcatcattctcagcaaactatcacaaggacagaaaaccaaacactgcatgttctcactcatagatgggaactgaacaatgagaacacttggacacaggaaggggaacatcacacaccagggcctgtcatggggtggggggaggggggagggatagcattagtagatatacctaatgtaaatgacaagttaatgggtgcagcacaccaacatggcacatgtatacatatgtaacaaacctgcacgttgtgcacatgtaccctagaacttaaaagtataatttaaaaaaaaagtgtcatttcctttgagaagcctcccctcatctctgtagcctgcataagatacccctgctgtgttagaatgtaatttgtcttactccttttaaaattttgtaattacttatttagtagtctccctcattagatttttttttttctttttcaaacgcagtctcgttgccttgcccagactggagtgcagtggagtggtcttggctcactggagcctccacttcctgggcttcagcgattctcctgcctcagcctcctgactagctggattacaggcatatgccaccacacctggctaatttttgtatttttagtagagatggggtttcaccatgttggccaagccgatcttgaaatcctggcctcaagaaatccacccgcctcggcctcccaaattgctgggattacaggtgtgagccaccgtgcccaaccccttgttagatttagtatgaagtaataggattttgctttttgtgttacaaaaatctagctaactgggatgccttaccacttgatatattcagaatgtcttttcccagcattcatagcaagcaaccatacatacatagtctcagggcatttctcaagtcttactaatcaatttaaaaaacttgattattatcaaccaccaaaatgagagtactgagccacccaagctagatgacttttccgtaatcatgctaataactctatgccacagaatacagtagaaaaagcatcgaatgcagagctaggaggccttactttccaatctcacacttcagtaactgcattaacttctgggacattctgtggcctcggtaaaacaaagatattaaaacctaccctacaaggttgttattgtgaagttaaagcacttaacttataataaacttacttaagttactcgagttctcttcctttctttcgaatggttacttctcagcttaaaatcaaatttcctggtcacaagccattgcttttccttaaatacacacttctccagcccttaaagtctaacgtgttcctttcccaaagaaacaaacaatgctggatgaatagaccatcctgcttttctcttgctatgaaacatactatttgcacactggcacggtgggaattttagatgcaacgtagcctggctccctttctttttgctacagcacatctgggtcaggcatcttgaataagtcccttaacagaatattatgtcatctcacatgcttttgaataattcacttgtcataactgagtggtagttggctctaatcaactaagagcaatgacccacaaaggtgttctatgcttataaaaaacagattccacaaccccagtgcaaatatgcaactaagtgtaagcagcagtgtgatgcatcctgaaatgaggtgtgtcagaacaacagcagcgtctaaataatgtttcacgtagattaacatggaagagagccctggaagagaaatacaggcatttttaaaaagtgctcccaggcagccaatcagtgaatatgaaatgcaacaaactggttttttttttttgttttttttgagatagagccttgctttgttgcccaggctggagtgcagtgtcacaatcttggctcattgcaacctccgcctgctgggttcaagtgattctcctgcctcagcctcctgagtagctggaatttacaggctcccaccaccatgcccagctaatttttgtatttttagtagagacagggtttcaccatgttggccaggctggtctggaactcctgacttcaagtgatccacctgcctcccaaagtgctgggattacaggtgtgaaaagtgtaatttttctgaacttcattttcaacatctagacaactgagggtaaagcctacttttataatgccctatgaggagtaaaactataaattaaaatgtactaccactagaaagcatatttgcaagcaaatgtgtcacaaggtcctaggcagtgctagctaagaggggccagaagttgtgtctattaaccaattaacagatcattcaagaagtaaaatttcccaaagtaagtgactttcaccttaggtgatttttctttcccaaatctggccctaaactgatcttgatgcttgcccaaccccaaagcccatgcccagcctgagcctcagcaagtatgtagcagcacaagatgtgctgcagggtgaggaggcaggtgctgggggcagaaaacacaaagaacaaagcatgctttccatgtgctccctaacttgtggatataaatatgcattgtctaaatggaatagtttagagtttatgtgatttcctttaaagacttgtagcctgggccaggcacggtggcgcatgcctgtaatcccagcactttggaaagcggaggcaggcagatcacctgtatccaaaggcaggagcagagccctagttatttttctgttccccctacaatgccttaaagtgtaccagcacttaataaatggtttttgaaaagaccactctccttgtctgaggactacacaggcctgagtgcctaatgatcctcagtgtgcatatgcaagaaaagctaaggagcaaaaaagctgttaaggagtggtttcacccctttcagtagtagggaaatttgctggcggcaatatacaccactagaaatggtgcctgcctttatattgctcatgctaatctgtaaagctggggttaaactgaagtcactatactggaagctgctcccctttaagcaatcattatcaagaacgtatatctggttagactgtttagtttgccagggctgccacaacaaattgccatggaccgggaagactaaacagaaatgtattgtttcccagttctggaggctggaagtctgagatcaaagcaatggcaggactgttcagagggctgtgagggaaggacctgttccaggcctctttccttgggcttggaaatgtcttctccctgttttcacatcatcttccctctgtataaggctttgtccaaattttctttttctaagaacaccagtcatattgggttaggtcctaacttaaggacttcattttaacttaattccttctttaaaaaccgtatctccaactacaatcacattttgagattactggaggttaggacttcaccatatgaatctggtggtgttggcagggggcggtgtgttcacctgtaacagaccataatcacttgtgtatatggagatatgtcattccttagtgtgtgcctccaagtttggtgatcagatcatcaagtttacatacttgatgaggtgctgacagcctctggcatgtttatgcttcttgagacacaggtaaaggagtgtttactagaaagcggggacacaggtcaagcgtgaaaaggctgacgaagactctacttcctgttacctctttgccctctgagaatctcagcacaacaaaaatgccaggattatgagccactgacctttttgagaaggaaatgccaagcatacagtgagctgcaagaatactctgaactagtttataggctttggccttgaaaactcaaattattccagttttatttatattactaaaatctagagcttcttggatattctatatgtcaattttttttagtgtagaaacctatgttaaaatgaaaaatgtagactaatgggaaactaaagaatatcagctactgtttatgttgagcactgtgggagccactgacacgtatgaacttaacatctaaacagtataatgaagcggcgctcttaatactctccatttacagttaagggaagaggcatagagagcttacataacttggccaaggttacaaaccttcatcacacagcaaagcccacactagagaacattctgcagggctccagagcctacatacacatcctgcctctcaccgtgaccatttactcaacagcagcaaggccacccaaaatgggcagaaaaggctgaaaacattcatgtcaaagggcacttacttatttattcatcttgtgaaaatgacttagaatttaaaattaagaggtaaaaaaatggagagacagttgtaaatactaagcactaacagctacaacttcactaaaaaggtttccaagcttcctctgctgtttgtgttcctctgacactaggcgtaactatcttgggcatcatttcagtcttgggaatgaaggaagtgaacccagtgtgtgctactgagataaaggaagaaagggagcttagagtcccagtaccagtggtttcctgggtatgggggaaccagccagctggatgcctttggcaaaatgctgagtttgaagctgccctaggaaccagagctgccctgagggaggcgtcacgacccagtgtcagcagccaaccctaaccatccgcaacacatcccccaaccctccactgcagacctgccacatttctccaaggaggtaacagagtaaaggcataccttaggcaggaacagggcagaagagggttggaagcacaggaagcagtttgtcttaagtactaacagcagaaacaataagaatatgatctcaaaagctaaaatactctagaaatgctctcttcttctaacctcagaaagattcaaattgtacttgactttccctagaagactcactcatctccttcctccatgaaatgagactaccagaggaatcctgtattttaaaaaagtttaattttaatccttcctagaggaatacagatttgaatgaaatacattcattccataaatacattagcagcaaaaccttcccaccagagtcctctactccagcccagaggttgtgccttgagcaggagagcatgttccatcaatcctgtcaacttaagggtgggtctgcttctgagaaacgctggatgtgcacgggagacacaatgaccaggtgcatgggtgacttaactaagctgggaccctgaaaacaggcccatgtggtcactattcagccttctttaccttccaaaaatcctttggcatcttccatgcttctctgatgaggttcctcagcactgagacaactgggaagacctaactttgcacatgcattaaataatgttattttgagttggcaatgttttaacacttttcataaggtaaatgaaacataaaagattattcccttccttcccttcctcaggtgagtccacatgtactcatcaggagacaatccagcaggcatttgggctctctgtatctccaggccccctttgtctgaatggctggatgtttactggagacagggagccatgtctaaacctacaaagatctccacgttacaataaccaggtgacttgctcaggcttccatcaaagctaatttcttgggcagaggccaggcatctctcctcttgttctctccatcactgactactgactgactgctgcttttttatttgccctccaggcacctgccgaaactttggaaaacaagatctaccctaaacttccaagtggccaggagcagttaaggcaggtcctgctttaaacttactagctgccaagtagcacacttatgctgctgtgtcccaatccattctgtggtgagtataagtcacaagagtctgcataaaacactatcagcaatcaggatggctatggggcaaggaccgtttagaatgttaccaagtcacaggaccagcaggaaaatggaataatggaagaatgtgaaataaatctgatttgtttgagcagaaggcagctttgattcaggcataaatgcatctcccagattatcatgtaaataaagacctcagaagttgacacttccctcccagtccaccacttaaaacaggacacatgctcagttttcccaatctgttttaaagtgttttcattaggatactcttctgtaagtgctttattcattcccagtctgttttgattactggctgaaaataaatcaggaaccattttatataaaaaccattatagtagataactggttatgtgtatttttccatttgcattttcatccaaaattgcttgtttcttttccttttatttatgtgcagaaagagactcatccgctgaatacacagcactgttaatcctacagtcttctgtccccacagagtctgctagatcttcctcttctgagtcatcctcttcttcctcctctggtgctgacgaactggaggtgggccctttgcaggttttcaggtggcgggtgagatggtatttggttagataagcctttgtacatttttcacagacataatcccgttttccttcatgagaattgagatgcttctttaagtgatttgttctcaagaacagcttatcacacttgggacacttgatctggcgttctctaagaggaacacaagaaaaaacatttgatttggggttacaaataacaactgaggcaacacttattcttcatagccgcaggcctttgtcagagcagctctatccttctgaatcaggcttttgcataggtgatatacagaagactcataaaacatgtatagtttaaaacagtgtaggctcatttttcctgttttagaatactatgtaaattctcaaattctatgtaaattctatatgtatttcttttgtcttgctgcattctctcagtatgatgctcataaaattcattcaagctgctgtatcagttgtttgttcccttccactgctgtatactatttacaaatatacaaatacaccacaacttatctatggtactggatttgtctctagctaatgaatgttttggtggtttccagttttttattatcacaagcaaaagtgctagaacgtttttaaatttttttaaatttttattattattttttagagacagggtcccaccatgttgcccagactggagtgcaatggctattcacaggtgtgatcatcatgcactacagccttgaactcctgggctcaagtgatctgtccgcctcagcctcccaagtacctgggactacaggtgcatgccactgtacctggcatttgaacatttttatacttgtatggtgctctgcaatacatgtttctctagggcacatacccaagaactatatagctaaatcaaaggatatgcacatcttcaactttacaagataatgacaaacggttttccaatgtagttgtttcaatatacacatccatcattgacggttctggttgtcccatattctcaactggaagactcaaatttgaaaatgtctgccaattagccagtacataatggtatctcattacaccgttatttgtattccctggatgccacttttatggaattaccatttttctgtccttttcttagactagtggttctcaagtaggggcgactgcctctatggggacatttggcaatgtctggagtcctttctgattgttatactggggaggggtggtataattagtatctagtaggaaaaggccaaggatgctgctaaccattctacaatgcacagggcagccccacaacaaaaaattaacccggtcaaaatgtcaataatgtcaaggtttgagtaaccct

SEQ ID NO: 15261 - DNA, 4200 bp, Human
aaccaccaccactgacattaaaacgattcgagactactcaagtaccagataatcccaaaccccattttatagctatcatttattgggcatggactgtattacttgtgttatacatttattattgtcaatctccacaacaatcctgcaagaaaggcactatttcacatttaaaaaattatgctcagagaatgatttgcctgaagtcatggaactaataagtggcggagcttacatttgaactcagaacatttgtactcctctgtgaggacaccagccagtttcatggcctagtgacaatacaccttcctgagggaaaaacatgcaaaaggtagaaatattatatttaggctgggcgcagtggctcatgcctgttaccacagcactttggtaggccaaagccggaggactgcttggacccaggagttcaggaccagcctgggcaatgtaactaggccttgtctccacaaaaataaaaattaataaaatttaaaaataaaaaaattagccaggcacgtggtgtgtacctatggtcccagctactcagaaggctgaggtgggaggatcacttgaactggggaggtcatggctgcagtgagccatgatcgtgccacctacacttcagcccaggcctgttccataaaataaaaaatactgcatttaactttctttgttgtcactgatagaaaaacttgagcaataactgctatgatacataaattgcacatatctagaaaaaaatttcagacttaaaaagccatgatagaattaaaaaaaaaaaaaaagccatggtagaattttaagtcgtatttgagtgatctggggagcccaagttttccatttacctacaaggaggccttacccgacagaacaacacccagatagaatgactgagcatccaatccaagaatcagaatcagtaaacaagagtgtcactggctttatgagttctgttcaaacagtatattagctaaagctgcctcccaccccaaattccttttctaatcataaaatgtaagtcttggcagttaccagaaaaggctattttgtaaaaatggctttcactgtgaaattaaccaattccacagatgatagcagggtcagaaaaatagtgccagagttccagaagctgtagaattaatttgatactttcaacacaggattagttaaccaaaggccaggtgtggataacaggaaacaggttgtcttagactctacactctaacacgactcttggaaaagtcaacattggcatgactcagtttacacttatgcaaaaatactaatatctacctcacagtggtaatgagagacataattagggtctgcaagcatttttcaggtcacaagattaaaggctgtttctgagggtactgcatgcatttcctgtagatatgagtacactgcattcttaaatatatactaaaaagcgacctcccagcacatataactaattttctttggcaagattttcttcagaagtacacaggcaacgatatttgtaaacaaatcctttagcagggaactaatcaactcttccgatggctctagcttccacttccgaggcccgctgtgatggtaaccaaccaggttccatctggcttaccaatgctgacgttcccaacttcctagctgtcagatcgataggaacctgaaactaactgtttcccgttcctttgaaaaggagaaattacggaccctcgggttgtttgggccgtagatgaaaaaaacaagcggggggggggggcgcgggggaggagaggagggagggtgggaagaagagaaaataaagggagattgaaatattgggaaaagatacgagggcaaggactggggacacagtagcccaccaggacccacatagggtgatatctacataagactccagggcaataacgtcaacagctcggtaacccctgcgacaccctgacagtcctgccgtctggaagtgcctttgtcccggcccgtcggccagtcccgccgcttctctcccatacccctaggcgctcagccctacgaggctgcccggaggccgcctaaaagccggcggcgctcgcgcccgcccctcagctcgccgggctcggcgggacatactaaccggctggtagacgccatcttcacggcgactgcggtgcccgcaacaagacacaacagacacaccgaaagcaggaagcgaatgtggcgaagagacgcgcagagatgagtttttatagacgactcacccacgcagtcgtagcagagcagggctacgggtcgggagaagggccaagaacagtgagatcccatacgtcacgtgctttgcgatttcttacgttcttactccgtttctgtaatttgctatgttgctaagcgagtcaacgtaactacctaggaaaagtctcatgggaaccctgcaaaggggctacaacagagctactctcaatctgacagttaaaacacaaagaaaaccctggcttcgtagtggtgccaaagcctgcatccctaatagtttaaccaccccttcctctcccaccttctcacggctaccttctcacggccaccacctaccccgcccccagccccccaccccgcgtcaggcactcccatttgagccagttcttacgtgccccaagggtgattctttctaagaaatttgaaataaaaggagaaactcacttaggtcatccagaacaggtgtctgttcaggatctgtcatcagctagcatgttgtcttcttaggcacgtcctttatacaggtcatgtaagtttatataggttatggtatcttgccttgcatacccttttagaattggcagaagatgaaacaaaactacgtgaaaccaatgtgtacacaagaggcacgacgatatgggccatgctctgatcatttttttttcacggcctttgtaacgttggctgatagctacatatagaaaacttgcgagaacatctagatattgcaaaatatccctagatttattaattagccaaactaacgtcaaaattgtaataccactattactaacaacaataacagttaccggtggagagtattcacgttcttggcgttttgaacaaagaactggacacaacgcacaaactaaggaaagaatgaaggaataaaggcagagatttattgaaaacgaaaaggtaataccagctcaagagtccttttgcagaattttcgggggtttaaataccctctagaggtttcccattggttacatggtgtacaccctatgtaaatgaagtagtggctccacaatcagtctgattggttgtggaaagcaaccaatcagaggctaaagtgaagttacaaagttacactcctatgcaagcgtctgattggttgcagaaagcaacgaatcagagatactttcaatttcacatctgccacacggctaaagtgtgtgtgtgtgtgtgtgtgtgtgtgtgtgtgtggttgtgtagtggggagggggttgcaaagggagtaacgtctggttcttttgttacttaggtgtggaaagttggggttttccttttttttttttttttttgagacggagtcttgctctgtcgcccaggctggagtgcagtggcgcgatctgggctcactgcaagctccgcctgccaggttcacgccattctcctgcctcagcctcccgagtagctgggactacaggagcctgccaccacgcccggctaattttgtttttgtatttttagtagagacggggtttcaccctgttagccaggatggtcttgatctcctgacctcgtcatccgcccgccttggcctcccaaagtgctgggattacaggcgtgagccaccgcgcccggccggggttttccatttgatttagttctaggaaatcagtgtgaatctgccttaggttccctgccttcagacagtattctcctgcggcaacactttgctgacaactattcttgaaaatacggggattggtattttcatggtggttttcatggggctgagaacttagaagataatgactgcttccttcatctggggatgggatttaaatgtaatggagcactcactgttttcttgagaaggtgggagatactagcttccttagaaagaaaaaggggtgcgagaggcaggattttaggaactcaaatctaggtgggaaccggggagcatgatttcttttttctttcccaatcccaatcttctattttgtaattctgtaattttaaaaacttgactgtactcttgtg

SEQ ID NO: 15262 - DNA, 87629 bp, Human
tgatgagtatgtgaggtgatggatatactatttagcctgatttaataatttcacaatgtatacataagcagaacatcacattgtacgtggtaaatagatactatttttgtcaaatataacttaataaagctggagaaaaaaaataaaattctccacttcaaaaaagccttaaaggggccgggtgcagtggctcacgcctgtaatcccagcactttggaaggctgaggcaggcggatcacctgaggtcaggagttcgagaccagcctggccaaaatggtgaaaccccgtctctactaaaacaacaacaacaacaacaaaaatacctgggcgtggtggtgggcacctgtaatcccagctacttgtgagactgaggcgggataatcgcttaaacctgggaggcggaggctgcattgagccgagattgcgtcattgcacttcagcctgggagacagagcgagattccatctaaaaaataaaaaataaaaataaatcttgaagaaaaaaaaaacaatcatttgctatgcctccagtatccaaattaagctcattttgatatttgatgttcgatatatttgtactaagagtacctaatgtataaaaatctttctaagcaactatcaacttggaatcatgattgatgtgctgtctatacatattttttctaacatgagaaagtgagaacgcagtcccccactaaattatgcagtcgagtttcccacatttggggaaatcacagaagtcagcacatctggagtgaaataaacaagcttcgccctgattacaggtttggcatattcatgtttaacaaacgcaccggaactaattaaagcaaatttggactcctactctattattaaaataactaattcctaaactcatacattattctttcttttaaagatcactgatgttaatgttcagctaatattttcttttaaaaaattaatgaaatgctttggaatgttctccagttatacaaacaaaaacagacacattctggagaatcaataaaatatttgaagtattttttaagactgtacagctggagctccaggtttaaattagagctctgccatttactagatatggttggtcaagaaaattaaccttgtatttcatcgtccataaaatgggaataaaataataagatctacactaatagatttgatgaaagaatttaatgagataatctatgcgaagttcttagtctggcacctggcacatgaataagtgcatcacataatgatgttagctattattattgtggttgcattatctttccgttcaaaaaagtacaactttcaaagccttgctgtgttggcgacctgtagtttaataatctatcgcttctctttcaatcttaatttctaaagacacagtaacaaaccattccaaatgaagcgtctccccttgcaatacttaaccttgagtcaacaattcttgtaattattaaatattcattcactaaagtaattgtttttttaaaaaaatagaggtgataggacaatggcctaactacagatcgcaattaaactttatttctctaaggcaggcagggtgaattctttgctccgaacctcccggactcctctccctctccgactttgtataacagagggagctccgagccctctctggcgcgcgaggtatttcgtctgtccccgggggtgccaggtgagccccagcggatccgggagggtaagctgggactcctcgcgagcagtagctgcagggtaccaagcttcgccctctgcgtccccgcgccttcgcggtctcccgccagtgcaggtccggggcccccaggcgagcggacaaggttggcctaatctgccaaacttctggggcatttaccgtgctctggccgccctcccgattcttccctccgcgcccttgcctgcttctcgcctaccccgggctccggaagggaaggaggcgtgtccggagcaggcgggcgggaactgtataaaagcgccggcggctcagcagccgggcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaagtgagtagggcgcgcccgggagctcccaggctctccaggaaaaatcgcgcccggtgccccggggaagccggcgctccctgggacttgcagctggggcgtgcagggctgtgcctgccgggtgagacaagaggatgcgggggaggccggcgtggtgtgtgatcccgagccgagccgggtgagccagggagaaaaggagtgggagtgctgagagggagccagtgtcaagtttggagcctcagcagttaagttttgagctgtcagtcggaaaccgtaattcccgtctggtggaaagattggcttttgggccatggaatgttaagttatcacgggaaggcatgtctttgcataggagacggttttcccgtggattccaggagattatgaaacagcaccccacgcgccaccctcactagctctctcactcagatttatttgtgtagccccgaggtgggcgccgggcaccaggagcggcgcgaacgcgggtgcagccgcgggagcgaagccaacgcggaactcctaagcggcagctctcggcggggcgggaacctgcccgcctgcccgggaaacttggctctcggcggtgtctgcctagtttgcagctctgtgtgggctctaaagagctctagtacctccacaatgcacgcacctttttccatttcaaaagggataaaggctttttataaaataggcacctctgaatgatagtgattgagataattcccagtgctgctaaattctgcattatacataaagcactgtgggtaaagcgctgcctggggggacaattagatttttttttcccttgaagaaaatacctggttcttcgtttagaaagggccgccacggtgcccctatccacagttctcttcaccattgttgattgttacctcctctcactttcccccttagaaattgttatgtgttatctgccgcggttggctaagggttgccctttcaccccccagaggttctgttggagattgcagttcctgaaatgtgtggaaggggtggaagtggtggggaaaaaggaaaccggggtgtttgtacacatcgttggtgtagaatgaaggcatcaatgtgctcaaaatgctttatcaaatgacctgcttagcatcatattttaaacagatatctaggcctgcaaaaagttgcaagactctagccccttgtaccggtgtggtaaaaggcaggggaaagggacattgcctggctaaaagaggcttgcatagtctctagagcactctctaagagaaaagacgcgatgtgcctctcccctctcttacaagcaggttagctttcaggcaaggcattgagcaccgcacctggaatcaccacagcgtgctgtcgaaatgcaaatgttaaagattcttgcaacaaaagaaaagttttattgtaatctcttgatttagacaagctttctgcgaaattataagaagggtagagacctattccttcttatagtagcatctgctcccatggatggtggtgagatctgggggaagaagctgctaccttctagttcaggaaaagagcctaaaccttcctatttaaacaagaacacaggagacagataaggttaatgtccaacactccaaagccaggggatgtactatcaagtcactttgagaggcagtaggattgattatccttgcacccttgctttgcaaaacaaatgtgagctctgtaatctcctttctcgctttgattaaatggctgtgtaaatcggattacatggaataattccattgaaaactagaaagaggtcaatctagtctgaaacattgtgactgtggcattagtgactcagtgctgccgaccagagaaatttgagaaagctaagtattttagatatgtgacctgttcggtcacacatcacacaagttaaagtgcaggccctttgggggaacttgctgatgttaaacggcttgtaggcaaaggagggcagtacccttgttgaatgaaggcattcattgcctaggatctaatgaccttcaaggttttttttaagaatacttctagcgattccacagtcactgaaaaaggggacactggaaatagcccaaaatcaataaaataatctgcagaaatggaggaggggattagatctttcatattgttaaattttctaatccaaaaattacaaagacattttctgtgcaatgctgcatggatggaaggtagcctatgtaaattggacattaagaaataggatcgattgttctgattctaatgttatcctcaccagggaagaatatctattaatatttagtagtttaaatagtcatttataaacatggcatcaataccatggttctattataaagcaacttgttctgtactctcctactaccccacatataaaaaaaatttatagtaatattttaaaatggggtttgatttgaattacacagctctccaagaatcatggggactccaggtattctggcctttccgtcaagctaagtaagtgtgaaaattccatcaacaaccacttggggtttgatgaatgattcattcatttagcatgttggtacacttcagtatttccaatataatgacacaggcaataaatttaagcacagttctacagaaatgaatgtcttttgaatttttcagatttgtttgattttattttattcagattgtgtggttttacagttttctagaggtgtttgtggcttgggcttagaaaaaacatctctttcaatgtgtaactattttttaaacataatattctgatacaccatattggataacaatcaaggcaccatattttgcaacactgattaagatttggttaaaagtgccattagcttaatgtgcctggtgttacatttatcaatgttgtgcttacattttagtttggggatggtttgtgagaagtgtcataactcctgtcaatttcagaaatactgagataagaaagattgatcttgcaaacaatgtaaaaaaggccattttaggcatactaactctcagagaataagcaaatagaatgctaattttcactactccaaagaaaatatctcttttatgtctgtatgaagtttgtcatgtgggtgatgatgcaagtttactttgtagaagaaaattaacatacttatgaaaagagcatttttttagtcttgtccttaagatcactcaatttggaatgtatgctttgaataattccaatttatgtagcttttaattgatacattctgccaagactttaaaacccaagtgctaagttgattacatttaacataaaacaaggaaaataaccatatggaaatctgaaagtctgggccaaaccaattaaaattgctaaattttatttacgtctaactgctgatttgaagatagcaaattctgggtcacattttttttttaataataggtgactgaaatgtttccatcaccataaatcacataaaaatttctcactcaaatagcaagtgtgggtattggaggttttttacatggattggcaaattccactacatgtggccttcgctttatatctgagaataaaccatatctgagcatatatgagaaacacctaaaatatggttggtagaaggattctaggttctagcttctgaagacttagattctaattcctgttttactactcatgagacaaatgaccttaggcaaatatttgttaaactttttgggatttctgttttttgtaatctgtatgatgattataaaagttataaagatttttctcgcatggtggttttaaggactaaatgaaattttatatgtgtctttataccagcatagtagcttactatatgtacagtttgaatttattgttcctgagaagagagtgcctgctggcctacttttacaagccagagaaaaactgacttattgcaggtaaattatgcctaatgaaccaagcacagagaccaagttttcctaaatctacgtctgtcgatttggtgactcccatgataggctaatatctgtttatagactataattaagacacatcaatccaggaatatgtgaagacaaaggtgatatgtgggcttaagaggtgctacgtttttgaaggtttttcttttaaagtacaaatgaatgagataattagaatagaaaatagaaatggaaaatggaaatattatctttatcgctgactcagtttcatatttctacactcttgctaagttctccttgtatgattctaaggaattatttcattttattttattttattttggactaaagagacttggttagtttcccatccctaatgttctcgcacttgcttttctgagtgaggccatgcattcatttctgtggggtgtctttgttgtctttaccaggcaacgtgcagtgacatttttttttcattatgctagtttgagacttttatttttcttttctggattatcttaatgttcccttttgtaaattatttttattcccttttgtaaattttattcccttttgtaaattagggcaaggcatttggatataaatctctgaagagtgatcttttatctttctttctagcacataaatcatgagcagctgcaagaaactgttcttggtcttacacactgttcttggtcttagtcacgtgtgtagacagaacaatttacaaaacaagttgagggaacaccaagatatttttataatatatgctgctttcagggttgttttgtataggctctgtttcatagaaacaattgactgcagcctttctgatttatagatgcagcaagatgtgtttgccttttcacttaattatgggtatactaaaaactgtttacaggggctgggagtttaagagaattgtcatgatctcatctctacctatttctttctctatagaaaaaagaggtgggggagtgattttctcatagttggggctcatggttctttctttaaaatcataatgtgtgtcatctaaaggaagactgttctttatgtacctgtctttgtcctttggctacattttactatttttgtaggctgccactttggcttggatattaggaggctgatttcttttattaacctggataataagtagtagtaatttgggaaattatttgaactccagatcttagtttgctcaactgtaaaatgagtaagtgagactaggtgatttctaagtgccttctggttctaaaattctctatttctaaagtactagtaaaatagatatttgaaccagatggtatttaagcttccttcagttctcagatttatgcagccattgcttcagtgtgaatgcacattataaccattgttttatgattatgaataagccaatggggagaaatgaaggagatttaaatttagactgttctacttttatgcatttcacctactgcttgatatttctttgtaaaaagaatggtatttacactttcctgttttagcaaaatccatagttaaagaggatctttactttctctgttctaaatttttaagttctatgaaaaagaattctaagataaagtcagctaaccagaggagataagcttacaaaaggtaatgcttccctgtatttgcctgttttttttctgtccctttaacttccagtacgtgtgtgcatggagttgaaatggagaaagaaaaccaagaagggatctgatgatgtagtagaaagagcactgaggggagaatcagaggaactgatcctaccctttgctctgcctcaagatgtgtgaccttggactagtctcccagtcttagtatctctgaatcatgcccaagatagttaatcctgagaagatagtgaagatgagaggctgcagctggagacacggaggtggaaagaggagggagcctcagggaaaggcagttcctgcagatgatactatgccaaatctctccttggctggcttttgtctgggtccagtaccatccttggaacagtgcttgcttacctcctttccttagctgagagctggagcaaacccagcagctagccgtagcccttttctttttttcttttttttttttcttttagcagtcagaagctatggcagtcttttcttgttgacatgagaatattccaagatcagctggaccctcctcaagctaggagaacacacatttctcagaaaacagggccacaaccatgaagataatgttcttctctaatcactggcattgcccactgagctatccactaaaacaaagtttagaattgaggcaatagtctagaaaatttaaaaaaaaaaaaagtagcaatggctattattgggatatttggatgcagaaattcagcacttgactttgtgcctgtagctgttgccctggggctcttgaatgctgctgattagaacatgggtaaattgggagggagcggggcaataaggtagccttttctgtgttccaggtacacagacagcagctcaaactttgtctgttgctcacaaagaatgcctttgctctttagggtgaccatgtaaaaggacatgaaaggaccaccgcaaactcatcggtgctcacttgaaaaagcaagccttgttcacctttgcagaaagggcatccccactgcataattgcatccctgtgcaaacctgggaagaaagagcacaggttggaggggggcgttgtgtttgtcttgtatgcccatactgtgttgccttttcaggagcagaagttcatctgctgaacataagccctgtgagtgcttagaacttttccctctttttcaccttgacataaaatccctaaagctgaggacctttccctttcaatgtcttcactctgctccagggctgaattgcatctcattattggcttgtttcacctaaatgtgagtatttgagtggcagtgaaccaggttgcctctaaggaatacaactgaataatggtggtctattgtgaaggaacctcttagggccctacagtgctgagttttctactgtttacttggagttcctttctcagtgccttcccaaacaactgccttgggaaaacacacagattctttggcttccaagaagagtgtgacagagaaagtgtgctttgttataaaggccttgtcaccctcctggatgtgttatccatatcgatgtactggctgttaaaattcatgttcactgcagaactctagatggaggagtggtaagaagggagggtagagatgttttcatataaaattgtttctaatgtgatctagaaaacccaaggattgcaacacagacctcagcagtcatacatcattatttatggttctgtgtaaatgtacaatttaacgcttctgaaatagtaaacacattagggatttccttttttgatgaacaaccaaaagctctgtgattgctttagtttggatttctcgcaactttagaaaactgctgtattccgtgggccctactcataaatctttgatgtgctctgttagtcagaggactgaccttagcacatttgtcattctgctgtttgaaagatacattatcacagtataggagaatggctggtgctttctacttccaggtggtccaaagtgggaactaaacaaaatgaggggataataaagggattaggcaacattcatgaaaaattcagaggaaattattagcataatgtttttactatttggatgacattaattgtatgtagaaaagcactgaactacaaaatagggcttacataattcttccaatatctttgtaataaattatatatatatatatatatatatataataatgtatataatatatatataatgtacatatttatatttattcttagcccctgcccagaaaagtgtttttaaaactttacttcctgtttgtaatgtactgaagccacagtactctatgctttaataatactttaaaaataatgtacctttttttaaaatatgaaactagggtctttaagaaaaaaatgtatttaggcatttattaggcttgcttgatttatttcatatatagatacacatatgactgtagctaattttaatttaaaattataagtagcttctcccaatactcgcgaatccttatataatgctcacaatgtcaggacctgttctaagccgtttgcatttatttatttatatttttcaataatgagacttttaaatccaagactgatttgaccatttattgtttgcacttctgtacaaatgtcacacataatgattcaacttgaagagatgaaatttactgtactatgtgtcaagtgtttggcatttaaatgtgtagccattttaaatagcttctatcattatattataaaatcaaaccatcctgataatagatcatgccaaaatggcacttagtagaaaacagttccaagattaattaattcacagcacttttccgctgagaggtagttattatttttttaaaccccatttcacagataggaaaactaagacaaggtctttctcctgccaatcccaggtgtttattgcaaaagagactcagctggcattaaccacagcgcattagtgtggcttatttaatacctcaaagatatgcattctgtttacatgaacattgaatcaaaaacaaatgcaactcagatgttcaaaaaagctgccagtaatagaatttggacaacaaaaatttcatgattgcagttgcctcaaagagtggctcctgccaactgctcagtaaatacacttggaatgttgtgaaatgaatggagacctaattcaggttgttagatactgatacattttttataagccttttttctaatggcaaaattttaacaattgtgctaggtctgttatacacacaaatgtgtttggtgcatgactggcaaggctactttgtttactattttacagcattaattttcagtgaatgcataacatcatttacttagtgaaactggagacaatgtgagagaatagcaaaggtttgaatggatatagatcaaatgtagtattggttctgccacttaccaaccccagtaagtttttctctttgaacttcactttctcaatatttaaaatgggcacagaagtaaccacctagtagtagtattgatgtgataattaaaagagatagactgtctaacatcacagcaactggcacttacttaatagagcattgtttccttctctaaaagaatagtaaatcacacagaacattatacaaatctgtatgctgtaagaaataacttcagtgttagtaattcctggctttggctatagggctttcataaataaaaaaattaaaaccaatccttagagactaatagcttaactctcttatttatacgttatctatcttatttgacactcataaacacccttagcaaatttttagaaaattttcccaattttatcttctttacttttctcccctttctgttgaaaagaaataacaaagtaggccaaagacaagctgtttaagaagtaagagcagcttactgaataaggaaatataagacaaattaataagttaataactgtgaattactccccatgggtgaaacaccatgccacaaactgcacaagtgtatctcattcgattgtagcaaaatgttgtaaaatacatattattatttggcatcattttttttaacaaagaaaaataaaaaccctgaagttcagagagattaagaaaacttgcccaaaatgagaatttaaaaagtgcaagtggaagagtttgtatttgaagccaagcctatttaaatctaaaggccagattccttctaatcactacaatataatgcaccaatatagacacgcatgcatacacatacaaactgaaagggttgaacttctttgtttttttttttgttgttgttgttgttttttctaatttatttgtggagaagaagatgcaatttaactttacaccagaaagactgagagcaggcaaagctgagtcctctggttgagtgatgagttgcttctgaccccacactcctcagtacttaccagaagtgtaaatggctgtatgtgagcaacactcccacaggtcagggagcctgggtttcctcatcaggctttcccacccatctccccagcagtcaaatggaaaccccttgcctgactcatctgactgttgtgagggaatctcattgtaaactctaaagatgtcgtcttactttatggaatcaggaattacttcattgccaaaaagctttctgtctttcaaataaagtggtactttgttggcagagggcagattttaaaatattttaaagttatgtttcaaaataacttcttggaaatagaaagatacttcagaaagtacttttatcaatttgctctgatcctctttacatgatgttttggaagatggttttaaatgtctgtgatcatattaggaaattatttgataataatgtcgtttatgtctggcttttaaagctaccagccatttatattgtggcctttgttttgttcatttcttatcaatccaactgcattaatattaaaaaaaatattttctgcattaatatcgcaagattttaaatgggtgattgtcagcacaaccttatcagcagcatcaccttgtaacatactcaatagcagtttagtacaaatgaaaatgttggctaaaaagtcctggcatcatctcaacacaggtaaaggagacaacagaacagagatgtgcttaaccaaactctgcagtcagatggtctgctttggttgcctaagaacgaaaacctcttagcctcaatttccccatctgccaaacagaatgagcaatggtacatttatcataggtagttataaggataaaatgaaataatccacaaaaaagcacttagtccagtgctggacaccaagaaaatactaaataaacatttactcttgctattaccattaaacaaatggtaatgtaatgcttatcaatagtgatggctcctttcttaaagaaagtgactttaactgcaaaatctccactaccagagtgaaagggaaagttgaagcaatttatccaagtaactccagcctcaaattcacttttgtcctgagtaatgtagttgtttttattctttttttaaaacaaaaactgaaaaagaaaaatgtgtataattagaatcacaaaagagtttacctagagcaaagttacttctttctatcatgtgcccaagatcgcggcaccaatatgtggtggctggcttatgaaacagattcggattcagagctcgcattcccaagctctttgctttacctggaattagggggacagaacatgagtcattcccattttgaatcagtgagtgattgcctacttttccctatatgagtgaagtcattttcagcatccatagaaatatagccacttgtcaaaagaaaatggaaagaacatggcttttgtgtcaaaagcatatagattttacctctggctcttgactctagcttgacatgggaccttaggcaatttatttatctttccttaaccttctcttaaacttctgtaaaatggaagaataatactttgcagcttccttctcttgtttcctcactcttttttctctcccttctttccttgttctttcccttcttttttttaaaaacctggaaataatgttatatacctaatttgtaatcacgattcacaatcactcaaataattgtactattagaaaacaatgtttttcagaattaacacggtttcctgctctaattttaagaagtaaattatatttctcaaagtgtttggctcattggccttgtgtagactggaagaagcatggggtttggagttagacagaatgagagttaaatcttagctccactattatgattacaacatgatatttatttccttcctctaggccccaatatcctcattggtgtaatggggttgtaggggtaatagtacatagttggaagaacacaagaattaaatgagattatagtctgggcatggtggtttatgtctgcaatccaaacactttggaagacagaggcaggaggattgcttgagcccaggagtttgagaacagcctgggcaacatagtgagaccttgtctctacaaaaatattataaataaaataaataaataaataaataaataaatgagataatatgtggaaattgtctgacccagaagtgatgctcaataaattgtatctgtaagctttagggaatggattatgccagcagacacatcagtatgtattagactgtctgctctgtgtctgtaaggatgttgacacatgttggcgacctcacaagttgtgaaagtcaagagagtaattaactgagcagtgctctacatactatactgtccattcagaggcctagtgttgttgtattgttctcagacttgagcaataaaaaatataaattttccaagtacatgaaaactttagtttattaatgtcttctaaaatgagcctcaaattagtttttgtatagtacgatcatgaatagctttggagactcataaatctggaatcatctcttcaaactgtatgactttgagtcacttgattcttcggataacattctgattttctcacttgtaaaatgaggtttataatagtgtctaagtcctaaggtgactgtgaggattaaatgagctaatgcataagaagggcattaggacaggtaccagaaaacctcggtaaatgttagctcctttcaaataaaatgcagttttgcattcaaaggttgttcgtttgttgtttttattttttttgcatgtgttgaatttaataactttatagaatcaacagtttggaaatgtttccattatgaattcaggttttattttcttgtcagtgactctgtttagtttaagggcttggttgtccagattcatctttgagtaagttttgtatcaatcaagacagatgcaagttacttttatcagtccattacttcaggtaaacaagcattccattctttgacagaacattaaactgttatgttctttttgatggagtgctgatttgttcaaaacacttgtgaaagagagaaaacagctcctgttttataactcttttgtaatacaaagtttgtttccaaaggttttctggaagtttcttgattgaatctttgattgtggataccacagtgattaatttaccaagccggaaaatgtgggaagtaattttgggttcagttcagagtgggatctaacacaacactttgaaccaatattaaaatgcagaaatctcttttagatattgaaaaagaaaaacaaatatatatatattaaagtccctgcttttaaggcctaaaggagaatgtagtagaaacactgacatgtgtaatttttgtgaattgcttaggaacagaattagatttaaaaaggaattccttttgcacttttccctgaagatttgtgtcctagcatttgaggagtaatacaggaaagtcagaacaagaacttactgacagcacaggagatccatgtcctacattcatgtatgtggtactgtattgctatgcagctttcaggatgtccattttattgtccatcaaaatgtaggggtagatcctataattttaaaggttctttctaatgcacacaatctagagttattaacagaagtctgactgtgtcattaccctggctaaaatcctctaccgactttacattaccctcaggataaagtccaaaccctcagcacactatacaaggtcctctgtggtttggctgttgcttatctccaccactcccgagtggtaagtttcattccagcgtcacctaactatgtacaatgacataccaatattgctgcacttggtttccaaggccctgagggcctcgcatttgggtagctttgatggtctctactccaggaagtcctccctgacttttgtttgctctttttcctcagcccctctccctactatgttgtttagtgatcttaccctgagctcctgtagcatttaaaaaaacaatcatatcacttatcacattatattgaagttatttttttacttacctagctaagttgtctaacactggtatccctagctagtggcacagtgccaaaatattgataaaggttttctgaactaaactatgaatttaatgccaaatgtctctttgagggacaacatccacctgtcagcattctaagaatggatccagacatttgacaattttgtgcctgctgacctcagcagacacatgaaactgcatgtaacactgtcctgtataaacatacatacattgttcaaacagaattttcctcagagagagaaatgataaatgagccactttgggtggtagaagagaatggagacagtaaattaaaaataaataaataagtaaaggagaaggtgaggccattgcttgccattcttaaggaaatgacacaataggctgaatgacaagggccagttaaaactcgctaatgccagatatatgaagacttaagaaccagaaaggattttagggcagaatattgttgatgatgatgaagaggaaaaatgttgatttccgatgcttattctctgtgccaggtcctgagctaaatgtgttacatactttatgtctcctgattctccccacctgtgagggtggtggtagtgtgattattccatttgatacaagaggaggaatctgagctcacagaggttgagcaaatttctcagcatcttacaactgtcagtcatcaaacctgatctgtttgttcctaatttcttgcttagtattagtactgttgacattttattttcttacctagagattttgtttgtttgtttctttgtttgtttaaatggagtctcgctctgtcaccaggctggagtgcagtggtgcaatctcagctcactgcaacttccgcctcccaggtttaagtgattctcctgcctcagcctcctgagtagctgggattacaggcacgtgccaccactcccggctaatttttgtatttttagtagagatgtggtttcaccatgttggccaggatggtctcgatctcttgatctcgtgatctgcctgcctcaacctcccagagtgctgggattacaggcctgagccaccgtgcccagccgagattttttttgatacataataattcatgagactattacaaatatggtaaatggattcttccttcccagctcacccacactcaagatgcttcctttaaaattctgttaacaatttgtgctagttaataggtagctagtgcaatactcaagtaaaggatgttgtgtagttttggatactgagatgtatagtctttgtctaaaaggagttgaaagacagaaatatgacaatatgagagggtttagatgattctattagaatgatatttatgtatttaaaacagatatggttaaggagttcagcaaaaataatgtctcaatacataagatcagagattaagcgtggaggaagaaagttggagaaggattaacaagaagtgatgttttcaaatttcatgtgtggttagaagccatcatcttagtgactcaaggcagtaatactactgctttacaatacagtgctctaaaataatgttacagatattgcatgtacttttaaaaacatatatcattttggggatactctttgatgccaagtttaaaaaattctgaagtgtttaaaatgatacaaacttagagcatgatctgtgttcctttttttttttaatcaggtaagcttcttggttttgggtgtagatctgaaaagttaacatttcttgaaccaataaaatgtttccagttttatataattatatcacaaagtctaccttctgccttgatttgcaaagaaaagctccaaaaaggaccataaagaagaggagataacacacaaatagtgagcaatgaagtagatgtacaaaatggtttgtgcagatttggcacttaaaacatacagcagccgaagtacatcttaaatttcatttagtgaatatattgctcacgagtccctctcttcatttcctgaggaagtagatccctattctctcccatatggtgagaaaatctctttgctatccaaacagtttccctgtttacatttgttcttccatccccttctgattcctcagcaaagcagctgttttgaaaagaagctcaaaggattaccttgaaatggttacccactctcccccttttctgctccaagaagaaagtttctttctgtattttcccagcattattaagagtcaagacttgaggccttaaggtacatttcctatattcttcttttgttttaaacttgaaagcaaaataatcttcccaagtctaccatgaggatgaatttcagaatgcacaataacttacatttaccgagaaaactgttaagtcagaatcttctaaaatagagataacaataacaagtgtgatgccagtactcctatcctgatacattgtaaaaaatcatctccttccttactgtgtcctacatccttttttcttttcttttttttttgagatggagttttgctcttgttgcccctgctggagtgcaatggtgcaatcttggcttactgtaacctctgcctcccgggttcaagcaattctcctgcctcagcctccctagtagctgggattacaggtgcccaccaccatgcccagctaattttttgtatttttagtagaggtggggtttccccatgttggccaggctggtctcgaactcctgaccttaggtgatccgcccaccttggtctcccaaattgctgggattacaggcgtgagccactgcgcccggccacatcttcctttcttaatgaatttagagtctcctcctacatcaaaatggtattagagagaatgctaaggataattccatggatctcatgataaacaattggaataaaagagcttgccacttagtcatgattattagcatgaaaatgtgatgatgcagcctattttgggggagggatgaagtgtcattgaatcagctcatgagtagtctggcatgcgactttctgtttcttgcaaacaagttgcatgataggggaacatcaacactatgccagtgtgtccctgaagaaaaggtagctggttttgttttggtcaaagtaggaatgagtctggaaagggattcagttttatgaacattgttttgcctgctttagaaaagatgacagatagataagagtcaaccaatgctttgggaagagataagattagcatttaaaagcttaacccatgtcatcacttctgggtatgtcttccctgagtgaaatcttattctttgcatgcattttgaatgctgaatcaccatgaataatttttatgaatggctactttagaaatgttaatggattgcaactcattggggaaataaaaaatttatggttgcgtattacaataaattctaaataaagcagtatatggaattgttgacttctcagagacttccagtgaacttactgcaggacagtgtctacatttcagctctgtgtgatactttcagtgttttcgcttttttaatatgcccctttttgtcaataaaggaaagaaactccactttatacttacgtagtttcttcagaaagggagctctggggattttatagccaggtcagcccttcgattttgggccacatctaccaggagaagcatttttcaatgattgttcattcattaaaattgtctatttacgttgtccctgcccttcttggagcttgtagtctactcatggttttatagcctagttttccacttacatggacctagggaagtattaaaggtacaaagaaaatggttaaaagttcaaactgagaagcatttagctaatcgtcactatttgaatttagcagttattgagcctaagagtgagaaggatgacaatggtttatacccaactgatgaacaaaatcctcctgtttatccttcactcattcattctaaatatatttacgaggggcttcttcacacctgccattgccttagtcagtctgacaaaacagggagggactgaaagtccatatggcaccttatggtgctcacagtcaagtgtaagaaacagataataagcaaaactggttggcgatgttgcaattctattgtgtaaatatggaaaccagctgctgaggattgaattgtacattgtccagccttcatctctgccccattatatgtacctgggtttattctctagtaacacaatttagatagtgccagtaccttggtctgtaccatataaaagagaattttattgaaggagaacttttatgagcaattcagtagcagttagcaatacatacaatccacaaatatggaggattatgtactatgagaaaggaccaaatcaaggtgctagaggtaagaatgacggataagaataatataatcctcattcttataccatgtatattcttgttgggaggaacagatgataagagtaaactaattgggtaatcaaaataatttctgagaatgaaaagtgcttaagggaaagcaaaactgtgatgtgatgtgatgtgataagaggtgctccttaagacaggttacctgggaaggcttctctgagaaggtgatatttgaactgagtcctgaatgatgagaacaacttgccattggcaaagcccaaaaaggagaaaactggcagcagcaagtacaaagggcttgaggcaggaattaccttccaggtatttcaggaacataaaggaggccagtgtggctagagcatggtgggaagataaaggttactaaggcgtaaacatggagttggacaagtctgtcttccgaaggtctctgtaggccttgattaggagttggagtcttactgtaaatgtaatgggaaggcattgggagattttaagcaggtagtgatcatgttttatatattcccagaagaagatactattgtgagtaataagtctgaaagcaaagaaggctatttagaggatccctgtaatcttccagtaagagtgtgctaagagcttagcacaagctaaagttgtacaagatgaaatggagagaaatgagttttgagatttattttgctggtagaaaatatgatcagatgtggaaataggggactgggaagaatcaaggatagtgcccagatttttggcttaaaccaccattcttcaagtttgggcatgatgttactaggaatgcttgttctagacagcaatgacaatagccatagcaaacatttataaaggtgtattatttgacaggtactatactaaatgcccacttacataactatatttaatcctcagcaaacctataaagtcagttctgttattacacccatttacagatgaggaaactgaggcccagaatgataaaataactttccaacggccataaggattgtgtcaaagtagaaattaagatatgggcagtctgattctaaggttgatgttttccaaccccctcctctataccacttctctgtgcatgagtaaacacactgttttctttctttctttcctttttttttttttttttttttttttgagacagagtctcgctttgttacccaggcttgagtgcagtggtgcgatctcggctcaccgcaacctccgcctcccaggttcaagcgattctcctgcctcagccccccaggtagctgggactacaggcgcatgccaccatgcccggctaatttttttatttttagtagagacggggtttcactgtgttggccaggctggtctcgaactcctgaccttgtgatccgcccgcctcagcctcccaaagtgctgggattacaggcgtgagccacagcgcccagccaacacactgttttctaaagctgttttggatatattagtgaagctgaagttgacttttgaaactttgctatttaggttaacattcacctgttgcccaaacaatttttgcctcacttttatactaggtagaaaagagcctgcctgcttggaagagcggatccaaatccaagttcagggggcagtttcacaacctctttatttcactttccagggctgatctttaatctatggggaggcagaggataaatgagattgtttacaattattatgtgcaattaaaaagaaaacacattttttaaaaaatgggttgtattgtgaatgattgtatagtcatttactgttagcaaagcttttagaatatttaagggatcaataaagataaaattataactgtagcatcaactgtggtttaactgtagctaactgaactagctatagttaactattaactgtaattaacaaaataataattagagcattaatagtcatgtaatgttctcatagatttgccaattggcttgtgagtgctttacataacattgtcttatgtaatcttttcaaaactgcaaaaacatgttatcatcacaagaaaactgagtctcagagaggttacataatttgctctggattacaacacgtgacagcaccaggatttgaatccatatcttactttgataacgttctctgttttaaatgtcatcatcttcataaacagtgagcctgcaattgacatatattgttatcagaagaacaagtcctgggcatgtcattgaacctgcagttgtagagtattgttaccagagaaatgtgtctcaggcatgtcaatgaatctgcaattgaagtttattgttaccagaggaacttgtcccaggcatgccaactgtaaatgctttgctgtgtttcatctggtagaattgtattaaactctcatggattgcctataaaaaattggtcttttttaaaatttaaaataatccttatttttcaacttgaattgtgaaacactaatgggaaatttctaaggaaaattttgaccacccttaggagaaataaatgcttaattacttggctttttccccttgttttgcttaggatttaattttggacaatatagtctactctgcctgattgaaacctggaatatacttcaaagagtatattgaagtgcatttgatggcctgtggaatttttggaagggccgtaggagcagactgcaagctgagcttccagaacactcccagcactcagaacttaagtccactacagtctgtaaatatgttgcggccagtgcagaaagctgttactgctgctgactggagggtcttgctgcccgcagtaccaactaagccaataaaatgcatgcccacagccaggctgtcttctcgagtatttccttcccatatcagatcttgcagtcacgcctaattggcagaaccgaagtcccatctacaaccctggataacttaaagggcgtctgataaatggagtttttagctttccagccatgatagtttagagggatatgctaggagaatattggaatggcaattgaaagagacaatcaacagtattctgtgcactcaatacacttaacttttcttatcttttttgtttttaatttccataggttattggggaacagggggtgtttggttacatgagtaagttctttagtggtgatttgtgagattttggtgcacccatcacccaagtagtatacactgtacccaatttgtcatcttttatccctcacccccctcaagttactctaaatcaagagcacctagtatgtagcccttcaatcaaatacaacgttgtatatcttttaagacatttttgttttgtttgttttctttaacaatataacactcatgaactatctaaaatattatatctcagactttatagagtacctaataatcacatagagggcttattaaaagatgtgctttcctgagatgcaccctcagaaatttggattccctctgacatgcaggaatctgtattttaattaaacaccccagatgattacactttcatctaaacataacacagctgactcccttggtttcagttggaacaccttcagtgaaagaaggaacattttaacagtttattccatcccactaaaaaggcagttggtatgtctcacacacattgcataattcgcaaagccagtttgtgacctttgccaatcaagcttgtcatctgatgtgacagagaaaacgatcaagattgtgaacgttctttgagctcatgtctctagctccactcattttgatgatatttggaagcagttaaagtagagtataaagatttagtttattctcatgtagtaaaagatccaggttggtgggtggcgggtcgtgaggggtggggggaactttgttgaaaattttctgagctgcttcctcagatttttatttatttatttatttatttaaaaggtcttgtgagactaaacttgtcagattttcagtagcagatgtgaaaatacatatgagcacattaattacatccatagtgggaaaaaaacacaaaaaggttctaggaaattcaggcattcagtctcagattgggcacttgggatcagatggcaactgaagcctatgctcatttcacatcaccaaatggtttggagttcaaaatattttagagattttaaataattacataatttttgatttacatgagatctcactttcagaagcaagtcacgtatttgaaagagtataaattatgatttatgtttctgtagctgtttttagagagctacagccctcagattcttgtacatcagggtgatgtacaaccctcagattcttgtacatcggggtagttcaattttaagagcagctagttggcataagagtaaacggtgcccgtgtccatggagtgctgaagatgcagatttcagaactttcatgaatttttaaaattatgtttccatactttggccggtgttgggggaggtctgctcatcttatttctttgaaaatacacacttattgcagagagttggcggtagatatataaacctagctaacttaaagggcatctgagaaatggcgtttttagctttccagacgtgatagttgagaattaaactagtacccatcagttttctagactagctcagtctgttacacatcattatcctcacagaaattagaattagtcattagctcgcatctccttaaaattaagtggattatactgtgtaggggatttttttcccctctgctttgtataactgctaaagagctttatgaatagctaatgatctactttttaaaccattgttactaattagatagtctatactgctgtcacaaatgcttactctattatgtacatctttattaaaattagtaacagtaaaaacctgaacactcaggccctatattcttgcctgaggtaccagtcttttatcagggatttttacacagggtcaaaacttctgagctcacctggctctgttaaccccaggtgagttgttccctattcctaggccatttaaaaaagagaaatgctgagtttattattttagtcccactctttcagggctgtgtgttcccttctaccaagaccgaagtgaacttttctagccctttccatgatcactcactctcttctttcttttttggcaaactgtagtaatatacccttgaaattccctcatactcattcactcctgtagtccatccactgtgattgacttttagttccatcaactcaatggcaactgccctcattaaggtcagctccattaagtactctttagtaaacatcatattgacatcttttagtgcttgttttattcattgccctctccctttggtattttttttccattggctgctgtaccccacaatcaactgatttccctctcatgtatttggcttcacattctctcatctcctacacagatagttcatgatagaatggtatctatctatggtatggtagtattcactaaggtttttggtgataaactcccagactcctgctgcctcttctcttcctacatatctggatcagcagatagcaccactttttacacagtcacccaaactggaacctggaagtcatttgtgcctcttccccttttgaccctaccctcttttcattagtcaccaagatcttccgttctacttccatatcctgttgaacgtgttcatttctctccattctcactgccactgccctagttaaggcccttatcatctcagctttggattacttcagtgacctcctaatgggcctcatgcccccaggtttgttgccctctctcccccagtccatccttcattctgatgcctgataaaccttttaacaataaatcagatcttgacactcccttgcttaaaatcattccaggtctccccagtgcttttaaaatgaaatctaaatcaattagcaaggagggcctctgcatatctctctagccttgccttttttttttttttttgcttattctttgaaacttattttccaatggagtaaaaaaatcacagaattctaagaacatgccttgtttccacacttctgtgggcacctgctacttcctctctcaggggtcttctccctcactaactttgagttggctgcccccgatcacctttggagaagcttctccccccagaaactatcagcccctccctcaaatgcccctgtcccccaaatgcccccctccccaagtcaggtttagctgtacttggggcagggggcagttgagggaggggctgggccttttctctctgactcccaccactgtgctgtgttctctagtagcttgagcttcctgaggccagtgatcatagtctttctgtctttatcttatgtatttattagatactccatacatgtctgttaaatgaagaagtggcccctgggataatgttactagaagtctgaaagcacccaattttgtttttataagaagaaacaacttatcgctttattttttgggtttctcccctccctctagctatgtaaatttttgtttaagctatagctaagtgtaacttgatttacctgctcgactcatttattcaacctggtaataacttgacatgtaatttcaatttgaaactgattgagttaaagagacctatatgccttctgtaacatgaccctttaaaataaaatttagtagttcattaaatataaatgaagtcagttttattatctaactggcctagtatttttctttccagcatagatagtgtaggttttggtttatatccaatccagcaatttcctagcaaagtggccataaggaagttacctaatctctcccgaattgtgttttgctcacctgcagagtagggtaataatatctacctggttgatgggaggattacaggaaataatatctgcaaactgcttgtcctatgcacagccccttagaagtcaatatattttgagttatttccactttaagtagtatttacatgtagaacgaggactgattattaaagggtgaatttccccaaatttttctcatgcattgaataccttgaaatctttaaattcccgttacattaaattcccttattatattacattgtctgccttttcatattaagcaacttctttctagtttttttttgttataagagcatattcattacatattttaatgatcacccatattttaaaacatttttagcttacttcttcacaaaagggaagttagaagagtatctttacaagattttggcacccaccaatttggactccaagttggtctgagtttcaattagttactctggtaacatctgttttattgatagtagttaagtttcaaaaactaacaaatctactaaatgtttcagttgtccctttaagattacttaacagtgcttagagaagaattttagtctgtgtaagatgattaggtattttccttataatgtttaatggtaaatttttaagcaattaaaaagatctgaaaaaagaagtcatatagaactgaatggttattcaccaaatgaggatcctgttgttggtttacatagattatttttggaagatatggttcatatgagttaagaagacctgaactcaggaccaattaccatacctgtatcttggtaacttgctttcctgtctttgggtagttgagccagttggctctcttccaaaatacatttgggctacaagggaactgcctgcttcaatagctggtatgcaggattaaagagaagatgaatgttgtttttggcagcagctgctgttttgttcagggcagctctaataccatttcgtaggtctgtgcataaagaaaatgagctacacaaacacttaactctctttttgactttgtgacgtctgtaatatggaccctgacaatgcatattttaaaatcacttctcatattcatagagaaaaaaaggctttttttctgtattttatttttttgtttttccaagtttagaggattggtatcttctggtttcttgaacagcatatgtccccctgatgttcttaggctgcatgcattttaatttctactgaaggaaaggaatctgcagtgtgacttatgtgttgcaacacacgttcagattaagtccatggtttgttttgggtgtttgtagctccttttcctggcatgtggccttttactgtaaggaaagctctgtgttcaggagggattggttattgagtgaatagtccactggagtctgctgatgtttgttctcaacaaaaatgaaaattaagcaagacctttgcctttgaggtcttcaacctcatcttcttgtaaatccctcccaccccagacttctttaaagtacttttctagtactgtctgctactgtctgctcccagaaaaggaccagccacatctgtcactgatgttaacataaattttagtcagtattacttccctctaccagaactgtttctactgcatgccttggttgtaacagtgcacacagatttctcattattttttttcctaatcatgtaaatgatttgaaggcaacatttagcaatgaaaggattattggaattttgtgtgttgcgggggaataaacgggggacacttttgatgcatgtttctaaaaacaaaaatcgagaactacccaggacgatatgtgtctatacaatgaaagactatccagaaatgaggggttatcacacaatgagcttgacctagagagaaaagttgtacaatgataaaacaaagtagccaaagaaaaatgtcatatacagctgcagagaatgttaacagaaaaaaaaaatagatgattacccaaactgaaaagatacattttagagcagaagtcacaaacacagggacattttgcttcagtgtatctccattagggtgtgtgtgagcgtgtgtgcacacccacatatttaggcaccctattccctcagagtttccagaaattggaagaagaggaagagaaaacaaagataaatattttgttgatatattggaacatgtcatttaattggaagtcagttgtctgttaactgaagctactctaaacacagttcagaactaagaaataaatgaaaaaggtgtgtgaactcaaagtcagtgtcaaaatattcatgtgctaaaggtcatactctttgtacatgggagatctactctataaagtcttttctcagaaagttttactcaaacatttttgaagtacttgtcttctggtttcctagccaatgcaaagctcataaaccacacaacaaataattgcataacacccatagtttgaatagtttctcatttgattcttactactagttcatgagatgggtaaggcaaaaattatttttactatcattttataggctgataaatggatactcagggagattagctgacttgtttgaagtcacatgggaagggactgagaggttttctggatccatgttctgcccatggtttccaaaagcgtttttttttttaaatttcttcttgcccttggaaacctttgtttaaacagaatcttactcagaggcatgaacaaataaaacaacaaaaaaagctgagctgctctgcttaaaataaagggtgcgggccaataattctggcagaggcaattcactttcctcatttggaatagcttgaccatcactacactacacctttcattcattcattcattccaaaagtatttcaattgagctgtgttttatttttctattgctgctgtaataaattaccaaaaatttagtgactggccgggtgcagtggctcatacctgtaatctcagcattttgggaggctgaagtgggtggattacctgagctcaggagttcaagaccagcctggccaacatggtgaaactctgtctctaccaaaaatacaaaaaaaaaaagaaaagaaaaaggccagccatggtggcaggcacctataatcccagctacttgggaggctgaggcaggagaatcacttgaatctgggaggcggaggttgcagtgagccgagattgcaccactgcatcccagcctgagcaacagagagagactctgtcaaaaaaaaaaaaaaaaaattatcataattttgaagatcaaatgttcaaaataaggctcacttacatcaaagtatcagttggactatgttgctttccaaaggctctaggggagaatctatttctttctcttttgcagcttctagaagctgcctacatttcttgactcttggtcccttctctctattttcaatgccagcaaggacatgttgagtccttttcaggtcacatttccccgacccttcttccatcatcgcacctctctctgaacagagctggaaaatagtctccatttttaaggaccatggggattagattggacccagggaatctaggatagtctcttcatctctagttcttaacgtaatcatgtctggaaagtccattttgccatgtgtggtgatgtattcacaagttccaagaattaggacatggacatctttggggccattatacttcctgctgtaagctcccatatgggacacatgttgtgttcatcatcaagagtgcaggagactagaaataggcatgttagcagtaacaatatgttgcaagtaatgacctgacaatctgggggaaacaggaaaactaaggaacaaacaaatgaaacctaaaataaatttttaaaagttatacaaacaagtacagtaatttggaaccacttggagaagggaagctacaactacataactgagatactttgaaagtcttccttttatttgatgaacctgaaccgtcacagaaaagcaaagtttaatatttcaattcactgtttaagaaatcaaagtgtgtgtacaatattagaaagacttctgtgtagaaaagttaatactgaaaaatttcttttttatataaagaagtaagctctgcatttcagctctctcctgagtatactgatgaaggaggtgtcattactgcttggcaaaaatctcaatatttctaacttgattatctccctgtcctaatgtttagctatgccagaatgaattctttaattttatgaaaggtggatatttttaatggtagcaaagtatatgcaaaattaaattacaatatgaatttatttataatggctttaaaataaagggctttaagaaatataggtttttcagagatatttgaatgttcataagctaacatagatttaattttagcattgacccagtggatttttacaaaatgaacaaaactgtgtctttgtaagatatttgaatttaactgatgcaaaaaaaatttatgttgccctgatcaaatcattcttcaattattatagcagtctgtgttgatatattttaaggaactatcaaaggacatatattaaaaattatgatgacttgaataatatagactattcagctgtggcatggaatatggaacagacttgtctccatatgcttgatatttgcaaaagtattaaagttttagagatctgctatcgcatcacagttctcacaaatcatctaacagatttgcaggagttctgggacagtgtagaggggctaaaaggacaggagttagaattggacagacctgggcttactgatttcaccactcagaagtcaccaaacctccctgtacctcaactccttcatctttaaaattaggatatatgaaagttatttttttccttattagatatccaagatgcttggtgtatagtaaatgttcagtaacttttagctctattcatggaattgttcccaaaacacaaccagcatctgcattcacattccagcgctctgcctgatagcattgaactacctatactatttaaagccacacttcctacttgagaactgaatctcaccccttctttcctgctcaaggctgttgcccaagcagtcccctctcttctgacctatattgccaattgcttcctcctactggatcattcccataggcatacactcattctggtatttcaaccttcttacaaataaaactctcttcacccccaatttcctgccagctacttccccatcttggttttatttatttatgtgtttgtttatccagttgctctcctttgaaggaaaactcttcaaaacagctgttcatactcactgtttctggttaatctcgtctcctgctttctaaaacccactgtagactggctttttcccataccacttcaataaaactgctcttgttaatattaccagtgaccttaatgttgccaaaccagtggtcagttatcagtccttgtcttacttggcctataactggcatttgacatagtttgaccctattttccttaaagtacttttttaaagtcttggcttccttccatgatctttttgctttgctctcttggactcttttgtgggttctcactcttctgtcagatcccttaaggttagaacaccatagcatgctcagttctttgttcttttttatacttttactcactcccttggtgatctcatccactcatttgcttatatatggaaggttatcatatttatatctgcaccccaagtttccctcctaagtccagatttaaatatcttgacctggcattatcactagaatatctcaaagacatcttaaacttaacatactcaaaatttaactcctgatctgcctcccaaaccttctctacccccagtcttccccatatcagttgatggcaacaccatctttccatatcaaagttcttatagtcatctttgactctttctctcaaatcgtactctgtcaggaaattctcatggttcagccttcagaagatgtccagaatctaaccactttcagtcaatgtattactataaccctttcttgattggattacagcagcaacctcccaacttgtcggtttcattttctacctgttgtcaccctaaagtctatttttattatagcaatcagactgatcttatttaattaatttatttttattctgaagtatatatccctcctctgctcaaaatcttgcaatgaatcctattttattcaagtaagagtcaatgtctgggcaataggcttcaacgccctacatgagctgtcctctccattgtctctctgacatcatcatcttctactgctccctaatttactcttgctatgtcttaaataacagatgccttaaatagaccttaggaccttggcaccagcttttctctctgtatgcagtactcttcccacagatgtctgcgtggatcactgccttagctttgtccaatctttggtgaaattttgtcttcttaatgagacacttatcaatattaccctgttaaaaatttcaagctgtttccacccatactgcaatctctggaaagaaaagagtacagttagttctatggctcttctcgagactcagagatgcctggtgatttgaccctccctataagtcttctttcaacaaggactcaagaaacttttaggtgtacatctatacttcctccaagggaattcagctgaagttactaggtagcaggcactgatgtgtgctttattacaagcatatgtcatgcactgatatgtattaatattttattgttgagactggtactggtgggggtagctgctctagaaaatgaatagaagttcatgccatatccctaaaaagctgctcagctagcaaggtataagcagaaggaatgattctacctacccaacatcacctatcattgccacacgtatcttgagtgttcagtgactttctgatattagagatggcctgggagtctgctctgcttgtgctgtatgtactcttttgttatctaactttttttttttggtgatgtagtctagcttttgtcgccaggctagagtgcagtggcgcaatcttggctcactgcaacctccgcctcatgggttcaaacgattctcctgcctcagcctcccgagtacctgggattacaggcatgcactgccacacccagctaatttttgtatttttagtagagatggggattcaccatgttggccaggctggtctcgatctcctgacctcgtgatccgcccacctcggcctcctaaagtgctgggattacaggcatgagccaccacgcccggccaacctaacctttcttaaaactcagcagtacacttggtgctgggcaaagccttggtgctgggcaaagcagtacacatggtgactcatgactgtgattgtcactctgaacccaagatcaccagtaaggcagagtagacattatgatcccaatcccctttaccttgctctaatcttatttttcccatagcttttgacaccttttgacatactgtataacctagttacttatgtttgttgattaagccttatgagggcaggaattttgttcattatataggcctagcacctaggacaatgcctggtatacaccagatactcaataaatacttgttagatgaatgagaaaacaaacgtttctttagtatttattcaatgccaggcgtaaaggattgcgaagaccagtaacagaatttctgccattacatttctttgagcaaaggatatgattatggtcatttctgagattggtccattacagagatccttagagaaagttcccaaatcacatcagaaagaggggtttagagaaatatatttccagggaggttacgtcttagcaatgacaatataaaagaaagctgactttaataaattatatttacacatgtgaaggaagactgttattaagggacagtttgtatgtaggggttgtctgtccaaaaagaagaatcctcaaacagaaataatttatacaacttagtcttcactgtggtccaagaaagatgatactatgaagagtgtgaccccacaatgctagaagtagccttaaataaaattatgcaggattactgctaaaatagaccatggtggtaagggaataaaaggatttcaatcttgaatacaaaccactatatccatgtaattagcattgtagttttagaaattttagcaaataataatcattatttgttctagtataatatctagttagcatgcagatattaattgaaaataataatccagttcctttttaatatggctagctatgtaaatagagaagatttctagccatgtgcatctggactcttgtgtaattttaagattttacagaagaatggtatctcataaaagaatgtgcacatattttaagatgtcttcacatctgcatggttttgtcatgctgtttatttttcctggaacgttcatcttttctttgtcagcccttgcaagtcctccttgtcctcctaaatccagccacagtcacattttctttctggcttttcttggcactgtcttcctgcaactggttctcccccttaaggttaattgattaattgcttcctcttctgtgttccgaaagtgtttatcacaagatgtgagtgttatttatttacctgcctctgagtttcaagggcatcttcaacatctttgttaccctagtgactggcgttgttcctgttgcataatatatattcaataaatggttattgaatttgagcatcaggatatatttttaccttgaccactgattgacccagcaaatatttattcaggactttttatatgcaagacactgtgttatgtgttgtgaagatactacaaagataaatcagttgcacaagttcttgaaactctacagtgtaataaggaaaaataagtcatgcataaaagcaactataatacataatagaaaatgttattttcaagccgatgtgtaggttatgtgtgttcgagagagagagagagaagacagattactttctgctagggttcaagaatgccttcctgttggctaaggaaatattttccttaagtggctaaaaagctgtgtttcaaaatattcttttgatgtctcacaaattcagtggaattctcttaggtctaaaaatatacatctctctcactttaacttggtgtgctattgtagattattggattaaagcactgctcagggattatgctgcttcttgccaagcagtctacatttaaagtagaaataagatgtttcttttggtgccataaggtatacattttatgcattctctagtttttagaagataccctaagggctaagtctttaacatgctgctacaagtttattcctaattgccattgggaaattggctgaagaaagtttttaacaaaagttaacaatattgtcattgagagaataattcaaaatggattttaactaaaagcttttaaaaactttggtgagcatagcttgaatgcgtaatatttaattgcatttaagccaataacatatattagactggtctttttgtgcatcaaggcattagatgttaaaagtttgaatgattacagatcttaactgatgatcaccaagcaatttttctgttttcatttagacttggattctcacttgcatttatcttcagctgctcctatttaatcctctcgtcaaaactgaagggatctgcaggaatcgtgtgactaataatgtaaaagacgtcactaaattggtaagtaaggaatgctttaccgtgctgtgtaaaaaagagctgtggctctttttcctgtgcttgttgataaaagatttagatttttcttgccccaaagtaatgttttcctaaagtggggaaagtaatcactgggttacaataaagggtttatagaaagcaggtagtgagatatttagggtcatggataatttgttggtaaaactggctagttgcacaccactgctgtgactgcttctttgctggtcttctccccatccttcataggcagtgaaggaccttggagagttcgctgtgtgctgatgggcttgccccagcttgttccccataatctctccagtgggtttcccagcatgttctattccccttcacatgtcttcctactcttctttaaaaagcctaacgaaaggaaatctgaaatggctattctcccaattcaatcagcaggaagaccctgtcacatgtcagtgggtgtttgctccttcagggaacatagagaggtgattcattgcccacatgttgaagggactcatctccctggtttgtcacattgaactcttccctcagcgaaagcatttgcattgcttccccaagtcactgccagctccatgctatgcttctccagatgctttctctcaagatcaagccacagagtgggcataacacatctggaatgcatccttcccaaccgtcacgatctaggggagatcttacatgcttttttgaaccatgtatgatttcgggatgaacaaagcttgagaagcaatttttaaattcctagttatttaaatactgactagagaacggaggtgatgcgagaataggtaagaaatgagggttgtgatatggagaaaaggatgaaaagtttattttttgaggtactgggataaggagtagaaggggctctatttatcttccctcctcttgatatatattttctggtgtatatgtcttattttgggtttataatagaacttcaaaacagaagtttaaggccactgttgaagtcttgctagcttagcctcaatatagaattagaaacacacagacacaatttatacaaattccttaggacccagagagttcaggtttaaaagcattcttccatgcagcagcagcagatgtatcagtatgtcttacttgagggaactgtgagcaaagccatgcaagagttgtctgctatatacccagttagctattgtgtatagggatgggggtgaggggggagtactttttttttttttaaaaacatactgtttaaaaatagatcatgttttttttccttgagttgcttgttagtttgtgacccaagaaacaatactaaaaggacagtatgtgtttaaaatctaacttttgtgaatgacctggattctagtctagacttaacatgtgatggctgtgtgaccttagtcaaggcacttgaccccttctagcctcagtttcttcatctgttaaatagagataatatgtcagcgggatctgaggataaattgtaataatgcagcctaagcccatagtgagcacagtgcctagcacatagtaaatatttgacacacagcacatagtaaacagtgttagacactgttactattttatgattatgtgaacttagggaagaggaaccatactaagtgcctcagttcagagctgaaatgagtgtcaggtggcattactggaagtaggatggtagtaagcaccatgagatcagtcactatcttagctcccatctgactacttacgcccatgcctaaattcatttatcaataaattgttctcagattctagaagctattgacaagaccaagcaggatcatacagaaaatgttatagtaaacttgtgcgagatgacctagtctagcaaacatgcacatgatcttagctttctataaggaagataaagtttttagagacaagatgaaggaaaaaaataagtctacaaagcaagatagacccttgaagatgtaatggtgcaaaactactttttaatgtatgttatcttaatacccaatggtctaagtcagttgttggctaaatttttcatctgggaattttaatggtgatatgagaagggcggggaaagcaaagtagatgatgttcattaaatgtttgctgggtgagtgaagaagaggaaatgatgtgctttactttagtgagcatcacaatcacctgtcatgctgatgaaaattatgggtacctctattcacaatagcaaagacttggaaccaacccaaatgtccatcaataatagaagactggataaagaaaatttcacaaatatacaccatggaatactatgcagccataaaaaaagatgagttcatgtcctttgaagggacatggatgaagctggaaacaattattctcagcaaaatatcacaagaacagaaaaccaaacaccgcatgttctcactcataagtgggagttgaacaatgagaacacaaggacacagggaggggaacattacacactggggcctgttggggggtgggggcctggaagagggatagcgtttggagaaatacctaatgtaaatgacgagctgatgggtgcagcaaagcaacatgatacatgtatacctatgtaacaaacctgcacgttgtgcacatgtaccctagaacttaaagtataataataataataaaaattacaggtgcctgggactacaccaagaaactactttggtaagtctgaaaaagggatccaaacatctatatttttaacaaaattctgaaaggaggcttaagagcaattgctctagatggtctcttctgtcattgtttagaaaccaaaatgtcttgactcttatttaatctcaattcctattatgactagttatcatctgtgttgtatagacttataaggatgccagattaatacaaatcttcaaaatatgtttaaagtaggtcactactttagaaccagcagatcacagtctctcagggacttatttaaggtacagctctaagggcatcactataccgaatctcaacttgtggagatggggtgtgagaaccctaatgtttccaactagcatctacataaaagttatttatgtagaagtatcaggactgcttaggccataatgtttatagagtgtgtgtgtgtgtgtgcatgtgtgtgtgtgtattttaatgtttgaaaagaagtggagtgttcctatcctaacttactaatttcatttattcaaacagcaacatgagtgactgttgagatttatggatgtagataatcacagcctttctctatacatggtggggcagagcatcttgaaggaagtcgggaatactaggtttttttaataccagctccactattacctggctgtgtggccttggacaaatcactgaatctttctggcattcaatttcctaatttttcaaatgaggaacatggacatgatcaatagttattaatctagggctgacaaacttcaaatgcttacacatgaagctcagaattgtgctgccttcatatgccttatgttcatttctgaggagagtgtgtagcttttatcatttctcagagaaatctaagaccccaaagaagataagaactactaaattagagaaacttggaggcctttttcagctttgaaattattttattccataatgatgtttttttcaggttgcacctcttggaataattcaataataactcgactgaaggaggttatataggatgagaggaatttgctttgcagacataaccttgctacattttatgtgagggaaagaaagtggcctgacagtccatttttgcctgtgctcacagttattccttcaatggaaatcattcctttgcagcccctaccagtttcatctttgcattaggtggcaacctgcactgtgcccacacacttgaagtttttttgcttgaagtgattctcatgtcacagaagcccatgatttatgactttaatgtcaaattttttttttaatttcttcttgaacactttgtactgcccccacggtccccgtggtttttattcgaaatgcttctggcctgtttactaagcataatagttcatctatttacagaacattttgctttgtttctaaaaaaatgttgcaacatttgttttaaatggcaaactcagacttacctaaagaaagggtcaagtatctgggaagaggatgaatcaagcttttataacttgtatctatgggatagttaggttgcagattttagtagttgtaattgttcatataggaaggaaatccagatattgaaaaagttcaaactagttttctctgtgtattctccctactcttctctttgtttgtgacgactttgtttcttcatttgaggcaatttaactcaatatgattttgttgctaaaaagaaaaaatgttttgtctttaactttctattgggtaatgacttgtcttcctcaaaatgtttcttaaggtcccatctccatctcgtaaaggtgaaattactctgtcttttcaaggtcagtctacaaattagtaagatagcattagaacaaaggaatctattgtcttcctggtcttgtgataggcacttatttcaagttggctatatttatacatgattcatggagattatcgtaatgagagattataaaaatatcctcagataacacattttcacactttgaatagacagttttgattaattctgattatttttcttcttcaaatattattgttctcaagtagaattaccactgcattaaagtgaagaattggagtctctgaatgtccccatttctggatgaattctaagcttttcttcagatgacctaggtatatcattaatagtgaagatttcacataattttgtttgaccttcgaaaaataatagtttgaaagatagttttcaaattttattttattaggttgcaatatttagcattttaatttctgctcctgtggtcagcagaaaattctttctctatttaaagctaaatttaggacattttgtattttaaaaaaaggactattagaaataatatttattaaaactctagatagattgctatattatcaagcatatgagtcttattgttaggaaaacattgttcttcctttatagaataaactacttggataatatgtcttctgctcattgaatttttatttttatcttttgtagagatgtgggtcccattatgttgcccaggctggtctcaaactcctggccccaagagatcctcccacctctgcctctcaaaattctgggattacaggtgtaagccaccatgtgcagcctgctccttggttttttagaacaatagttatgagtacacagacaccatgcagaaacactttgcatggattgtctcctttacttttcataaccttacaagataactatttttagcccagtatattggttagaaagctgagatctagtggtatttagtaatctgattatcatcacttgggaaatagttgagtagaggtttgaccccttaactacctatcattgaggcacagtaatgcagttcataatttataatgccttcccagtagtttaagatgtaagtttcaactacaattaatgaattatcattgtaacctactgaattttatttcctgaatagtagtcaccttatcttactgtgattaggaagctatcatattgtagaagctcagttagttacttaattggaatcatcatcataaggtgtgtcatcatcataaggtatgtcatcatcatgaggtattatacactccctaaatattgtagtttataatctcttctatttgaaagaaaaaattgttatctatctttatttagatattctttactgaggaaagatgaccttgaaaagcctcctgaagttgtcatcttaatttttttttgagacagggtgtctatcacccagtctggggtacagtggtgcaatcatggctcactggagcctcaaactcctgggctcaagtgatcctcctgcctcagcctctctagtagctgggactccagagtagttgccaccatacctgactaattttttaaatttttttcttgagatggactctcactttgttgccaagtctggtctcaaactcctggctttaagcaatcctctcaccttggcttcttaaagcagtaggattacaggtatgaaccactgtgccctgccaatttatttttaatcactaattgagttaccattttaaaaaagtccagttacatttgaaaactataggtaatacacctggttggttagatttttagtcaatattagtggtagataattttttaggagaaacaaagaagcaaaaagcttttttggggggtgttatttctgaaggttgaacaactaacatagtaagctactgtacctgagtgaacgatgatagaagtgtagagcttttttcctctacagccatgattattaaactttgctaggtctgaaaatcatagactctttccccagaaaagttgacataggcacagcattttgtaaaagtgtcaagggagtcatagataactaatgaattttgattcctgccttggacttgggagagacagcataacaagtaagggtcttgcaaagatgtccaaggtggccactgatctcatgagatttagggacctcagtgacccttgaaccatgagatccaaaggtttttagatcagtgatctagagaggaagttaagtgttctgactttgagttatttttcttctgagtccaaatacctgcagggtgtggtatgcagccagtgccagtttggcttgcaaagacttcttgttggccaagtctccagcatttccaaatgctgttctcccatggatgtttttccagtgtcactggacatggtcaatcattaagacatccaaagaagacagtaaatggttcccacctagcacagttagctcatcatccagtaacttgtttttgcagttttttattttacaatctggcatagtattgacatccttgcactccaaaccagagctcattagaatgagttggcctttggtaaaattttccgtcaattaatttttttttgccatgaatttctttagtagaacagatttgttttttaaaatacgtagccttggttacttatccacttaaccctaccaatagggaatactccctggactctagacctggttcctgcttttctagtttccagtttgcatgtaaacatttaatgtatattcaaattcctagtggtcttctaatcttttgtctgtctctgttttctctttgctccaaactgtcttcccatactaatcttggtattttactaccaggttccttctctgctgaaacacattcagtgttgcatcaccacttacgtaagtaagtcaaaccagactgaatttatagaaattatctagtttgccctctttatcttacagacaaggagtagaacttccacagagatgatgctatgtgtctaagcagaagcaacttgctgtggagttctgatggtagaactgttcctactgtaccttactacctaccatttgacctccctagctcaacatttggagggtctctctcaaaggcagttttcctggaatatttcttatctcttaactggtctccctaacacattatgagctttcccatttctttgcctttgcataagacccttcctctatctagactgtcccactccctcgcatttagtattaatagaaattcatactcattcacataccatgcctaactaagcacttagtattttatatgagttattttatccttataaatccatcagctagattctatatgattcccatgtgacacatgtaaaaatttaggctgaagtagatgaagtgacttgcccaagacttctgagttagtaggtttcagggccaggatccaacctgagtggtctgtctccagaacctgtgctattaatccatacattaaattcactgcctctaaggagtattttccaagttgcaggccataggctccctctactctgtgaaactttccacagtgatatatatcagagaagcagaatttatttcatggttatctgtgctttctggaaggtgagtcaatatactacggggttgaatatttcctacccaaaatgcttgggaccaaaagtgtttcagatttcatttttttttttcagattttagaatatttgtggttttttctttttaatatactttcaactattatttttgattcagcagctacatttgaaggtttattacttgggtatattgtatgatgctgaggtttggggtatgattgatcccatcacccaggtagtgaacatggtacccaataggtagtttttttaaccctgtcttcctgcttcctatctagttgtccctggtatctattgttgccatctttatttccatgagtatgcagtgtttagtccccacttgtaagtgagaacatgcaatatttggttttctgttcctgtgttaattcactgacaatgatggcctccagctgcatccatattcctgcgaaagacatgattttattgtttttttttgtggctgcatagtattccatggtgtatatgtatcacattgtctttattcagtccattgttgataggcacataggtcgattccatgtctttctattgcgaatagtactgtgatgaacgtacaaatgcatgggtttatttggtagaaggacttattttggatatacacccagcaatgggattgctgggttgaatggtagttctgaattctttgagaaatccccaaatttctttccacagtggctgaacagtgtatatgcattcccttttctctgcagccacaccagcatctgttgttttttgacatttttttaaattatactttaagttctggggtacaagtgcagaacgtgcagtttgttacataggtatacacgtgccatggtggtttgctgcagccatcaacccctcacctacattaggtatttctcctagtgctatccttcgcctagccccccaatacccaacaggccctggtgtgtgatgtttccctccctgtgtccatgtgttctcattgttcaactcccacttatgagtgagaacatgtggtgtttggttttctgttgttgtgttagtttactgagaatgattgtttccagcttcatccatgtctctgcaaaggacatgaactcatcctttttatggctgcatattattccatgctgtatatgtgccacattttctttatccagtctatcactgatggacatttgggttggttccaagtctttgctattgtgaatagtgccgcaataaacatacgtgtgaatgtgtctttatagtagaatgatttataatcctttgtgtatatacccagtaatgggatcgctgggtcaaatggtatttctggttctagatccttgaggaatcgctacactatcttccacaatggttgaactaatttacactcccaccaacatgacagccattctaacccctatgagatggtgtcttattgtggttttgatttgcatttctctgttgattagtgaggttaagcaatttttcatatgtttcttggccccttgcatatcttcttttgagaaatgtctgtgtcttttgcttacttgttgtttatggggttattttttgcttgttgaattgtttaagttccttatagattctggatattagatctttgttggatgcatagtttacaaatattttcccccattctgtaggttgtctatttactctgttagtagtttcttttgctgtgtagtagctctttagtttaattagctcccaattgtcattttttgtttctgttggaattgcttttgaggacttagtcataaattattccccaaggccaatgtccagaatggtgtttactaagttttcttccagcatttttacagtgtggggccttacattttaatctttaattccttttgagttaatttttgtatgtgttgaatagtaggggtctagttccattcttctgcatatagctagccagttatcccagcaccatttattgaatagggagtcctttccctattgtgtatgtttgttgactctgtcaaagatgacatggcttgtatgcatgtagctttattttagatttcagattagagatgttcaatctgtataaatgcttagaaagtaatattaacacaataatttattaagcgaccacaaatatctacaacttgactttctaagttctcttccaaatgtaattagaaggaaaccaatgaaaaccaaggacgtaataatgggatactgcgctataggtagatgtgctgagccccagcacacaaagccagggtttgcatcctacctgcaccagttactcctaatgcgtgtaccttggggataccggttaacctctctgagtttccatgacctcatttgtaaaataagcttaatataatctctcatggggttgtggtagagactgtatatgaaaacttgttttaaattataaagcacgtttcaaaaacagtattatttttcagtctcaccagaaattgaatatcagtaaatcagcttaacgaataaattactttattattatacactgccctaccaccagtggtagaatgtagatttcagtgtttttatcagggaacttcctataagccttctttgaaccaatatttgtatataaattattcatgaaatggaattggtcaccatactctttacattttctttgctttttagacatatactcagatcccacactttctaaatactaatctagttgattgtatttttgtatttttaaaataatataaattatgcttaagaaagggctggattgttaagcagcttgtgttcagaatacctgccacttcttgctgcgtttttctatctggaatgcctttaatttacctggtttattcaaaatgagatagaatattgctgcttacttatcgctttcacatctgcaacaggtctgctctgtctttgtcactagggtttacataaaatgactagacgctttttcctttcaaagatgaggatgaagattaagaagagaaaagaaattatggaagcttggtggaaagtttgagaggaagaaagttaagtgtaaagaataagggagttaacgccaaaaataaatgaacaaaaatgccgtcatgtctggcagctcaggtgtgttttcaataagcagcaatggaatggacacggtggctcatgactgtaatcccagcattttgggaggccaaggcaggcagatcacttgaggccaggagtttgagaccagactggccaacatagcaaaaccccgtctctgctaaaaatacaaaaattagccaggtgtagtggtgcgtgcctgtaatcccagaggctgacacatgcgaggattccttaagcccaggaggtggaggttggagtgagccaggattgtgctactgcactccagcctgggtgacagagtgagactctgtaccaaaaaaagaaaaaaaaagcagcaatgattctaatattttatttagggtggtatgaagaaggttgatggtgaagattcacaagtggaaaatacccagaacaagtgcccagagggtgtagagtgtgaaaatatgtagtggagctaagagacaagggaggctcttctctccagggacctgagttctagtctagacttaacatgtgatggctgtgtgaccttagtcaaggcacttgaccccttctagcctcagtttcttcatctgttaaatagaggtaatatgtcagcgggatctgaggataaattgtaataatgcagcccaagcccatagtgagcacagtgcctagcacatagtaaatatttgatacgtgttagacactgttactattttatgattatgtgaacttagggaagaggaaccatactaagtgcctcagttcagagctgaaatgagtgtcaggtggcattactggaagtaggatggtagtaagcaccatgagatcagttactatcttagctcccatgtgactacttatgcccatgcctaaattcatttatcaataaattgttctcagattctagaagctattgacaagaccaagcagaatcatacagaaaatgttatggtaaacttgtgcgagatgacctagtctagcaaacatgcacatgatcttagctttctataaggaagataaagtttttagagacaaggtgaaggaaaaaataagtctacaaagcaagatagacccttgaagatgtaatggtgcaaaactactttttaatatatgttatcttaatacccaatggtctaagtcagttgttggctaaattattcatctgggaattttaatggtgacataagagaaggttgcggacagcaaagttggtacagtgtgtaggaaggaagagaacctagaactctgtaacttactagggttatatgcctccaaagtcagttgccggtatagctctcagtaaagaacatggattgagtgtttataatgtgtttggcacattcatctgtcttaattctaaatgaccatttgacataggtatcttgatcttcattgtataaatgagaggaaccaacatacagagtttagatttgtcccagattcctttgtcctaaacctattgcttattcacttatgccagaatgactgatgtaagtaagtcagacgttatttaaagccttcaaaagaacctaggcaaatatttgagacttctcaaatgttcagccgaaggtaagagaattaagttacatcacaaaatgaatctttctaaattatttcttataaagcatttgcatctcataagtagcattgtttttttgaagtttcactgatcattttttaggttcaacataaaatagttctcaaatttgggtgcacatcggaatcacctggaggacttgttaagtaagattcagtagctctggtatggcctgagaatatgcatttctgacagattccctattgctggcacatcactttgaggtccacattttgagaaccactgacataaaaagcatgtattttatgattaatcctatggaggaacaagtaggaaaatagtccttgaggggaattccaagatcacaggtggaagctgaaattcagatcatgtttccaaaactcagtaggttatacctagccaggcataactgaatttggagtctaaaagatctgtattatcacttttttattttgaaggatgccttttgattacagagggaaatcaaggattaaaaatcaatatacatgtaaatattgaaattcattggtaactttaaaaagcacaacagttttgtgtgcttttctccaaagcactacaaatatgattaattgatgtataagaattttcttatggaatttttttttttgtctctgtaggtggcaaatcttccaaaagactacatgataaccctcaaatatgtccccgggatggatgttttggtatgtaaactacatttctgagtttcattttagtagctcatagaagaaatgggatcattcatattgagatagtacactagctgctatttaggagcttgcttattgtcaggatttgaagaatttatctttggaatttgacttgcaggcttttttttccccctcttaagcaactgttaaactttatcagtgatcatttcagcacatatatcctagacctgtatagttgttcttcactatccttagggaattggttccaggacaccttccgaccctccatcctccccactcactccaccatcaggatacccaaatcctaggatgctcaagtcatttctatgaatggcatagtatttgcatataacctatgcacattcttctgtatactttatttttaaatttttatttttcaccatggaaggcacactggaactcctgtgtgttccaggagtttagttccaggaatttggaactaaattaaattatttctaaattaattctaaattaattctaatactgaatataatgcctatattacataaatcattgttatgctctgcttttaaaatttgctttatgttttcttattgtttgaatattttccatctttggttggttgaatccgtggatacagagggccatctgtacttccaaagtaaatacgattatcttctttagacctagccacagattttctcattttccttaagcatccccctaaaaaaggacttcagtgtaagtttatgtaaattctttttcatagctgacctacctcacttgtttaatttgaaagcacaatttgatttactagcagtgcaatagattcttagaaccttacaacaagtgtatgtgtttactattataagtactactctgttgctgaaaccaagaaattttaattatttttctcattacacagtatcagaattcatacattaagaaatatttcaagcatagagaataatgtaatatctgtatacctatcacagagcttatcaaaccttaccattgtgcaatatttgcttcaaatatatttttaataatgaaacattacaaatgtaactaatgccctatgtatgctccttctctgtcttcattaatccccagtttgtctcttagtggtaacacttattctgagctggactttttcattccaatgtgtgctttcagggcttgtaatgtggacagcattcactagtgttatgtagagcaggaggagcattctcttatatgtttactgcagtgtatgcacccatacataagacatggaactttttgaatatttaataattttatgttaagcttctatactttgaagttcgcttatatctttcaacatgctttgacaagttgttttatgttgactcatttcaactactgtactgtgtttcttgagtaaatttaaaaccatttgagttactctcttctctacaactctcatctttccataatctaccaaaacttattaaacatctactttgtgtaggttttgaccaatttttgtggatcagtccatcaaagttgttaccaatttaaacacatcattatgtgcttgtgcttaaaatgcatttcaaagactacaaggctgtcatttcaagagaatgtcaaagctacatttctttttattagtaagcattttagcatgaactacctaaagttttttttagaattccttagaacatgtatcttcatgttgaaccatttatcctcaagcctatgtcaatgtctatcctattgagttagggggagttctctggaaatagaaatggaaaattattagcagcctgaaagttaattaattttattatttggttactaagcaagtatttagttaggaaaaactaaccaggagccagcactttggcagacacttgaagaaacaaacacacaccaattaggcaatgatctttagttcaaaaagtttagtaattgggaaggcaggcaggggggattatgtggcctttttataacacttttccatttgcaaaatgatttcacatattaattttcttggctgattagaaaaactctgaggaaggtaaaatagctattatgattcctattttacaaatgatatattgagctttacagcgcaaaagtattttgcccaaggctatacaattagaacgtgacagagtcttaaaaagaaacccctaggtcatcagactcttaaccctgggttacggaaagtgaggatctatataattacaacacttagggaaagtgtttgaagggaagcctctaggtaataaagacccaccccagatccttcctgactgcagcagcatttaggattgtgattgccaagcacccaaagataacctgctgctctttgaaaaacaaatgctaaactgaaaacaactaaatagaattttttgtgctggtataatcatagaatatgctaaatcatagatttcaatgtcggcttgtgatagcaagagccaagcttgtgaaaataaagctgattcactgccacatattttgtgcttgtttctgtaattgagaaaaatctactattgattctggcatgctatactggcacaactggagaaacactgttcttcttggccaccaccatgggcaagaaaaacaaggccacgtttagagcattggacagaaccaggggtctcaccctttgttttaccttcattttgacatgttcgtttctgcgaagaccagaggagtttcccagtggggaggcctctgattatttgcgagtggtcagagtcccagctgccttatcttttgtctttaaacaatagagggtggagtgggaatgggtgccaaaaagattctctggtgccaaagcaataaaattctgcccatgggcactgggcagaagaaagctctagaatagaatacacttttatttttatttttattttgccttcattttaaaaaacagctaaattctcctagaaaagggagttcacttttccaaggtccttcttagaaaattacctagcagattctgtctcacaaatagcagggtgtgatcaaccacttagtatttaaatctaacgataatcaccaatgctattttaaactctttgaaactattatattgccggactgttgaaatttcctttaacttcctaaccttaaagaatacctggatatttctggtcttttacatttactggtaatgttattgtagaaagaataaaaatggcattgctgaattgttgccacacaccttcattcacttgaacttccatagcatttacataaacggggggttgcttgtaatatttgagtttaaaaatcttcatttttaaaaaaatttttttatttttagctattatggatacataagaagagttgtgtatatttatggggtacacgtgatattttgatgcaaccatacagtgtgtaatgatcaaatcagagtaactggaatattcatcagctcaactttacaatttctttgtgttaggaacattccaattccactcttttagttattttgaaacagacatttttattaactgtgccacctattttgctactgaacactggatcttattcgtttttcaatttttacttaaagtatatattcatcagttttcttttagttttttatttgcaaataattttaaatttacaaaaacgttgcaagaatatttaaagaacacccatgtgccgtttaatccagattcacctatttcaagtatttttaacattctgcctcatttgctttatcagttgctttctttctatgtatgcatgtgtgttttattatgtttctgaacttcttgaataagttgtatactgatgcatacatggccatttactcttaaatacttcagtgtgtatttcctatgtgaaggatattttcttacctaaacacagtacatttgcaacttcaacacattttacaataattatagtactttaatctaggtctgcatttcaatttagcttttttgtttttgtttttgttttttgttttttgcatttcttttccttcagtataagatcctatctaggattggaattttcattttgataccatgtaaataatgactcccaaagatgccttgttttgggaatatattacctgacatggcaaaaaggactttgcagatgtaattaaattaaggatttatagatggaaaagttattttggattatccaggtggtcccactctgatttacatgagttcttataaaagggaggcaggagtgtcagagccagagagggagatttgaaaatattacactgctggcttcaaagatggaagagggattcacaagccaaggaacgcacatggcctctgaaagctggaaaaggcaaagaaaatgatttttcctttacagcatccaaaagaaacacagccctaatgaataccttggtattagcctattcagacctattttaaacttctgacctccagaactgtaaaataacaaatttgtgctgctttaagccaccaagtttgtagtactttgttatagcagcaataataagctactacatcctgtctctctagtctcctttaagatttcctcaggctttctttgtctttatggcactgacatttttgaatgagacagtcctcccctttaagaaaagtgtttctctttgcaacatttgattgatgtttcttaatgcttctgtggagcttatgcaattcaagtgacaatgctacgaaagtgatgatttgtgctcaggtaaccacatccagaggcacacagagtccatcctctcctcatggtgctgtttgttttgatcatctggttaagatgttcaactgtttatgtatatttactcattcacaatttggggagagacactttaaggccatataagcaatccttctccttctcaaagtttctcccacagatttagcatctattgatgatacttacctgaaccaatctttgctatcattgtcagtttttcgttcagactttttaaaggcacagctaaatatggaagtgattggcagcatgtgatgccactctaacaataagccttccaaacttcttccctcttcagtacccttcctcaggtatgcacaatttcacttcttggctattctcatctttttttgcctggccctgttacttacctctgggctctttccattttctttgatacctgaggatttattatttgatgttttgattcttcctgaatagacagagtgatttaaaaagaaatacatccaatcatttcattcctgtttctttatattcattgaatggctttttgctgctcttaggaaacaggaaaaggagctgcttcaacaaggcctccaagactgtagtgatctagctgggcacagtggctcacgcctgtaatctcagcattttgggaggctgagacaggtggatcatgaggtcaggagatcgagaccatcctggttaacacagtgaaaccccgtctatactaaaaatacagaaaattagctgggcgtggtggcgggcgcctgtagtcccagctactcaggaggctgagacaggagaatggcgtgaacctgggaggtggagttttcagtgagccaagattgcaccactgcactccaggctgggtgacagagcgagactccgtctcaaaaaaaaaaaaaaaaaaaaaagactatactgatctggcacctttccacatcctttttcagtcctttatcgttatcgttaccagttccttgctgccacatagcttcttgcctggctttctctattcctggaatcctgattggttcttttgtctagctaacacctgattcttttagattttggttttgatttttgatgaaaccaaattgttctactggaaactcttctcatcgcactcctcagagtagcagttttggatgtatttgtgggatgatttaatagataatcttccaccaacctgtaaacttcacaaaggtaggaactatattctttttgctctgcattagattctcagtgcctcatggatgctcatatgcatttaatgaatatttgctgaaagaaagtgaagaaaggaaggaggaagaaaatttccctaccatataatcatttgtaatttccttgaggcacagatttgaacttagttcacaaggttataatgatgaggtgagtgcctataactcgtcacacagtatctgcactgcaacgttattatcttcttttagatacgtgtgaattttttgaaatattttaggtgtaagaattgtattatgcaattttggggaatcacagcttctttaagcctttggttctactgctttaattgagttatttttgcattcaagaacctgcttattgttcccatttactaaaggctgagagccagattcctgaacctaatgttcatgactctctgtaatccttccctaccctaaccaactcatctgaatacccattattccccaacacaaacttgccacctcagccacatgcatcactgcctcctaaaataatgcgcctgttctcaaaggatgccctttcttctcccatccacttatccaaattctacccatagaatcatgcaatatcttggggcttaacccatcttagtggtcatctcctccaaggtcagtttaagatttctctttcacacaaggacattttctgctctttcagcccacattttctctcccatgtatcatttgatcaggtgctactctgtgctgagtgttttgcttgatgctggagcttggtggtcagcaatactatcattgcacctgctatgtggaccctatcttttagtttattatcttgtgacttctatggaatttgtccagaagctattcatcttgggtacatgatcatatattgcttacatagagcttaatattttaagtgttatatatttgtctcaaagtattatcgtgagaaataattaaaatacaaaaaatatgagttgtggtgtgcatataataacatcagataccatcattattattttgttgttgtgttctctttttactatattttgactatctacagagcaaggttgaaatcttttactcctgtgtatctcctcaccattctttagacaatccaatgcatatagtcgctcctcaaaaaatagttatgaataaacatttaactcttggcaaaaatgctagatttccaaatcttgaaggagcccatcttattagtttagattcctgtggttttcactaatagtaaaagtcccattattataaggacactaaagaatagcatgtcacctaagggcatgggtgcaacaggccccatgaaaagactggaaccaggattggaaactatcagtttttccttctccatctctgaatctctgtttctccgcctcattctatttgtgcagatattttctcctttgttccagtcacttggtagaatgtaactgcccaagagctgccaggtttacatatttcaatttcagccctattcagagattaattatcagtttctaatgatcaataccaattttggggaggaacgttctggttggcctatccaagtcaggtgtctaccatcatccaaccaactatggctacagggcaagttcaccgtttgtaagcatggattctgaggctccactcctatgatgcggcattctctctataaaaatagacgtcagccaaatagacacttgtagtcaactatttatctgcctcgatctcccatgtaataagaaagtatttatttaaaaggaataagcataaaatgttagttgaatgaataaaatatgacattaaatgctattttaagtagttcttttgtatactgtactacagcacaggggcccgtcttcctaataagtgattatattaagatgctgttcagattatctaggccattattctctgatagaaatacaatggaagccacgttcataatcttaattgtctggtagcaacactaaaaaaaaaataaataaaaacgagcagctgaaattaagtataatgaaatttatttagccccatgtatccaaaatattgtcatttcaccttaaaatcaatataaaaattattaatggaatgttttatatgtttcatattattcaaaatccacagtgtgttttacatctgcaacatattacagttcatacactaaattttcattagaaatagttattccatatttagattttttaataaaatttaccattgagaagatagtcacatttctgtgttttccaaacatacttaaaagttccagcctctaaatagggtgatattattgacttttcaatttaaagaaattataattaagtaaaatgaaaattttagctctgcagtcacattcaatgcattttgagtgagaggagctgcagatggatagtgggattcccatattggccagcatcgattagaatttattttatagatggagaaactgaagccctgaatagattaaatgacttgcctgaaatcacaaagtgaattgacagagttgggactaaaaactgggcctctagttcatcgttgctgccctcactccccaaacccctgtgctgttccttcactgttctattttagggcgggcctaggggccatttataggtctgccctgggaaataacacatatttagagtgctttggttgattaccatcttaatcagattgagatttctacggcactttaattcaaacaagaaatgtaaagttagatgcctaaagtgaacactgaagacccaaattaattgtttagggagaggactaaaataaatcattacaaaacccagctaatccaaagagaagttaagatttcggagactacactggcaacatgaacatgcaatattttgcaaagtgcttttataggaaacttttaaatttgcctgcccatggaatgtttgagagtagaatgtcagctttctagccacaacgaaaaaaaccaaaagaacagtaaataaagtccacaaatggcaattgtcacaattcctcagagaaatttaccttcattggtatgactctggattaactgaaatgaaacagaaagaaccatttctattccaaagagatttcttaattgagccgaagaatcgtgtctggtccagacgtgagaccacatgggtcatagtgaattcagcagaaaaaaacacttcagttttatgtgctttcactattctcatggctactagaacaaaatgagtgatcgagagtcctggtttctcgcgtttctgtgtaaatttgttatgtaacctggaacgagacacttcactactctaagccttgattttcccgcttatacaattggtgagactggtcctcagtattccttctaggtctggaattctggtgattctgatgacatggctctagattttgattgcacatcccagaggtagatgctgaaagcacaaacagaaaggtacacttcgtgccctaggcatgcatacgtctaattccagcaagactgaagtttgacacgaattaaagaaagtaaaacaaaaacaaactgggtggtaatgctggtatttagattaatcagattagaaggctgggtgaatactccttatgaatattcttagaaacctcatagtttatgagccaggcttttcactctgagaatctctaattggtatttcaccaactcctgtgaaaagaacgttctcactgggtagatactagctttaggccctataagaaagaacatagatatctctctgtgaatagctaccaaattgaaagtaatgtaaagtgcttcagtgaagaagtgttacagtattattttgtctactttcagcttcttaatccgtaaatcttaccgtgactgctcttaaagactgtctgtggggtgggcgcggtggctcactcctgtaatcccagcactttgggaaaccgagatgggtggatcacctggagtcaggacttcaagattagcctagccaacatggtgaaatcccatctctactaaaaaaacaaaagttagctgggcgtggtggcagatgcccgtaatcccaactactcaggaggctgaagcaggagaatcgcttgaacccaggaggcagaggttgcagtgagctgagaccacgccattgcactccagcgtgggcgagaagagcaagactgtctcaaaaaaaaaaaaaaaaaagactgtgcatctaataccaatgtggaataatgtgtcaaattatttcacctaataaaccagcacagtttcttgaatgaggcaggagatagagaggagaaagcatgccagaattagcaagtctccaggatgattttaaaacacatggtttatttcagccggtttctcaaatttactggttctggaactacagagattctgtgtcacatattctgtggaattaatatattaccttttaaaaatttatgcttagtcttagaatgtgcatatatttctgttgttggtctttggaaacagtcatattcctagttatgtttagaatacttttaattttattcattttaaattatatattttatttaatcatttagtgagatcatgatttggtgttcatggtactttaaaattcctaaggaagttcacagtttttgactgaattgtcagtggtagtgagatgctagcagtccaatatcattgagtcaatatcattgagtcagtttggattctagaataataacatgttataagtacatagggatagaaagcacatgtttttagtagtcctagctagagctgctataattaaccaagaaaacataagacagaagctatcaagaaagaaggtaagaaattgagagcatggagtcaagaaaaaagtttttacactcaaagcagaatctatatgtttcttcttttggaaacaatacatacaggcgaataaagcatcaaattacatgcacatcaggaatttaaaagcaatcatttgtgtcacctttgacatcctgtatgactgtcaattttcttaatcctttatattttctagtgaaagagagaacattatatcttactttcttctaatgaatatcattgagtaaatatttatataaaactatttaagtttaaaatatctctgaaaaataagaaacagtgataatatcatttattaaggcaaacaaaaagtacgtttgtaaatttgacaatctttaatcatttatttcataatcataatcgtggaggaattgaaaaacagaaagacctgctattacctcacaaatgaaatacttagttcattgtgttttattctccttgcaaatcattgacgatatttaattaaaaattacaaaactgctagacattccagtcaaaactagtttcctctcttacaagcaggcagatcaaaactgactgacatttaatattatttgtttaccttcattttatctttaataaactcaagaatcttaaaaagccaatatatacatggttaaacaaattactgaaaaatagaactttgaatttatgattcagccttttccaaagaaacaatagcacaagcaaaaataaaaaatgagtgaaacatgattacaagtgttttagaaatacacgatttttcagctgtgtaggcacgtagtttatatcaactatcaacaaattgttcatgactttagaagggcaaacattagagtaggattagattgtggaatttccatggtttaactctaagaaagcacaggattggggttggaaattttactggaaagagttgattgtttagactgttgatttagttatgtgaaaatgggaggaggtagggtaatagctaaataggaactagaatataaaatgtaaacatagagttcggttgaaaatagtgatcaacagaagtggcagtaagtaccccagaattcctcagcttaaaaataagaaacaaatcaacaaaacattttctactttaaccacaaaaaaaaagcaaaatgaacaaagtacccattcatataagacaactaccacagaaactaaaggaatgtcttaattcaaaacaaggaatttgattttggttcttacttgccagagatcctaggcaagcatactcataaagtgaggaaatagagtcctaagagattaatacctggaatttcattgttagaaaaatttgcacaatttcaacggaatgaattggtgaaagctactctatcacataaatactattcaaatagcaatttacagtgtatgctgtgttccatatcctaggaaatctgttcattgttgatagggctgacggtctataaggaattatcactccctaaaaggaaagaaacttgcagagcaattcagcatccaaggaaagactgacagctttgaaagagacctgataatgatgcaagtaggaacttgcatgtgcttgaagtaagcactgatttaacaaaacaaagactctgttctgcacatactttggaaacacatattctttgagaacttggttatgacgagttgaaatggccacttgaactaaattcccatgttgagatttgtttatccttcttatctgaagccagagccaacaatcctaaaagttttgagtgacatttaatggttccaggaattggggcttacctatctgcagataaacctgcttcctttttggctgtattatattaagtaaaacagttctgttaaatgaatataaagtggtcccttctatactttagaataaataaatgacttgagccagatgcagtgactcacgcctctaatcccagcattttagaatgctgaggagggaggattgcttgaggccaggagttcaagagcagcctgagcagcaaagcaagatcccatttatataaaaaaattaaaaattagccacacttggtagcatgcgccttgtagtgccagctacttgggaggctgaagtgggaagatcacttgggcccaggaattcaacattgcagtgaaccatgattgcacccctgcactacagcccaggactcagagagagagcctgtctctgtaaaaaattaaagcataaataaataaataaataaataaaaggcttgacttttcccacagagatattctgctggtaaatagagaaataaagcttagtagtttgatttattttccatgacatcagttactctgagtacaatatttttgttacaagttgtattaaattatttgtgcttttaatgagccaattcaatgttattcttaataacaatgttatttttgtcactgcagcatttcagcagtgttcaaaatacatcagagtttccacttaaaagatctttataagagaaaagataacacattaaaatcatataaagcatgcaaacttacaacctcctcctcctgttacaagagtccctcctcctattacaatagtccctcctcctcctgtcacactagtcccttctcttcctgttacaataacccctgtcctcctattacaacattttaagtaatgtaatattaattttaaaaatctggccaggcacggtggttcatgcttgtaatcccagcacattgggaagctgagacgggtggatcatttgaggtcaggaagtttgagacagcctggccaacatggtgaaacttcctctctactaaaaataaaaaagtagccaggcatggtggcaggcacttgtaatctgagctactcgagaggctgaggcaggagaatcacttgagtaactaaaacgatagctttgaagagtactccgagttttatggcacttacttattaaaatagctgttttgtctcttttttcatatcttgcagccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggtaactttgtgttcattgggattatttttcattacgcttctctaaaaacccatgcttcttggtgctgttggggaaaatgaggcacctttatttatgatattttgattgtataaacttcaaatttaaaaatcttgttcagatgagcaaagaaaacaagtatttgcagttatactgcaatactgaagtgcacattcaaacttaaatgttgtcatctaatacaaaaataaaacttatttacattacaatgcaaaatcagtcctgcctttatctttattcttcataagtgaagtccttgaaacctttctattaagttacaagtgttcatttaaatggaaaattgtctgtaataaacacatatccttttatgcataatgtaatcaccccataggtcacagcaaaggaatacattttggctcctcaaagtcattggataactgatcatcaccaacttcaggatatgggcatgacatatggaataggcaatgtactccagaaaataagagtgagatattggagtttaaattctggctctgtcgctaatgagttctgtgagcgtaacttctttgtacctcactttctttatctttaaaatgggggcaatgccagaattcatctaacagggtcgacgttaggttatttgccatgagtactttaacaccctacctagcaaaataaatattaataaaatttgatgttttttcatcacactgtgtctatagcaaaatcatgcttaggagacctgatttggtatacagttcaaatggccaaagattagcttaggagacttatgtaagtttaaattcaaagttttaagcaggattctgtaccttaatacctaaatgctttttcctgtgtcccatctaaattccagctattctgtaagacccaacttcaatcccatttgtactatcctatcttataattcttaccatactaataatccaatcactacctttaatctttgtattattttctaatttccaaagtcagaatgtggtgttaaccactctttcatattactactgcatatagtgtgccaatggcattcaaaagaagtagagatcacaaaaagtagagtgcatcacacaaggtgtcacaaaggaaataacatgtgcattagagccttaaagatgagttaggtaaatgagttaggtcaatggtgatgttgggaagaacactgcaaacaacaaagaatgtgcatttactaatcatggcactttggtgggaacccaggagattaccaattatatttctcagttgttttggagattgagttactgtatataaagcacttagaatagtccatagtaagtaacagatagttgtttattttggttacctacttttctttataatccattatgtatccctacaacatagctttgatttgctttggggaattttatattaattttatatcaattaatcataccatttttattattttgggacttgcctctttcactcagctttaggtttagaagatgtatccactttaaagcatatagctgtagttaaccttctcttgaattgaactccactaattcaatatatcactagttattaagccactctgtctggattgacataagtgatacagatattgctgcaaaaaaacttttttatatgtctgatggtatatatgtgcaatagtttcagtaggttatttacctgagaatggaatttctgagtcacaggatggtcacatgtctaactttactggataatatcaaatgtaccaacttacattatctcagcagtatgtaagagttcccttgccaatatttagtatcatctgactttctaatttttggatattagagcatgcattatggtgtggttttttttttttttttctaaagactggaagttcttgtaatggaggggtcttttaaaaataaaccctcatgtttttaatgagcatctctaaagaaaaatatccccagcttgtttttaaggttatttattttattttattttttgccatgacattgtgttcactgccccagattcaacttgtgatcccactgggatcactaccctgcattaccaatctgaattacatacgttaaaacagccatctaaaagtgctagttgtaagagtctaaatacttgaatctttgagagacatatttatagtccattatcttcacctcagttaagtctgaagactatttgaaaaatgtaatcctattttttcttctaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaaggtaagacatgtaagcatttccagttcaaatgtaaacaacaaacttaaatcttccctatgtagtaagaatctacctctgtgttaagctgtagcaagatacatgcatgtacgtctaataaaaaagcagatatcaatagcacagaagaaactaatgattgtagatttgtgggtttctaacccaaagcaatattcatcagtttcaaattagtgagctgtttgtgagtaaacaatatatgagatggccactcataccttttctcatctaatatttgccagtaattacaattatattattctgtacctccagtctacttaatggtccttctcaaattttttcttaaggatctaactctaagtcacaaattctgatcctccccagttactctgtattaagactcttttttcccttcactgggtccctataatacaaacctggattcattgctttctttttttaatgagaaattaccatcaatgtgtcattatttgtatttattaacatatttattcaataagtatttgttctacaaggtgataatggtggatttcttagtaaaatagaatagcaggacccagtatgaaataaataggatctgaatactctagatttgggaagcagacctggcaagtaatctggtattgcacttcacctttcagggactctataactcatacaaatcaccatataacactgacacattattgctttctatttagattccagagtcagtgtcacaaaaccatttatgttaccccctgttgcagccagctcccttaggaatgacagcagtagcagtaatagtaagtacatatatctgatttaatgcatgcatggctccaattagcacctataggagtattgcatgggctttcaaggaaacttctacatttattattattgatactgttctgttactgttattccttttatggtcttcttgagacttaagtttgtagaattaaatttccctagagctggagataatgtttagagaattaggccaataaattttctgctgaggttattttaaataagacataaaattaattttagaaatatgatttatgccttttgttgaatcattaacatatattctgtgtggaatgtgtctgacaaaaacggaagtttaaaattaagtgtataaatgctggttgttaacatatattctgtgtggaatgtgtctgacaaaaacggaagtttaattgtataaatgctggttgtatagaattccaaagatattttcagatttgtgtatatcagtatttactattgcgcatttggaaatttgatgattttgttattttaccacagaattatatgcttgatgagaataggcttatttttctgaaatttctgtcctcttttgccaagaacccaattttctttgaaaatccagacaaaggtcattataaagtttattgtatttactaaatactctctagcctcatggaaggtgcaggaagaataaaaaccatcttgtgatctaggctaaaaaagtcatcccttaggacttataaatggggcactgtcatttgttcagggacttagaagacctatctgtgaaaagaagtaatcaatttattactaattcataatagcttgttacaatgcagaacatttaaaaaaactctaaaatacaatttacttattttggaattttttgccaccaaaacctgacctgaagtgatttgaggctatttatagtctatttatctttctaaaagtgaatatatattttactaatgaaatattaatgtatttgattacagaatgctacccaggattcactggggatagtatatgttatacattatgtgcaggacagaatcttctgaaacctaaaattctaaattacgtagcatatcagttctaaaatgtgtcaaaaagggactagagccctgtttgtgtgttagtcaattaagggttttcttaccaactatggattttattaacattttcaaaggagcaacttttgtcttcttaaattctctgcttatatttcattgatttctaatctttattatttccttccatttgctttgtgtttcatttactccactttttctagcttttcgaagtggaaaaattagatcattgattttaaactatttttgctaattacaagcacttaaaggtataaattttcttaaatacactgctttagctgcacctcacacatttttgtgttgtgattttattatttttctaaatatttgtcaactgtgatttcttctttgattcatggataatataaaagtgcgttgtttgatgtcaaaaagtttgagattttcctatatatcttattgttactagtctatgaattttgttgtcagaaaacatactctataatttttttgaaatgtactgaaactattttatgtatgttatttaactgttgaatgcagcattcaaatttggccaaaatggttgatagtgttgtttatatcttcccttccttattaagctttttgtctaatttttattaattattgagaaaagggaattgaaaatattaacttttgattgtggatttgtctgattttccatctggttttgggttttttgcttcatatattttaaagctttattattatgggcttatacattgattattgttagatcttccctgtttaattgaccttttaatcttactgaaatatccctcattatctctgatagtgctttttgtcttgaagtttattttgtctgatattagagcaaatctttcttatgcttactgttttcatggtatatgtttggctttcctttattttcagtctgttgtctgtatttttaaagtacatctctggtagacaacatacacttgggcttcactattttatttagtgtatctctgattgttaattagagtgcttcatccatttctatgtaataaatcattggtatagttggattttaatccaccatttccttacttgttttttatctgtcccatttgtgtattgaccttctgttccttatttctagccctttttttttggttaattattttttttctagtgtttaattagtgttggattttcaacagcacccttttgcattattttgtggttattttggaaattaaagtatacactttaacttgtaatattctacttagagttactattgtagcacttgagaaaaaaatgcaagaaccttgaaacagggtagttttatttacccatacccatcttttgtgtcatcattgacatatattaacatatctacatcagttataaatttcacaatacagtctacaatacacaatgcagttcaattatttctttgaactgtcatacgtattttaaagtaagagaataagaaatatattgtcttttatattaacctgcatatttattatttcctgtacccttcattccctcttgtcagtccaggtttccatttggtattaatttccttcaggctgaaaaacattctatagcatctcttataatacagatctgctggcaacaaattcttttttctttttaattggaaaatatctttgttttgtcttccatgtagcaggtactttttactagatattgaagtctgggtacacaggattttttttcttttagtcttttaaaaatatcactatagtattcctgcagttattgtttctgaaaaaaataaaaaaggtagccaccatttgtcttatttttaccctgtatgtacagggtcatttcttcctctgcgttctttcaaagtgttctcctttttaacatttgagctagaatatgcctatgagtggttttctttgtatttatctttcttgagatttgtcaagcttttggatctatatatttgttttccctcaaatttggggaaaaaatagtcataaatttttcaaattttttaatccattttatctatcctctcattctgagatactacttgcatatatgttagcagattgctagtgtgtcataggtcgcagaagttttgttcatttatttatcctcttttctctgtgttcttctgagtaatttctacttgtctgctttcaagttcattgaccttttgttctgccatctctgatctgctgaatttttcatccagtgaattattctatttatgaatttatattttctgttctagaatgtccagttaattgtttaatgtatttcatatttctctgctggaattttccatctgcatactcattatgaaaaaaaattcttttttgtcacttaaatataatagctgctctaaagttcttgtctccaaatttcaacacataggtcatctcagagttgatgtctattgacttcttcctctctgattaggggtcacatttccttttaaatggttagtgattgtttaatatatgctggatattatgaattctatgctgttgaatatctttcagattctatagcgtttctttagaggctattgaattgtgttttggtaggaggttcgaatagtagcagatgaggtttatcttttctcccagccttgtttttaaactttcttgggcacaagggaaagtagccttattcctaaggcatggaatatctgagatatctgtaaagtgctcagaaaatctctccaatattgcttgtcttaataattttgtccccattgttctgtgtctgctagggcctctactaagattatagcttcccatgagtttggtgtttggttatttttttttattataattttattttttggtcaggttttgtgacttctctactggtgcatatacagcttattattggaccagtaacttaaggagattcatctagggatttctgatgctccttctttgcacagctcccttcttccaaataacctagatctagaaactccagctgcatcggcagccctgaacttcaatctctgactccctagcttagtgaggccattggtccttgtttgaactctgtcttccacacctcaatctgaaagtgcaccccagacaggagagctgaaagccagaaaaccagggcaaacatgagcctcacttagtgtggatgccctgtctcgtgaattacacatttgtactgctgttcactaatttctgaaaagagttgcctcataatttgtctagaattataattacttaggttggaaaggctagtctgctaccatcgtatttggaaacaaaagtctttcctactaattttaaaagacaaactaaatataaaatacctattcaatcccgtgcctctgaatctgagattactttttaaattgcaagatgaatggacagccttcttttttgttcactgtttcttttttcttcctttttaaaaaattttgagtcttgcattgtcagcaacttttagctaggtgatgtcactcatgaatatgccacttagatacctctgcacaggacaagattttgtggtgctaacattcagagagaaacagacgtaaataaaatactcatagtacagtatacaatatgtatcataatagaattatgcaaatgtttttaggtgtagcacaaagggggtaagacttttttgggagaagggttagggaaatttgaagaaagcatgctagttttcagggataactcaaaagctggccatgtcagagtaccagggcatatgaaaacttattacagagatgtgagtgtgtaaggaaaagtcatgggagaatggaataacatacaaacctattagttatccaaagggaattatgtttatagcataacagtaatatcctttatgataagcaaagagaatgtttaaaagatgttttatgtttgagattcttgcagacagtacctaaatgatagagaaagaaatcctaactttgacattatcttatacattttctagaaatagtcttgacccaaccttcctggactcatataccagtcaagttaaactcttttgactcttcggtcaaatggaagatcataatacctccttcacagagtttctgtgagttttaagtgagttagtacacatgtgcttggagacataactgatgtcttataagagttcatcattaagtactagaacaatgagatgcaataagactttggatcagtaattatgttgaacctttagtgagctctggatctgaatcaaggaagaatactcatttgcttgtttcataagcaccaagataaccatgtcacaggcatggtgctcctaaaaatgctcactctaaaaagaagttcagcaaaattatagcacaattctttgtgttctatatttctacagatgttggttattattagtcaaatgaaacaagtcagttcccaagatttctggacagtgaatagttttggtaataaggagatataattaatatggtaataacccaggaatttgggattactcaaatccggcccagatgagcttcctctccacataaattctctgcaggctatctttgcataaaatcaaaactttgttgtcagcttaagttttgtccccaaatacccttcatttgggccttgaggcatgcaattcaaatctcattgattcctactcgatagctgcagtggaaagtattgaaagtcattccctggaggtataagcaaatctcttctgataaagttctttttgtctgcctgcaagagggacagtagtatccctgatggaccaaaggcctggttcttaagccccacgcatgaacaagtgaaataaaaaaagtgaggtaacattgacctctatgggaggtgaagctcagtaacctatgggcgcttcccccaaccctcctctccactgccgccccgccatccagtctttgctgtttctctccctccctgtctcctgcaggaagattgctgctgtgtcttagtcagactccaggattgtgtattggctcacagtcttagggatggaactgtcaacatggtagtcaccgcactctcagagagcaagtctgagctttctttagtaaggcctcccacacagctttgttggaagccccttccttagatgctatccttctgcctgagaaaggttttaggtagcaaattccagaatatctcactctttagtaagctgctttttgcttttgagtctggtctttcctttggtctgagtggtgaatttcaagacttaggtttggtctttgtatagaacaagaagaacatggtgtttggctaccttgattacagggcatctggctgacccaacgtagataatggagttctccatagcatcttcctagcttgttagagttttccattggattttaaggacaaaatcttaattaatttatttgttctctctgtgtacattgattatggcctcttaaggaggttacctagtaaatctattgtaattacataccagcaatcccaatagataatgggggccacagcagattggccttcaaggagaaccaaaacagccaaatgatttatttacaaacagtattattaaaattcctcaaatggtgcgaattgtttgtaaccctgaatccatttcatatagagagcacttttatagatagtagttaaatcccaaacgagtccacgtaatcttacataatccttaaaatagctctgttattgtaatgatagtactttaattataccaaatcccattttattactcagatttattttggtgagaaaattcacattgggctccaacttgagatggtaaaacatatctcccatggggctataggatgtggggtgggccaggaggaggaatcctaaggaggatattcatggttatgtgaatggaagaccctatttctgacaactccctacgtggggatcaccagcaccttattgttcatccctcactgtctcctcccccaacacacacacacacacacacacacacacgtgagcacacatccatacatcccatcattagagtctccttggaaacataccatttataggatgagggaatttcctgctctcagttcacatatggtagaggaatgggctgttcctgtcctcaccatagtagataaaatctatttctgacttatcaagttaaatctatgaattaatttttccctgtaagatgttgatacacacatagtagatctattattttatattatgtactctaggtactttgtatgttaaataggtataggtatatagaaaaatctgtcaaaataagtttcatgttggaagagacccttgtgggagatgtgttttgtttatttaattcgtgaatcattctgctccttttttttttttaaagacagagtcttgctctgttgcccaggctggagtgcagtgacatgatctcggctcattacgacttccgcctcccgggttcatgcgattctcctgcctcagcctccgtagtagccgggattacaggcatgcgccaccacacccagctaatttttgtatttttagtagagacggggttttaccgtgttggctgggctggtcttgaactctggatctcaggtgatctgcttgactcggcctcccaaagtgctgggattacaggggtgagccaccacatccaacctaaattcatgaatcattttgcttctcatggaagagccaggcaggatcaagaaaggtgtcccaaaccaattccatatatgttctctctcattgagtttcttatttagacgtagtatgggacaacactagtgccttcaaccattccccttagtgttagtcttaagctttccaacattaaaagtccaaactcttagtccgttgcacagtggcatccgacaaatgtgtgttgaagatatgaacgtggaaacagccatgattctaagcatgagatacctaaaaatactataaccacagtgcacatacaattatttaatattttcaacagtccaaacatagctgaatgcatacagatcttgatccaggttgtaaaatgtcatgtttaaaatttctgagcaagctgtcaagagtgagaaagcaaaaagattttagaagataaaggcatgggagatagatttgcttgatagtataagtcattttccccccagaaatatattaagtctgtgttccatatgtgtcagaattacccaagccagatctctttctgtctctgtgatttctttcttttttaatgcattcatcttttggagactacatggatttatattgccttgcaaaagcaatattcagcagaaaaatcaatcttttgaatactttaaacagatataggtccagaatgtgttacagaaacagttaaaaacaaccacagcataagagcaaaacttctagaatggatatgctgtattcatcagtgtgttctttaaattatagggaaggccaaaaatccccctggagactccagcctacactgggcagccatggcattgccagcattgttttctcttataattggctttgcttttggagccttatactggaaggtaagtggtaccattcctttttttaaaaatatgctatgtttacataaattatcatctttttttcctcaagaaatgatcctttaagaaaacagtgaattctaccttagcttataatctaaacaaaatttaaattttataaagtttcctgtttctcattatgtctggagacaatccctctagctgataattcacgcttaagaattaggaactggtgttaatagcctgaactaaatatgaaaaggaagatctgacgaaaatcatatgatatacttaaaagacaaatagaaatgtcatttgtattatctgctattttggatttctactcttttgttctcttcttattgaagcctgtctaaaattttaaaatgtgcaaaaatcattgtgactcagcttcttgaaatgtcttttgaatttgattaagtgtcagcttctttattactctttagcccccaacatcctaaaaatgttgagttgatagtaccatgcagctttcataattttttattacaaagatattttgcatgctacatgctgaaaaaactgttattggagttattgccataaaagataaaagtggagtccacttacctcttaaatattagaccattcattgattattttacagtatatgtctttcttctttttccagaagagacagccaagtcttacaagggcagttgaaaatatacaaattaatgaagaggataatgagataaggtattttgttttgctaaatgtgtgcccaatcaagcatgacattgccatttcacacactgtgtacctgcccataatgtctttaagaagtccttcactcatgacagtagctcctaaccagtgagtcccaactctatccatgtttctgatgtctcactctctcttcagtgctgcatctccatttacctacagaataccttcacataattgtcttcatgactcttcttagggtttgtaaaggggttacctctgctttcttatttaagtaaggcagcagaatcttctcagactcctggttgtggaactctggaggcacatttgctcatgttctgtcttttccacacttttatcaaaacatactgattcagctcttggagcgtcttcctaagcttagttctttcagtaggaagcattatcatcactgacatctttatgatctcatgagttgctgccactgatcttttctttagcccttctaaactcaacctttagtcacactcttctgtaaaccctggttcatagtgtgacttcttattcaaaatacgttcagtgattttctcttgtatattttatatatcttttattttactctggctttcagagcccttaactattctcaacatactcgttgttttctctaaagctgaatacaaaatttgctgtaagatgactttccattcactgtagctggctcttgtcattctttcaccttaccctatactgcccagcactcatatgttcccttacctttgattataattttcatttggtgtgttgccttctctcatgtcatgcctgtatgtatacacagacacatatgaaatgcatataggcatgcttggtatgtgtatatgcatatacagagaaagaaatgttttaactacttggaaagactaccttaagacaaatgaagtcttccctcttccctatagtaataagaaggtaggctccccattcaattttgcaatcttctgctactatatttacagaaaagctgccttttacaatgccgagatcatggtgtacctcagaatctctgaccaagagcaaataagcattttttcttattgtttttcagtatgttgcaagagaaagagagagagtttcaagaagtgtaattgtggcttgtatcaacactgttactttcgtacattggtaagtttttttcttctttcctttttttttcttttttttattatactttaagttctagggtacatgtgcacaatgtgcaggtttgttacgtatgtttacatgtgccatgttggtgtgctgcacccattaactcgtcatttacattaggtatatctcctaatgctatcccttccccctccccccaccccatgacaggctccattgtgtggtgttccctaccctgtgtccaagtgttctcattgttcaattcccacctatgagtgagaacacgcagtgtttggttttctgtccttgcgatagtttgctcagaatgatggtttccagcctcagtcatacatgtgcatgtgtctttagagcagcatgatttataattttataatcctttgggtatatacccagtaatgggatgcctgggtcaaatggtgtttctagttctagatccctgaggaatcaccacactgacttccacaatggttgaactactttacagtcccaccaacagtgtaaaagtgttcctatttctccacatcctctgcagcacctgttgtttcctgactttttaatgatcaccattctaactggtgtgagatggttatctcattgtggttttgatttgcatttctctgatggccagtgatgatgagcattttttcacgtgtctgttggctgcataaatatcttcttttgagaagtgtctgttcatatccttcgcccactttttgatggggttgtttgattttttcttgtaaatttgtttaagttctttgcagattctggatattagtcctttgtcagatgggtagattgtaaaaattttaattcaaactgaaatatttagcaagaactatacagcatatgagatgccaaagtttagaaacaaacttcattagtaagtcttctatcaagcagatgtcagtatgttggctgaagctgttacataattgaaatgtgcatatctaattcattgtgtattctccagttttgaaaggtaagcagtgtttgtcctgactagtggattcatctagtgtgggatatgcacaaaaattaacagttgtatgtttacttagactgtttttgagaccagaaaattaattagacaagggaaatatagcaaattaggactaaaattaagtattactaatagaataaaaatatatggaatcaattttatttaggtgtgaccactataacatgactgtatcccatgtgttagatgctgaaacaagagaaaaccagaatgtttccctgccattttcaggaaaaagagaaaacatccaaatatcttagagtcaggagagtaagattttccaggtcaattgccaccttccacatgactagtaataattatgcattataatagttcagagcccaggatgcacggaacataaacgcatggcagacaggtgctgtgactgtgtgggtctgcggagggattgtgggagaaaggagagtaagatgtggctagaaggtactggtatcattatctcctgtcccgtctgctttctctgctcccttgctgcagatactgttgcgggaagacccacagctgcattaacttaatcagtattgattcatgctgtccctcacttttgcttctgctaattggctgttatttttgttactggcatggaatcctgagagcatttaccacagttgcatgcgaatattctctcctctttcaaattcctcatttcttctgtgcattccctcattgtcaaaggattatttactctcctctttattacctagatagtctgtggtggattccttctttaccctgcaagtcactgcccttccagctttaactcctgtcccaggttcagagatttgtctctagacttaatcttcttcagtggaactgagtcataaattatcttgcctcctgtatgagcttacttttatggttatacagcaacattttttaacaactcaagataacatgatataattatgttgcacatttctctaacactgtaatactttattctacacactctgtcacttttaccttcaatcatactcttgattaacatgtccgtagcatgaatagcaccctctattttctgctgcccattgccacttctttctaggctcattcttcctgtcaaataatgtaaatggatagaccgtttgcttgacactttttattttccgaagcaatatttcccaagctgaaaccatgctttttcctagaaattcatttttttgcctttgaaccataagatgagattcactgttttctttttttttttccttccttttcttcttcttgacagccatttcagttctctcaagtggcattcacaaaccacacattaaatggttaattgagtcttaaatgctcaaatgctcaagtaatgtcctctgttgtttggtttgggattgcattgctgggatcctgttttggcacacaggtctttaatcatgtggttttaattacgacattcgtcccatgacatttgggagtggattaggatacggaaacccaggccatttgtttaggaggaaaaaagatggtattttaaagcaaccatagtcaaacaacttatgaatgtgttgaatagtcagttagcattccaagaaaagagttaggtctttctgtttcttgctgtaccctcaacacctaacttgctgcccgtgcattgttggctctctataaatgtttgttgaatgagagactgagtgagtgactcagccctaaatgaaagtttaagcaaatggcaaagaagattgttcttctgaagtagggtttgtttttatcttttgtgtgaatgtgtgtatttaatgtattgggttggattaatgagacagcaaggtatgcatatcaagggggaatataatcacatgagaaattaactaataaattatttttcttaaggtatgaattattactcatgtataaaatgaatcacattagccaggttaaagaagccagaattatccagaaaaaaacccagctcacttattcagtagtcaatgggaaatagatggcagaatgaatgaaaacatgactcattctccttcacaaagtgccttactcgtcatctctgcaaagctccaccaaggctcaggtcacatactgccacctacaaaaacctgacttcccaaatgaaaataatctctatttctggccctctaaatagatttcatatgacacttggtaggacatcacagtcacctaaatgaacattttgtgcccttttcaaaaccataaactcttagggggcaggatttttttttcttaatttagttttggagccccactaaacaatgtcacttatactgtgcacatataaatgatgaataactatttgttgaataaattaatggaaagatgaatgaatatctcagaattacaataagatgagaataaaatatatgaaaataaaaacagaaataaacttgtatgtgtctatgagtacataagaattcaaatgctgagggaaaagtaggaaaagaggtagaaaagggccagttcgtcctcagaatctgaaaaccccaaagtaaaaatgtgtgtatatcatttgtaatcatctattgactacccattatatgaagtaaacccttacatttggccttctaccagcagagatggaaaaccctccaaggaactcttaagtctagttcctagataggtgtgtagtagagggaaggtctgggagaacaaactgtgatgtggttggagagaaaatcttctaaaaaataagaataaccgtagtaaaaaatgccaagacagaaataaaatgtggagttgcaattatacatttaaaaaatagatataatttggattataatcattttcttggttaacaaggaaggggaaaaatacaaggaatgactcaggtttatggcaaggatttctccctgaaatggaagtttcaccaactaaaacaaattaaatcaagacaaatattggaacactagaatagagaacatatgggctagttctcttaaggaaataacctataattggaaaatgaaaagaaggagggtttaatatcttaactacaaggaacaaacgtggaaggaatgtattgaactagaaacaacaacaaaaaaagttgcacctaggaataaataggccaggagtggtagctcattcctgtaatcccagtaccttggggggctgaggtgggaggatcacttgagcccaggagttcgagaccagcctgggaaacataggaagaccccatctctacaaataatttaaaaattgggtgggcatagtggtatgcacctatggtctcagctactcaggaggctgaggcaggaggattgcctgagcccgagaggttgaggctgtaataagccatgatcaaatcacagcattccaacctgggtgatagagcaaggcctggtctcaaaatataaaaataaaaaattaactgaagtgtgtttatttgacaccatgcgtgagaacagctatgtgaaaagttaaaaatttacttggtcacatagcttatgccaaatatccatagtagcatcctacaaaaacctttttcatattgggttgtggatagcaaagattaagatagataaataaaacagatggattacattaaaaactttatgttaatacgttacaggaaacttttgctctttactcttcccacaaatgtgattccaacaaactctagcaggtgcattgatggatgcaaagcttaatataactttgttgtgtcctcaaattgtttatagcctacaaaaggaaatcagacatatacataataaccaatttttaaaagtgaactaaaagtttacagagttactttgatcaaagtccaggcctctgcatatgttcatacaagttgtgaattcaacacagttctagatactggaatgaatgacatattagaattgagcacacccaaatacagttacctatttttgaaaggagagagaaatcactaacaataggagaaaagcttcactttgtaagtggtggaggtagcatctgtactgagcacatggcgtaaactaagtcagtatagtcccaaagtagaaactgtgttcaagggtcagtttggacagttggattccagtggaagtcacatataaagagttaaatgctgagaagaaagggtgagcatcggtttgagaaagggtttgaattccaggaatggggcttaaatgccttgtgtcacataaggaggtattgggagaaaatggtgtaggaaagatgtgggtgacaatcaaagctgaggtgtgagaaaactaatcgggtgttggtatggcaagatgtacgggagtggttaactagagaaattgagtccacttaccaggccagtctttaaataagatgtgagagagaatgacaactgaattagcatcagggccaggaaataagaaagcatagaccatttgaagacattgcagtaaaagaatcaacaaatcctagttactaatgggatgtgagacttggcatcacaggcagaactcaagaatgatttggagactatgggacttaccagagtgcggtggcattaacaggaaatggaaaatcaggagaagaagctgttggtaaatattattgaaactaaccagtggccaaatatgttagactggaacttcagataacagtcaggcctggaaagaatgatttgcaatttgagagttatctgcaaagaatcttatttgagaccttgaaagagaaattgcttagtcacagaaatggccccgtgtggttgatagtaaatagcatgggtttgattgtggagaggttcactaaagaaatacaaacaaaattttggtatatctgagctaagggggaagaaaataaatcttagaattggaataaaggacaagctgaagacaagcttggaaatttaggcctcaaggcttggcaatggttggttaccaaatagcaagacctgtgattctttgctagatgtttcctaagactttcaaagctttgggagtttggtttctgtagatacattgtaaagcagatgattagaaaggattaggcttggattcaagccttgactctttggtgtagaatactagatgaatttatatcagttatcagttcatgtcttttaaaccctggtttttcatgtgtaatgagggttagtgataaatgtactcttcttatttcacaagggttcttgcaagaacccaggttatcattataaaaattgtagttttgttctatgggaaaacaggtgccagtctttacgtttattttctttgctaagtgacccggggacaaaaatcaaaaatagatttccaatcttctctacatttaattctctctctctctctttctttcttgagagtctttctttcttaagagtcttgctctgtagcccaggctggagtgcagtggcgtgatctcagctcactgcaacctccgcctcctgggttgaagggggttttgtgcctcacccccagagtagctgggactacagatgtgcactaacacacccagctaatttttgtatttttagtagagacagggtttcaccatgttggccaggctggtctcaaactcctgacttcagatgatccgcctacctcagcctctcaaagtgctgggattacaggtgtgagccaccatgcctgtcctatatttaattctctatattaagctttgtgtttccaattatttatacatttaaaaaatacatccttttgctttttgtgattcccttttgctttctaaccatgcttttaaaatatcttctatatattttggatttctgaagttttatcttagtatctcttaatttttgttctagatttaattctgatttcctaaatacaggttgtctagcttctagagttctctgcttggtaaattgttgtataagacagtttttaatatattacatttagagagactggaaaaatattgcaattcttattacactatggaattttatggctaatctgtgtaatgatctcaatactttaaaaacagtgatctgtgatgctgggttgataaacaaggacaaaagtagtgaaagagattgagcagagaagacgagaaatgcaaaacacatttatttagagactgggattgaagatgggatgataccatctatatgtattttttttaagtagagaaggaaatacaaatactttactggaaagttgaaacatctgaaagctagtagattaacacaagtactgaataactaaaacaaaatatggctttcatgcttcaacaagtacaataagctatgctgaggccaaacgaactttccccagaactttgttgggatgcggtgccaagattacagtctttctttttttggttggaagtattgaacgaaatctttctgctgctatttcctcagctggaagaaatgattgctagaacctaactagatagtcaagatactagagcggctcagtggccatgtgaggctattacttgttggtggccattgaccagcttctccacctgtcttagggatctctttcatgctactccatctatctccatttctctaatctccactctccagacactttgttcgtcaatccttctcccttcacccctgtttactaccttttataatcttgctagagaaattcaaagctaactaagttgataattatattatcacaaactgagatcattggtagaatgtcaggaggtatgaaagtcacagggtgaaatatttattgagtgtctattaagtgccagacattattataagagtggaggtacagcagtaaaagagatagagaagctccctgccctcatggagcttacattttaatgggaggacatagataataaacaaaaagtaagattgtttcagataatgtgttaccaaggagatcatagaaaatgactgatcactgcatctaagaaaatatttatgaagttcttttctgctatataagtgaagcatacattgcaaatttgttactcattctgtggtcatatatgatttcggctattgagatttttaaaaaggcagaaggcagatacaccataatctctcttttcttccttcctttctaggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgcaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctagaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatcccactatacaaatgcaaatggttgcctggttccatttatgcaagggagccagtactgaattatgccttggcagaggggagactccaaaagagtcatcgcaggaagaagttaagaacactgaacatcagaacagtctgccaagaaggacattggcatcctgggaaagtccgccttttcccttgaccactatagggtgtataaatcgtgtttgcaaaatgtgttatgatgtgtttatattctaaaactattacagagctatgtaaagggacttaggagaaaatgctgaatgtaagatggtcccatttcaatttccaccatgggagagcctaaaaataaattatgacatttagtatctaaggttagaaaaccacgcccacatgctaatatgggtgttgaaaactaggttacttataatgcaaggaatcaggaaactttagttatttatagtataatcaccattatctgtttaaaggatccatttagttaaaatcgggcactctatattcattaaggtttatgaattaaaaagaaagctttatgtagttatgcatgtcagtttgctatttaaaatgtgtgacagtgtttgtcatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtgataacattattgccatgttctacaaccgtaagatgacagttttcaatgtagtgacacaaaagggcatgaaaaactaactgctagctttcctttcatttcaaaagtccaagaatttctagtatatttggattttagcttctgttcaaagcaaatccagatgcaactccagtaagtggcctttgctcttttttgtaccaaagagcccagatgattcctacagtccctttcttctctaacatgctgtggttccttaaatatgagtaatttctctaagatataacccaggtgctttgagaagctgcattaaggtgttcaggccctcagatatcacatggtacacttgattagtaataaaaccagagatcaatttaaattgctgataggtcctgtctcagtgtgtggcattgactgttttcaggaaaatagatacagattaatatgagttatgcgtgtaggttgtgtatagattgagaagatagatacttctcaatctagtagtttgatttatttaaccaatggtttcagtttgcttgagcatatgaaaatcctgcttaatgtgcttaagagtataataaatgtgtacttttgtcctcaaacctagtagctgggttttaacactcatggacatggtcttaatcaatggagttaaataaacaaattcagcaagttattaaatctgacatggtaggagaggggagatgtgtcctgcttattaaatgtgttggtccattgaaagttacatggattgccaatttttaaaacactaaagttgaataaaatgcatgaacaatagaaaaatgctgaacattattttggatgctagctgcttggacattaactgtgttatttctgctttgagatgaaaatatatatttatctttgcttattttatcccagatgtgttctgaatatccttcttcataaatcatggaaaactcactgctgag

SEQ ID NO: 15263 - DNA, 87629 bp, Human; identical to SEQ ID NO: 15262

SEQ ID NO: 15264 - DNA, 87629 bp, Human; identical to SEQ ID NO: 15262

SEQ ID NO: 15265 - DNA, 87629 bp, Human; identical to SEQ ID NO: 15262

SEQ ID NO: 15266 - DNA, 8226 bp, Human
  misc_feature (1)...(8226): n = A,T,C or G
agggcacagcaataagcaagacagatcagtctctgaccccaagagctccagtggagaccacaagataattaaggagaaattaaacagataaagaaggagtacagaatggggactgcagggaggctgcagagtgagggatgtgagagggagcgtgggttttcagagggtgaccagggaagactttctgaggctgtgtgaagagtcaggaggcagcagtgcaggggaccagtgctggacagcaagctcagccagtgtggcctggggcaatggcctggtggtccgagacagcagaggctggatcagctgggggtgtgaggagaaggaggtctcctggattgcgtgccagttgcaaggagaagctactgaaggactccataaagaggactgatatggtctgatttacccatttaaacacacagacacacacagacgcacgctgctatatagagaatggaggaagggggaactgaaatcctacagtaaagagatgctggtaccctggacaaggggcagggtggggggtgggggcataagaaaaaggggacagatcaggacacattttagacatagattcaacagactgaatgttttttatctgaggatccgagttgactgcgaggtcactgccagagacatcgacttttgggagagggaaaggtttggctgaccgcaaaacctcctttaggaacaaattaggtgtgaggttagtttgttatattattttctctttcaggacataggcaaagatgaagagaatcaaatcataaaaggcgtttaatgttaacattttccaaaattgtgcatgttctagctatccctttaatgtctgggcattttgataccctgtgagtggctggcaaactctatcattagtgtacacggtgagaggtttgctgaaagctatatgcccccgtttctctacctgttgcaggggaagtgttcgtgggagaaaaacttcgcggcctcatactgtgaaggggtaggttgagatggccacgggggttctcagattctccaccagcgtctcctcgctgaccccggccttcctaggcttccttcccgcgtccctgcctgccaggaaggtcccctgtagcttgcagagaccatggtagacagagcagttgtatctgcgccagccagagaccacctgggcaagaagcgtgacccagacatcgaggagggtgaagcctcgctgggccgccccgcaaccccaggaagccccggaccagcgagaggctcccgggcggtctcttgccgacaccccggcacgggctcacccgcgcgctcacactccgcccgctccccgctaagggactgggttcgctccaaaggcagaggaaacctatgggctccccggctcgtgtctcccgactcgtgtctcttgcctccgcttcccagctttcccgaccctgcccggacggggtttcggggttccctgctcgggccccgcgcgctcccctcccacaggctggctgggctccgggcgcggcgggaggcagcggggacgtgagaccggggtcgccccacacgccctccgcgcccctcgggccgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggccgggcggacacactggcggggccggggcctggccgtcccaccgccgtctgccccccgcgccggggccgggcccagacgcacttcctcaatcctgaggcgggcgggcggggagggcggcgcgaagagcgcgcagagcaaggccgccgccagctctcccaggaacggtcgcgaggcgtcccctcggcggccgcctcagtttccctggccgtaaaacgcgggcgatggcgctcgatgccccgggagacgccggggtccgcgggcccttccggcaccgggtcctccttcaggttcgggcacccggctgcctccacgcggggcgagcgcggcgatgggatcggtccgtgctgcgctcagccccgctttcgctatccctctgctccaggggcagcaaaatcagcagatgagcccccagcgcgcctgcggcccacacactgcggccgtaacagttaaacagacggggaacattcatgtgcgtagagctcttcacggggcgatacagaaatgtgtcgttctaaagcgttaacgacctgcaatttgcatatcctccaacacatggattttactgattcaattatggatgtgtgcaaagaatctgctgctcggtgagtcattgttaattgtcggctttggggggaatacataaaacgtggaatattggcaatttatcgtgtttcgaccttttataaaggcgtcaccaggctgctgaggctaatacagaaacgcagaccataaaaaagatctgcgtccacgctgcaggcgggcctcacgctgagctccccgtgtcgacccggggacaaagcctgctcaggaagagcagagggttccacgccctgcaggaccagcgccctgggcccctctcctggaaagttatgactcgcacgttcccaggatttagcgcacatctcccccaccctcactgccatttcacagaacccgggcagccgcagggctcctgcaggacctcccggacgccgcggggccgtgttcccttgagcggcttcttgggtccctggttggagaggggaccaccgagcagcttcgctctgctcctgggaggctacttctgccactggacgactttccaaaagggtgagcgcagttctgcaatcctgttctcacccctgagggcctcacaccagtttgcaggagccagcagtgtgattgccaccgacaagttcccagcaatttgcagggcgtggtgtcctcagtgctgagagagccccgcgacggcggtgcagctcctccagggcgcgcagccccgccacctggcgccaccgcgagggagcgcaggcccagggcccgggcagacgctggaggggacgcggcaggtgaagatggggcacctccacttcccttctaaaggagcctgggaataggctaggaaatgtccccactgtagaagacagcaggaacatctgacacgcggataacctgtgctgagctcgttatattcccagcatttaattctagccattaggcatgcgttagccacagcttcgcataggaaggttattgcaggtaagttaagactcctttccacttcttcctaagggtcgctgacccatggttctctagcttttgctggtaatcccacccggattctcagcaccctaggttggaatgacccctcctgaggcgggtggggtagctgggaggcacctccctgaactgacttttctgcctttttgaaggtgcagtggctgagcgctccttcagtgttttccggttgtctttcttcagcccagtacgcagtttcctcagacagtcttccttgagcaacttcctaaacgcccttcattatcccccttcaagctcatgcctaggagcaaggagcaaagccattagaaaggcttcatccaccagcaggagaagctaggacatcccaaagggtccacttctagagaggtgccaacccccacacgcacaccaggcacacaaatgcatgtgtgcacacgcataccacaccctccaattgtccccagaatggctcccttcagggagtcatgttccgggacaccaaatgagggaaaatatccttctcctacagtttcctgctcacatttggattgagaaatgggatgtctctaaataatgtgtctaaattctcttaacataagtgcatatgttacgagagatctgatcccagcctcccttttttgttaaagtggtggtgctttgccacccatgtcaaaatgatctgggctttccacatcaaatgcaagggatgagcttggaggacataccccagtaccagcaatgatcttgagccaatggcagcgtcagctcacaacggggtgattgaggcttcttggttagaagctttagaaacttgaggtcagtaaaacccaaattgatcctttctctagatcctctagatttctctagaggaaaaggtgacaaaaacagacacttgtgctcaccgtcaggggcacaatgctgtccgtcaatcctcatgcagtcctccccaccatttcgcacactgacaccatcactactttatgataaaaggagactcaggcagcttagataacagctgaaactcagccagctatgacatggaacctctgaggcccagctccttgcctggtcaacccccaagcccacagaaatgggtttcacactcaggcaaagcactgggcccgactgactgagcaaatgtaattttatgcttacattattgatcctgctttaatatcagccatttcgtacaggtctcagaaagagaaaggcctgccatcgaattcaaatgactttggtctttaaatgaaaaagcacaatgtttctcaaatatccaattttattttatcattctcgcattgtgggatgcaatctgcagctaggatcggaattcccaggcctatagatttttaaaccacaccacaggggtaaaccttaaaagaagtgaaacctaacactatatatatttccatttctaaatacagtatattacagaagtttaaatataccacctctgtgtacttacaactataaaaagatacaataactctaccaattataaataatgtagcatttcatattaaagacattatcgtacaatggaagaataggaaccctctaacgtatcactatcaaggttagtgtctatatctacttgagataaaatactgaaaattcagtgtatgaagccaaatcctgatttaacaagttattggtagtataagtgataagtgttagctgatgaagggaaggcaaatgtggtaatttatatctctgacaagggtgataggcccattttatacatggttttcgttatacacacactggttctgttatgggccctcattttattattgccctccccaacttaatttgcaaacttaagcactactttcccaattaggaaagtactagttagtaaccataaaagtatccgtcggataacacatttgtttttgtttttgaagctatatgggaacactttcagtttcccaagttaaaacatgaaattgcacatcatcatttggatccccaaagaggaaaagaaaaattcacaacctgccagtgaaatactcaggccacttggatgaagaccgaggtcctccatagaatccaggtgttatttactaactaatcagaaattaatatcaaaataggacttaaaaataacaaggctgtgttattacagcagtctttccagttgtgtacgctttactaatctaaattgggtaacagaactggagaaaaggaagactacacagacttatcataagctgttagtgaacgtgatagaaatgcgtaatttgttaaagtgaattacagctctgatttgtcaaatgaggaggtgaattatcctaggatttgctatgctgttgtggcgttagaagattggatctttagcagcaaaggtaacctcaacaatattttctgcttaagaaagtgccttggttaaggtagaccgtgatatcgtctttgactaagctctctgggctattgattctgtcatattccaaaggcagtattggtttgaagccgaatctcacggtcaatgtcaacatgcaatccacaaagaccctggcgcccttccacggtatgcactaaccaaaactttctcactgtgaaatcctttttttaaaaacaaaaaaacaaaaaacaaaaaccaaaaaaccttactgtgaatcctttcccaaggaatggtcccaccttcacctcggaaagaggcgtggcttgctctgtaagcaggtccaccctgaggagaccgctggtgcaagagccctgcttgcagaacacacagggggttttcccacattcttactggagtcagattcggcaaagcatttcaagcaactgctggacacttcaaataccactccctgttaacaacgccctgagtatctcactgtctccaggatctggtttaaagggaaacacagaaatggccaacagctccctccccaggcaggactgcgatttcacagacaacctataggcatccccagtctggtgaataaacaggagagtgagaggaaaacagcaatcattcaactccagtagatgtaaagcctccagaagaatgtgtcccgggaaggtcagaaatgtcatttttttcctccagcacatttcatctgccacattccgccgtccgatgtttgaggaaggagccccgcctttccttcaggggttcttgtcgccaagtttgatggtgacagttttcacttctgtgtattcggccaaagcgtattcacctctgtgatcacagaaaagaggaaaattcaaaatgggtacatcccttagccattgtgtagaaactgttctgaggcttcatcattccatcaggccgttggaggcttatgcaaaaggttaaaatgtgacgacctcatggaataatagccaggactataacagcactagtaagtgtcagtagctgcatatgtgacttaaatgtaaatatcaaggtcttcttctgtgtgatgcttttgaaatggccaggactaagggtttccctttagagaatgaaggggattttaaaaaaagtaaagaggtgaattccctggggtggcaatagagagcaaaacgagagagcctggtggacggtggggtgtctgtgaacgagggaggggcagaaattacactgggttgataacttttagatggcaattgggagctgcttgaagaggagacagaagaggcagaggcccaaagctattggctggggatgtggccagaggaccagtgggaagaacaccaagggcctgaagctggcctcagagtgcacagctggggaccagctgtcaggcagtgaggccagcctagggggcatgagggaagcagacgttagcacagagtggacatggggaggccacagcttttgggttcacatccttggtatagttcctttctttaaatcttgcagggctcaggtgatccttccctggcaccatgggccgtcttcagggtagcttcccttccaagacccaagaggcagctttggagagatttaaatccttctaagcgcttgatctgctgtcaggtgaagaaaaatgtgtgcttgtttaggaagagatgaaggtagaggtggccactggagtctctgtagttaaaaagacctgtgacagaatcccatctcctcccttagatcaatggttctcaaagtgtggtccccagaccagcagcatcagcctcacctctgaacttgctagaaatgtagattctcaggcctcccccagccctactatcgtaggcagaataaggatctccccaggtatccaaaattggatcccccaaacctgtgaatatgttgggctacagagtgaagaattaatgttgcagatggaattcaagttactaatcaattgactttaaaagagggagactctcctggatcatccaggcagacccagtgtaatcacaagggtccccaaaactggcagaagaagagaggcagagcaaaatgagattatagaaacaggttcagagagcagcagtgctggctttgaagatggaggatggggccaccagcctaggaatgcgagcagcctctagaggatggaaaaggcaaggaagtagattctctcctgagaacctccaaaaaggaatgaagcccttgattttagctcagggagacctgtgtcagatttttatcctacagaactataagataatagatttatgttatttaagccactgatgttatggtaacttcttgcaggagcaataaaagactaataaacttactgaatcagaaactctatggtggggcccagacatctgtattttaacaagtcctccaagtgattctgatgcatactcaagttggagaaccactggcttagaactatgttgcttaggtaagttctttgccttccctgagcctcaacttcatcaactatcaaataggaaaaccatcacctccttgtaattataacaattacagataatcatgtagagcccctactatgtgttaggcagaaaatgaatggtaggtgccat

SEQ ID NO: 15267 - DNA, 19974 bp, Human
  misc_feature (1)...(19974): n = A,T,C or G
tgagtaaaattagtcttgacaaaataaaacatgatcattaaaaaaaagtaagaggccaggtgcagtggctcacgcctgtaatcccagcactttggggaggctgaggcgggcagatcacttgaggtcaggagttcgagaccagcctggccaacatggtgaaaccccatctctactaaaaatacaaaaacttagccggatgtggtgcctgcacctgtaatcccagctacttgggaggccgaggcaagagaatcgcttgaaaacaggaggaggagggtgcagtaagctgagactgtgccattgcactccagctagagcgtcgcagcgagactccatctcaaaaaaattaaaatttaaattaaaaaaaacgcattcagggccaggcgcagtggctcatgcctgtaattccagcactttgggaggctgaggtggacagatcacgaggtcaggagttcgagaccaacctggccaacatggggatactctgtctctgctaaaaatacaaaaattagccaggcatggtggcacgcacctgcagtcccagctactcgagaggctgaggcaggagaatcttgaacccaggaggcagaggttgtgtgagccaagatggcgccactgcactccagcctgggtgacagagcaggactctgtctcaaaaaaaagaaagaaagaaagaaagaaatgtattcagtagagccaacctagacggaaagattattttatgtagaaggtttgaagagatgtgtatttgccttctaaaaccataaactaaaattatcatgagcccagagctaatccatatagaattagaccccaccccaggagagaaatagcttaaacatactgatctcgtggatgatattggacttttaagatgggtgaagggaatcgaaacctctggtcacagtcgcctgaaagaacatcccactgtgacactatgttatcagtggaagcactcacgagtttatgaccatctcggctccagctgaggaaaaaaaaggggtaatttagcacatattctaagtatatcataccactctcatgaataaactgtgtaagtcacacacattgctgcaactgcacaggtcaacaatgtttttggttttgttccacgtatactcaaatccataagcttttccaactaggcaattaataagaaggttttcatgacattttactatctagtaatggaagctcataatatttcaagataaaactataaagtgactcagtgaaataagagattaaaacatcttagaagagtctaaaaaatcagctgcgctttaagagttgatatatttgaactttctgaagtcatctcagaagtagcaccatcatggtataaacaaaacaaaaaaatgataagtatctgttatttaaaataattttaaaagaactgagaaagaattaattcctcctggtaagtacagataaacacactggacataatatataaaacagacaaaaaaggttctgaaaggtagacaaaggacaggcaagccagagactgtagaatcttaaggatgacacagtagtgaaatccctgaattttctgcctcatgttccccgttctgggtgaaggagaagccaacaacctggtaatgccagtgggcacgcataaaaagccccaagaagagctaagggaccagaaaaggacagcccagcaagacagaaaactttaagacaataaccaacctacgccagccaaacatcacagaaaagaaatgcaaatccccctcttagccaggttgaagcagatagcctagacttcacctttatccagctataacaaggcaccctccccacctcactggggtggtgtcagagaaggatcagtagagaatcagatttgcattaccaccagcagtaatgaggtcgcaccaccatggtgtcagagaaggacacatagagagaaggaacaaggaattcctatccttcccagacaggatgttatcagcagagacctagtggagagcctaaacttccaatcccacccagcagtaatgaggccaagtaagaagaaacctggactttcacccacctctggcaataacaagatggtacactccatttccctgtgcagtatcagaggaggcctgctaaactaaaagatttaaataacatctataggacgggcgcaatggctcacacctgtaatcccagcactttgggaggccaaggcaggcaaatcacttgaggcccagagtttgagaccagcctggccgacatggtgaaactccgttgtctactaaaaatacaaaaaattagccgggcatggtggtgtgcacctgtagtcccagctactcgggaggcttgaggcaggagaatcacttgaacctgggaggcagaagttgcagtgacccaagatggcgccactgggctccagcctaggcaacagagtgagactctgtctcaagaaaaagtaaaaaataaataagatctacagtctcataatacccaaaatgcccaggtttcaactgaaaatcacttgtcaactcaagaacaaagaaaatctcaactcgaataagaaaagacaatcaatagacactaatacagaaatgacataaatgttagaattatctgacaaggattataatgcagccatcataaaaatgcttcaacaattatgaacatgcctgaaacagatggggaaaaaagcccagaaaatcttagcaaagaaacagaagatacagagaagaaccaaatgggaattttagaactgaaaaatatagtaacagaaataaactcaatagatgaattcagcagccaatggaggaaaaaaagggaaagaattagcaaactggaagatggaataaaaattaccatagacatatatatatatgtgtctgtgtgtatatatgtnnnnnnnnnnnnnnnnnnnnnnnnnnnnnnnnnnnnnnnnnnnnnnnnnnnnnnnnnnnnnnnnnnnnnnnnnnnnnnnnatacacacagagcctcagagacctgtagaactataacaaaagatgtaatattcatgtcatcagaatcctggaaggagagaatacagactgggatgttaaggttatttgaagaaataatggctgaaaatttcctaaatctggcaagagatacaaaacctacagattcaagaacatcaactaggatgagcccaaagaaatccactccgagaaatacaaacttctgaaaactaaagacaatgaaaaaatcttgaaagctgcaagagaaaaatgatgccttatctataggggaacaacaatatgaatgaaaagggatttctcatcagaaaccatgaaggccagaaggaagtggcacatttttcaagcactgaaagaaaagaactgtcattccaggaataaacgggtaaactgagacacttgttgctagcagacatactctaaagaatggctacataatgttcggaaaagattaaaggaagggtttagaacatcaggaaggaagaatgaacaatgaaaagagtataaatatatgggtagataaaattactttttctaagccaggtgcggtggctcacgcctataatcccagtactttgggaggccaaggtaggtggatcacctgaggttggcagttggagaccagcctggccaacatgctgaaaacccgtctctactaaaaatacaaaaattagccaggcatggtagcacatgcctataatcccagctacttgggagcctgaggctaaagaatcgcttgaaaccaggaggcagaggttgcagtgagccgagatcgcgctattgcactccagcctgggtaacaagagcaaaaattgtctcaaaaaaaaaaaaaaaaaggcaggcgctgtggctcacgcctgtaatcccagcactttaggaggtcaaggcgggcggatcatgaggtcaagagatcgagaccatcctggtcaacatggtgaaacccggtctctactaaaaatacaaaaattagctgggtgtggtagtgcacgcctgtagtcccagctactcgggaggctgaggctggagaatcacttgaacttgggaggcggaggttgcagtgagcagatatcgcagcattgcactccagcctgggtgacagagcatgaatccgtctcaaaaaaaaaaaaaattactttttctcttcttgagttttgatgtttgaaacacacattttaacactgtcttatgtgggtgtcaatgtatgtagagcaaatatttaagacaattatattacacacaagaaaggacaaggggacaacaggaaggtaaggtttctacacttcacttgaactggtaaaatgttcaccaatacaacttatcaccagtagactgtggtaagttataaatgtatgatgtaaaacctagtaaccactaaagctacacaagggtatacactcaaaaaacactacagataaagcaaaatggaattctaaaaacttgtccaagtagcccacaggaaggcaggaaacaaaaacaaaaaacaaatggaacaagtaaaaaagtaacccaaaaccgatactttacccaggttttgaaatcaagaggaggtgctattgagaaactcagcaggcaatataatctccatggttaagaatatggctcaaaagtcagacttctactcaagcctagacattactacctcctagctgtgtgatcttagcacgttacttaagctttatgggcttcaatttcctcatctataacacaggaataaaaacggtatcgacctgcagaaggctgttgaaagaatttaatacatacagaattcttggcttggcacataataagtactcaatgcctgatacataataagtgctcaatgcctggtacataataagtgctcaaaaaattatttatatcagagacaaaataaatatactgccagactcaggactctaggaacagaggaagacaggggtaagctaaggttataaatatagagggattaagttaaagcctgcacacaaaaggactctgtgtgtctcttctaccgggtctagaatacctgtagtcaggcaatcagtgagtccttctagagaatgtcaactctaaagaggcctaaaggtgttaaaatgcaaaggtgcacaataaaaaagccaatagctggatgatgatgatgataggagggtaaaagggtggatgatgggagggtaaagggtaagttaaaattcaaatacactgtaacaggaaacccaatttctgaaattaacaaaccaagaaaaagcaatacacattatatcagaaatatgaagctaaacagcagaagaaatagcccccaaaaatagaagtctactgggaatggcacaagactgagagtgaggagaaaaaaggaacaggtttcgttgctattcttgtaggcctgttagcacaatttgactatagaacaaaatgttagctatgattctattttccctctaaactcttctgtactagggggtgggtggggtaaaaaaaaaagaaaaaaaacctactgctactgcactataatttttgttttctttcacagcaagcttgtatttctgtcataatggagggaaatctaactaaaaattaagttataaacaaaagtaaaaactaaaaaaaaatttattcttcaattccaaattccataacctcaagaattaggaattatactttttcacagcttctttcccaaaaacagatgggtctttactgattccaatgtgctaaagtctacctatggcccccatccagtgcttgaatttcttctgcagcatcctaacaaggggggtggcaagctcaggcaggaacagctctcagatagctctctcctgggcagtcaatcccacccacagcacctctgcttgggagctcctctctacttggagttaactttgtttccctatagctaacttctgttcactacctactagttctgttttgttttttgggttttttttttccgagacagggtctcgctctgtcgcccaggcagatcccggctcaccgcaacctccatatgccggttcaagcgattctcctgcctcagcctcccgagtagctgggattacaggcgcatgtcaccgcacccagctaatttttgtatttttagtagagacggagtttcaccatgttgtccaggctggtctcgaactcctgacctcaagtgattggtgagcctcggcctctgaaagtgctgggattacaggcatgagccaccgtgcccagccagtacctaccagttctgcttctacatcctgggccattttttctctctttcatacatcaactttactaatagttgaagtcagctatcatgcctacctaaaacttcccttggtaaaatttgttccctaatatgctcaaataaggaacagttaaatctatgatgcatgtatactgtgcaatactctatagacacaactatataaaataaggagacacagagaaatatccactatatgctaagtggaaaagcaagctacagaacaaaatatatttatttttgtttaaaaacatattatgtggatatatgtattaattatttcccacataaaaagatatagatatcttatagatagaatatattccacactctttaacagtggttaccctaagaagtagacaaagggctttcattttttactttgcatatttatatattcttttttaggtgtttaaaatatttttaaatggccaagcacggtggctcactactgtaatcttggcactttgggaggccaaggcaggcagatcacctgaggtcgggaggtcaagactggcctggccaacatggtgaaaccccacctctactaaaaatacaaaacttagccgggcgtggtggcctgcttctgtaatcccagctactcaggaggctgaggcaggagaatcacttgaatctgggaggcggaggttgcagtgagccgagatcgtgccactgcactccagcctgggtgacagagcaagactctgtctcgaaaaaatttaaaaaaaacaaaaaacttttaaataatcaagtataggttttgtgattttaaaatattaaaaatgttggagggaggggttgaaaaatctcttactttatatcctttgactgactaataacacttctggaagtctactgtaatgagaactcatagaccaaatgccctttgggcatctcagatgcttattgggacatttcccattcatccgacaagtatctgaatggctactgtatatcaggtacaacgctagaagctgagaacatagcagtgaaatggcacacaaggtttgtactcaaacagcacttaagatcttacagggaagatactctaacacaaatatttgcaataaactaacatgaaaataataggagacatgcaaccataatctcaaactcaccacttccccctcaaatcttccattaatgagtatcttcaaccaagccagaaacctaagaattatcttaacttctccatttcactcacaccccaatcaaattaatgactaagtcctcttatttctaccatttctcacatctgtctaacttggctcctttcttactgcaacactcattatctccagcctagaccacagcagttctcctatgttcacttactgttgccccttcaatctcttttctacttgttgctttgaagatctttctaaaataaaagctcatcatgtgactttcctgccaaaatcttttaatgacttcagagtacatatgagctaggaatcaaattcctgagtatggcagacgaggttctccatgaggaccttggtttaccttggctcttgtcatatcgtatgtcccataccacaatccagctatcctgatacctgtagttccccattgtaccatacttgtttcaagctgatatgccttggcctgtgcagtgccctctgcttggaatatatctggcaacatctacttatcttacaaatttaaagttataaattatctggctgggcatggaggctcacacctgcaatcctaacagtttgggaggccaaggcaagcagattacctgaggtcagtagttcaagaccagcctggccaacatggcaaaacactgtctctactaaaaatacaaaaatcagccggtcatggtggtgtgcacctgtaattccagctactcaggaggttgaggcaggagaattgcctgaacccgggaggtggaggttgcagtgagccgagatcgcaccactgcattccagcctgggcaacagagcaagactctgtctcaaaaaaattaaaataaaatacagttataaattatctcatctatgacggcttttctgaccgttattccccttcactacaattgataacttccttctttgtgctttcatctccactaaatcttaaatatagttcttgtataggacatataaagctttagtatatgtacctgtatgcaaatccacctcccactaatcatctagaatttctcatttgtttttgtgtccccagagcctaacatagcacctggtacataactcatggtcaacacctgctgaataaatgaatgaatgaatatataagaaaaactatggcacaaagacattcactaaacactatgtagttgaggaaaaaaaacagaaaatggttaagtaaattatggtttatcagacaatatacagtcatttaaaaagttgttaaaggctactcaagcagaaaaatgtcgagacagtattaggagggaaaagcaaaatacagaatatagcacaattacaaactatgctttaaaaaatcatatctagaaactgggcagacatggtggctcacacctgtaatcccagcactttgggaggctgaggcaggaggatcgattgaagccaggagttcaagacaagcctgagcaacacagcaagaccctgtctctataaaaaattttttaaaattagccaggcatggtggcgcacatctgtagacctagctacgcgggaggatcacttgagcctgggatttcaaggttgcagtgaactgtgatcgtgcctgtgactagccactgcactccagcctgggccacagagcaagaccctgtctcagcaacaacaacaaaaatctatacgtacaaagtagtagtatctggttaggaggactacagaaaatactagttatttctattttgttttattttccatgattttctagaataagtatatattagtatataataaaaacacacatatttttaataggtaagagttctttttttttttaagagacaaggtttattgtcacccaggcactggagtgcagtggcacaatcatggctcattacagcctagaactcctgtgttcaagtgattctcccacttcagcttcctaagtagccaggactacagatgtgcaccatacacccagctaatttttttactttttgtagagatgaggtctcactatgttggtctcctgggctcaaggaatcctctcatctcagcctcccaaagcgctgggattataggcatgagccaacgcatctcgccaggagttctaaaattatattgtgatgatggttgcacaactctgaatatataaaaacttgtgaattgtacactcgaaattttatattatgtgaaacacatacacacacacataaaaatgtgtatttttttttttttttttgaaacagagtctcactctgttgcccaggctagagtgcagtggcacaatctcagctcactgcaacctctgccttccaggttcaagcgattctcctgcctcagcctcccaagtagctgggattacaggcacccgccaacatgcctggcgaatttttgtatttttagtagagacggggtttcaccatgttggccaggccagtctcaaactcctgacctcaagtgacctacccgcctcagcctcccaaagtgctgggattacaggcgtgaaccaccgcgcctggccctatttgaatctttattgcaagaatacaacaaaaaagaaacagaaaggcggtggaaggaacctaagagatcatccaggccagtgcttcctggattattggatatgaaagaaaagttttggcccaggccaccagtactttactggccaaactttactgtgattcaggcctcctcccaatccagtgctttataataccatttagacaaaaggagatagacttaaccttgatctgattaggtccttttgttggccccaagttcatttaaaaaaaatgctgccccaaaataaaattttctgaagcaaatagtttcagagagcaagagtgaaatcaatgggaatttatgttacagcagatttcaactgtttttacgttttctataaagccttaataactatatttcattgaaggaatagtcatacttgtgaccactaaaattactggaattcagtaaactgcacaaaactggactcgatgacttccaagcttctgtcctaaccgagactttttattctaaatgaaaagtcaatatcacaattatactacaattacaatctgaaaatatttcatttcagtattgagatattctcagcgcctgatacagatccataatacaatgaatttctcccaagaaaggtgcttcaaggacagcatggactcaggatctacataaaccatgataaactgtattactaatggctgaatatttaaaaatctaagtattaaaatatctacaatgagatttgcaaatatatagtcatcattcattctcctcatatttaaatattaattaaaaaatgtcttaccataaagaacacactggatggatgtgtgcactaattattttagcaatgcctcttgtcaagaaatcccagatgacaattcggccatcattacagccaactgcaagcagtgtgccccacctgttaaaggtgcaagtcaaagccatgctgatacaatccaaagttccatcagcttcctaaaaattgaaacaaatacaagaatagaggcaacaatagccaggtatccaaattatttcctaaaggttctttatcacttgtgatacttttattgaatataaattacactgcataccaaataatctctctgtgtcttcttatatctattaaaatagccaaaatgaaggaacatttattaaagctaaccatggattctggaaacagatgtgatcaatcccttacatcactactataactttgtataaactttctggagggcaaatgggcaaaatataacagaagtatttaaaaagtcatatctattgatgcagtcattgtaattctgggaatttattccaagaatttaaaacaaaaagaatttaaacaaaaagaatttaaaagaattttttaaataattaaaaaagaaaaaccctggaatagcctacaatgcataacattagagaagtcaaattatttcatatcaataccaagctatttaaaataaccacaatgtctatcctcaaacattcaagtgttataaaatagttttacaattaaaaaagtaaagcacatctatagcatacattttgctttactacataaaaacattgatcaaaacgagaaaagcacaaacctatgatggtggtgtttgtgaaaaatccttcaatgaaagtttttcttttatttaaaggaaaatgaactgtaagattacaacatcatggtaagatttctagcccacattgcctatttcctccctgatcaaaattgtacactagctccttattatagcataagatatattatcacacttaatgcttctctgtcaaaacacaaggatcaaaaagtattttctgttctaacataaacacccagaagttactatgttcctaaaatcaccacaatactatactcttacctctggatagttctgcccaaaggactctgcaacaaagcaaagaaagagttgatggcacatgtaccacatagcaaggatcatacaactcacgaacagtgtatagcagtggctgacaaaacgaaaagggggatatgatgccctttcaggcattccatgaggccatacggattttcaagatcctgctaagatgacttgtttactctcattatctcggaaatatacagatgcgttttcctgagactatatgacctgggatattgaaacagagtgagggcagaagcagatgtgagaagtcccccaacttctattcaggcaaacattgaagagatttgtaaaaatgtcacaacagtggcattttcctcactaaatactttgtttttgaaaacaaaataactactcacataaacatgtaatggatttattatggttatttctatataatatgctttaaaaatattatctcagttttaacttctaaattggtaaacactggtaggtagatatcacctacataaacaaaaactctctggggaccctctacttcttaaaagtataataggatcctgatactaaaaagtttgagaactgttgacatatccaagttagcaacagtctttctccatcacaccttttgggcatttcacaatttatttccaaatttactaaggtaagagcaaggagccgggctcggtggctcacgcctgtaatcccagaaatttgggaggccaagttgcggcagatcacaagggagttcaagaccggcctagccaaaatggtgaaagccccgtctactactaaaaatacaaaaattagccaggtgtggtggtgtgcacctgtaatcccagctactcaggaggctgaagcaggagaatcacttgaacctgggagacggaggttgcagtgagctgagatcgtgccactgcactccaacctgggcgacagaacaagactccgtctcaaaacaaaaagaaaaagagcaaggaaaggcaagagtcaattcatatcagtcaaattatcacaattactctttgaaaccttgaaacctttaacaaaagcagcgatcacaccccttcctgactaataacagcatttaggttgcaacagcaaatagcagttgattaaacatgaaattctctttatttctttgttttagtttttttgggtttttttttgtttttcgaccggcctggttttttttgtttgtttgtttgtttgagacggagtctcggtctgtctcccaggctggagggcagtggtgcaatcttggctcactgcaacatctgcttcccaagttcaagcgcttctcctgccccagcctcctgagcagcagctgggattacaggcatgtggcaccatgcccggctaattttgtatttttagtagagacagggttttaccatgttggccaggctggtctcaaacttctgacctcaagggatccacctgcctcagcttcccaaagtgctgagattacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagcggctcacgcctgtaatcccagcactttgggaggccgaggtgggcagatcactaggtcaggagtttgagaccagctgagccaacatggtgaaaccctgtctctactaaaaataaaaaaaaaattagttgggcatggtggcacacgcctgtaatcccagctacttgggaggctgaagcatgagaatcacttaaacccaggaggcggaggttgcaatgagccaagatcgccaagatcatgccactgcactccagcctgggcgacagaagcaagactccctctaaagaaaaaagaaaagaaaagaaaagaaaagaaactatcagagaacactgaacataacaaggattaaatataattctgagaaacttagttacacgtgtaggtatatatagtgaactgtgatagaatatatatttcttactgtgatttgtggtaaaaataagtttgacaaatgatcttatttaattatatctccggtgcacactggtgaatacacagcagggactcaaaaagtggttgcagaagtaaaactagtgtctacctatgagccacttgtctaaccacattaaaaatacattgtcattcatttccttcatctggccagatgtccttcagtaggcttccacaatcacattacttctgttcctttccttttatctataatcattaactttctcactttaaaatgcagagtcattttcagagattgttatctttcggacccaggcttctttaatttgtctaaccttccagtgctaaatattccttcctggctgggcacagtggctcacacctgtaatcccagcactttcagaggccaaggtgggcagatcacttgaggtcaggagttcctgaccaggttggccaacatggtgaaacccagtctctactaaaaatacaaaaaatatagccaggtgtggtgttgggtgcctgtaatcccagctactcgggagggctgaagtaggagaatcggttgaacttgggaagcgcaagttgctgtcagccgagattgtgccactgcactccagcctgggcaacagagcaagactccgtctcaaaagataaataaaaataaatattccttcctaagttttatcctaatgaaccttctgtatcattcaagaaaagccttttgcaagatcctgctactctttcaaagtactagcgttatcacctttcttccatccttaagtttttacaagtaagcgtcaaccttttgcccttgtctcccacaccattctaaaatcattgtaatctggtttctgttccagctgctgaggagtcccaagctgccaaaggactaaacagagcaacccattctcagccctcagactcaactgctctgattggcttctatgaagacgccacaccaatctgtactctcttcttcctctacatagattaatacatggaaggcacttgaaaatctgcctagctcagagaaagtactttataaccgttagctaacttattatctccacttattcctcctcttaacctctaactacagattgtgtgcttggcaattttcttttctccccctcccactttttctctagatcatgtcctctattcacaaggtttcaatgagcccatctgaaagaatacaaatctctcccataaatccaaacctgtctcctgacccctagaccacattcagcttctccaaagctgtctttttccaatgaccttacactttatcaacagcatcattatttgctctcaccatttttcacgtcactctcttactcatcagcactatatgcaatctattctcaaatttgtcatccctacctcctcaatgtcttttctatttcctagctcaggccttcctcatcactcatataatctacccctccaaactggttttacactcctccaaaactcaactccacattgctgtcagacaaaccttacaaactcatagctctgattgagttactaagtcaaaatccttcaatggatctaccctaccttccctaaaaagcccaaacttttgagctaggcattcgagaaccaacacaaaatagatggcaccgatcccatcccctggcattctctttatccacaacctggccaagcaggaaaattctttaggtcttctctcactgatgcctactgaacatccctcccatattttcatacttcagcctgttgatattttaccaaccttaaaaatccacttaaggccggacactttgggaggctgaggtgagtggattgcttggggccaggagtttgagaccagcctggccaacacagtgaaaccccatctctgctaaacatacaaaaattagccaggcatggcagtgcgcacctgtagtaccagctactcaggaggctgaggcacgagaatcactcgaacccaggagacagaggttgcagtgagccaagactgtgccactgcactccagcctaggcgacggcgcgaggctgtcttaaaaaaaaaaaaaaaagtccacttaaaactccaactcctccacaggtttggggggtttgtttttcctggttgacttcttcctttaccccaaagacattcactctctgttccaaacattcttagcaactggtaatgactctttcaggcctgcctacattctgcaatatcctacagctattttacataatcaccttaaactccctgcttaatgaaaagctctttaagggcaaagaccattttttatgtatctttgtagcccttttgacaattaacatatcttctgacttttttaaaagagaaacctaaccattaggaacagcaagtagtgcagaagtccttgaaaacctcagctacccctagaataccatgctaaatgtcacctaatggaagtccaggagaaaggacctacagtttttaaataatctggataggaggtaaggaggcaatgactcaaagtgagggcgacaaaagacaactccctccgtatttcacacctcagtgttttacacaccgtccctagcaaaggaccttaaacagaaagttaggataattggattccagtgccaactatgccatttacttgcttagtgcctagccattaccctctgagcctttattcatctgttcaatgagaagcttctaccagaagatctccaagtcccctccttagacttctcttttctacaaaaagattaacctgttcaggcacccaattccctgacaagtcttcaaagcttcatcccaagcctcacttcttcaaattccatctccaacaactctggtcctggctgctctgggtacttcaacacctgcgatcctcataatcaaagctaagtcacaaactgtctgtccccatcgctccataattgatatgaaagtggcctcgggaggggcaatgcaacctactcgggcagaaggtgggcttcctcctcccgctgctgctccacatcaggtgtgcccagtgatccatagccgaacagtgtccctaagattgcagcctgactcccctcccgcctgggttccctcctttccagtacccaacgcttctctaaaacgcagccacagcccttctcacccagcaactcgaggttcatccctgcggactgtggccgcccggtctcagctccggcaacaacaccttctccccggccggcttcagcaacttgcgtctaagtggtggacgccgcgaagagactgccgcaagctccgaagactttcggccttagaaggccccgcggcttccgctttcttcccccgccttccttgttcgtttcaggtgggctgcccaaatatatgcctgaccaaaatcaagcatacactctctcggaaacaattaattatgatctttgctgaggtacaacaatgttatcgtcactagggactttaaatagcgcgacaatttaagattatttgctccgggaacatgtaggtgaggtagaaattccaggcatacagttaacctactagttcttgccctgttgtgtgttcagcggcgttgtccgggcgggctacctcagactccgcaggaaaggttccggacaagtcctgctaatgcaagaaaccagggaaggtcgtcccctagtgctcgggtgtgtagcgccgctgacctcaccaaggcgcgtacttaccctgtatgtaggtggcgttgcagggtgtttcggtctcgtgaaaattatttctcatttgtaaagatatgctattgatcctacagaaaggtacgacaacatatgttaggcctgtctgtgttaagataataaaaaccttattatctaaggttttaccctttaccaaacagtgttgacagggacgctgtgaaaaagactgtgaaaaagaattggaatgaggggtggactgagtttcccggagctcagtcatacagaactccaatgaaatacccaaagcaattagagaagtccagttactggtatctagcgaaagagcaaattttatatgaacaaattcctactataaatgctgtggctcatcagaaaaaggaaacaacgtcaaaggctcgctgcagaaaatagtactcgggctaggtctccgacaatggaaaaatacacatacacaagtttattaatcgcagtattgtctgcaattgcaaacttttggaaacaataatgaaacttttgaactagggagcccagcattttcatgttgcccagggccctgcaaattatgtagctagtccagtctgcctctacttgacaaatttgcagaaaaagcagcctcattcacacagtgcaccctgtccctgggccccagttgattgctctttcagtaagcccctgacctaagctcaacccaattaaattcctttcccaagaatttggaatgggaattaagtggcccccacagtctgacacatcgattgaagagagtaaatgtgaattaaggagctatttaaagcgcctaataatagatggacaccatggtagttggctgcaggttgcagaatgaagcagaggtccagaaactagtcaaagataatacttggtgtatccaattagttcccaagaacatattacattaatgtcttctatttccattatccttggacctttataaagtatgtcttttgcagccgggtgcggtggctcacgcctgtaatcccagcactttgggaggccgaggcgggctgatcacctgaggtcgggagttcgagaccagcctgatcaatatggagaaacactgtctctactaaaaatacaaaattagttgggcgtggtggctcatgcctgttatcccagctactcgggaggctgaggcaggagaatcgcttgaacccgggaggcagaggtttcagtgagccaagatcgcaccattgcactccagcctggacaacagagtgagactctgtctcaaaaaaaaaaaaatccacagtttttctactctccaaagacaaaggaaaactttgcataaaggcaaaagcaacaaagaaaaatatcgtgtgaaaaccacagcctagtttcctctaaattctctgactctactctcaaatccaaagtaatcatatatatatgtatttagagatatggtctcactctgttgcccaggctggaatgcaatgacgaaaccatagctcactactgtaaccttaaattcctgggcacaagtaatcctcctgcctcagcctcccaaatgcagggattacagattacagctgtgagctaccacgcctgattccaatgtaataatttttacagattggatgctaatatagctaatgaagttaaaattaaagctgttaaaaataaaaatagtgaggccaggtgcagtggctcacacctgtaatcccagcactttgggaggcagaggccaggcgtatcacgaggtcaggagttcaagaccagcctggccaacatggtgacaccccgtc

SEQ ID NO: 15268 - DNA, 4361 bp, Human
tccttgacagcaagattcatgaacttcaataatcacaatgttaagaaaagttaatcttcaactataacagactaattttttaaaaatttagtcccttttagctgtatgtcaaaagggcagaccaatagctacagctagtacaatgactagaacacaagctcaaattccctggtattataggagacaagaagatctcagtagctttcattttctttacaatttttaaaaagcttcaattaagtacttcaattgtatctaaacataaaacagaggccccatctgtattaatattttaaacattcaatatttgagctatgtaactcgtgctagtaggtgaatataaacatgtcttaaataaggaatatttacatttcgaaaccttctgattgtattaatttgatctggtttatttttaaaatattcccccttgctacagaacatcttccttttctgcattaaaaacaaaatggctgtatttctctgcccaactttgcttagctgaatcaatccttttaaaagctttctttactgctaaacctatcttcaattcttaactgacacaacatcagtcatttttacatgagaacaatacattaaaataaatacaaagaaaaaattctcccagcaaatactagattcaatcccaacaatacagacacagtcttaaaaaatcagttatgtatttatttgcatagaaccaaaggaaagacttaaaattccaacatacatcctacgaggcttacaatttaattacaaatccagttttgagggaaaaaagggttttggttttcctctactaatgaggatgatactgtttcacatgcttcagttatgtatgctgaaacaccagacgcctatacatctttacttttcgcagaattagtatccagtccaaaaaagtcttctttgatgatgtaccgaacacactgcaaaatcacatttctttcatgtcgaatgtccggagctagaagcatttccaagagatatagatggtgtgttcttggttcgaataacgtttgatagttgtgataatcttttttcctcttagggtttgtcttttcaaaaattttctttcggttctcactcttggcttctgaaaaatttctaacagttgctttaacatcttgacttggactcttagaagcactgctatcaagaacctggttttctgccaaaacgtctgcttcagtcttgatgggagtttcttctggctcactctctgaccccgaaagactgccatagctactcattagtgagcatagggctggtgtcacttccttgggtatcacagaatgttgtggtttctcctccttatcagactcagaatcactgtttatcaaaacaccaagaggatctgcatttgcctcaggtggaccttctggcttcaaatcacacaagtgattgcctgatccagtgactgctctctgtctataattgttttttcatttctgattctcgccaggacttctgatatttgccatttgtgaatgtctggacatccccttcatcttgccatattgtgttgttgtcagtactgctcatctcttctccttttcaagttttaacttcttcttcctttcaatattggccagagttggctagtttttccttctttctcccctccaccgtgcaatttcctctggagtgtctaacttgatcttcttcatgccaggagcatgcatatttctccaatggaactggacaatcttcttgtgtgcagtaaaagagcaatctacttcagggcattttgtatgttcagacatgtgtttgtcatacttttctcgatttttaaaaccacgatcacaggtatcacaaaaaaagtgaaaaactggttcctttcttttcttttttttctgttttctactgggaggtaagctgaagtctgtgaattttgcatcatactttcgtggataataagaatttttaactgaagggttgaaggacttctgatgccgaggaaacctatcagaagactgtctccaataccacgatgtggaagcatggaaattccaaggctggccgctgggttgaggctgagaatcaaggggggactgtgcgtggaaggggggttgcgccccgggaagaagctgggcgtcaaagaggggcggagccctggggagagactgggcctctatggggggctgcgagaggaagcctttgacccggctgcgggaagcgaggacgtaagcggtggtggcggtggcggcagaattgcccagaacatccagctgtcccgcggcggggcagtgtcggtcaggggccctaacgtgggagtcagcccgggagatgcaggccacccgataggagtcgcgaaatcactagtcggctcagccataccaccggccgggtccggagtctagcacgcaactgtctagtcttaatattttagaaaggataacttatcaaaatgaaatctggataatttataagctcaaataaatatattcaagaggttcagttattgatgagttgtttatattgttttaaatacctctcaaatattttcgtaaaatacgtgtgtatacactgaaataagtagatactaatcttatccatttattcaacttttatttgctgagcacatcatctgccccaggcactactattctaattgatataaataagcatttcctgggaatggtacatttcctgggaatggtacatgttttctctcaactcacagtatagaaagggagacgtgcatatatcacaaagtattgaatgctacttgaaatttcatcatcaacattgtatgataagaatgacaatattaagagttactaatattagtacttaccaattataaatgtgctcctaccagatattagcatcttatgtcactcattctttgctaaataaatgcattatctcattaaacctttttaataatcttgtcaaagtagtatgatttattccattttgtagatgaacaaaattagactcataaaagtgacattactaggaaatgtttacacacctaaaaaggaataacaatggggtttggaggcaaaacatgagctttcaaagccctaactttcagcttcaataacatgtagcctcaaattacagttgatctacaaagatcaaactacagttgatcttttttgctgagagtatcaaaaaagaataaacaattctgactaacggtatatttgggtcttctataatggaatagatggtttggaatttataattcaggcaatgagaagtcattggaatatttcaaataagaatcagacctaattgaacattttaattaaataaagattatcttatataataccatgtcacattgtattttgtcatattatgtcatatcagaaggcattagagaaataattcataaaacagagggaaaggaaggacagagaagcatgttgacagtgacagctgatggagagaatagcaataggcatattgctagcacaaagtcacagccaaagaataatggagttactctcttaagtatggtacatatacccaatttctttttcttttttttttttaagattttataattgaagttcatcttaatacttttttttttttgctagaaactggttaatctcttttattttattttattttatttttttattgatcattcttaggtgtttctcgcagagggggatttggcagagtcataggacaatagtggagggagggtcagcagataaacaagtgaacacaggtctctggttttcctaggcagaggaccctgcggccttccgcagtgtttgtgtccctgggtacttgagattaggcagtggtgatgactcaaggagcatgctgccttaaagcatctgtttaacaaagcacatcttgcaccgcccttaatccatttaaccctgagtggacacagcacatgtttcagagagcaccaggttgggggtaaggtcatagatcaacagcatcccaaggcagaagaatttttcttagtacagaacaaaatggagtctcctatggctacttctttctacacagacacagcaacaatctgatttctgtatcttttccccacatttcccccttttctatttgacaaaaccgccatcgtcatcatggcccattctcaatgagctgttgggcacacctcccagatgggatggccgccaggcagaggggctcctcacttcccagaaggggcggcctggaagaggcgcccccccaacctcccggatggggcagcggctgggcggaggtgccccccacctcccggacgggggggctggcccccacctccctcccggacggggcggctggctgggcgggagctgccctccacctcccggatggggcggctgccgggcagagacgctcctcacttcccagacggtgaggctgccgggcggaggggctcc

SEQ ID NO: 15269 - DNA, 9401 bp, Human
tcatagccctcttcactgactttattccagcaaacatggtaattacaatatcatacaactaagtacagacgacctggctaaaatgtctgcccgatggtctccgagtctcctgaatcaggtgtctgagaattacacagttatactgtacacacaatgcccttctacccgggacacagaaataggtccacactacacggacttttttctcctaggaaaggacgatgctgttcttacactttctgaaagtaatcacagagccctggatacgaagctattgtatgcaaatctcttaaatttgtaaacgagctatagggcaccagaaacatcccatttgaagaagttacattcgttaaaaaaaaaatgctgttgaacaaggctgtaacttactaccttatgaagagttccatttcctataagaaatgtcgggcttcttccgaagacaacgagagaaaacaagattttaagaaattctcccggaaggacattgatttggatcttgtgatagtgtcctcacttcgcaaattagaaagggaaaaaaaaactagtttttattatgatgtgggccgattcaccacaacaataatttaattgaggcgaatttttgcaagagcccaaaagggtggggggggggggggagtttaaaattaagagtttcccaatgctgtgcgtttatttgggattctgaaagcacagaacccgcaagcgaccaagacttttcttctatcccagagcagatagctccgcacttacccaacctggctctaagcatttcgtgtaaacacaaaggttgtgctcaaatcacacttgaaatacatgagagacaccaccaatgcctcccccagaactcccaactacatgcaggtctgaaccgaccggactagagtcagaagcaccggcgcttcaccccttcaggtgtttcgtaaatgccagcaaaagcaggcaagcagcatgactccgccagagtggagcgttttgtctgcggtggtgcccatttgtttggtcttttacaaaccaagtgaccggcctgggcctcgcggcccgggacagccgcattggcaaacttctatctctcaaagccagagcagttagcaaactctcccccagacagggcgactcggctgacgtttttgacccggccaggaggcaaagaccaaaacgtcagagcagtagccctgttactgaggagcgtcggcagggtcgcgggtagagggggctggagaatgacttgtcagagctcaaggtcgatgtggcgcggggcggcctcgagagcgccgggctcctgcgtggccacggccgccgctgccaaccttcgcggggacttagctttgctttccattgactccctttgcaaaagcgcagcagaatcctgaccagccgcaccagccccggcgaacccgagcatgttaatctatttatatggattattacggaggaacagcgggcgttgagtcaccaaaacatttgcttcaaaagactatttctaagcacttttgcaggcaggcaggctcgctccaggcgcgtaaactcggctacgcattaagaagcggctgcttttcgaatactgcaaactccagctaagtccccggtgccgcggagagagcagtgaaaagaaatgtcggaggtgggggtagatcctagtctagacacacacacttgcgcgcgcacacacacacacacacacacacaagattcgcgcggagaaggcactaaaattctggcattccgagagtacgacaaacttacacacttggaagtcccgggtcccccgccttccccgcagcaccccccgcccccccaccctaccgtccgccctttggctgcgatcccctcccctctcctcccctcccgcctcgtcacccagcccagtgccacaatcctcctccctccccaaaatcgggtccaatcagctgcctgccaaccctgggactgctgtgctgtgattggcgggtggctctaaggtgaggcggagtatttattaaagagaccctgggctgggagttggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggaggtaggacccggcgggggcggcgcggcagggtgggcatcgcggcggctgggggcgctggtcagggctgatttgccccgccccgcctcccatcgcccgggagttgccgttccgggagccggcgggatggggttgggagtgggaatggggtgtaactgtggctcagagtttgacaaagttcttgggctgctcgcggggacgcggaggaggggggtggtaagtggaagaggtgagggaggtagctggaggatggacgaagactggtgggagacggaaggagggggctgccagcctgctctccagtcgcctggaagctcaatcggggcggggaagtgaaacttgcctccctcctacccggcctcttaaaactgcactctctcgtgcagccccactgtccacggagatggggcaagggagaaaccgaggttggaggagacccttggcaggaactgggaggcgggaggagggaggctactggaaataggtgggagtgtatggtggggggtgagaattggggaccttcttgcagcttaagtaatttgggggaaagttttcaaagggggttggggttgggggcggtaagtcgagcagcaaaggcgtttagggggcagcaccgggagtcgttttcatctccagcgtttccaaaatagaaatagaaggggaggggagggagggggcggggagtgaccgctcaggtcagactgcaataacttatttatttatttatttttaagaaaagttatgagctgtggttgcaggcaggagggaagatggagttgtgtgcagaggaagccgagtggtctgggtcgccgcctcctccccgccgacctgacagtttggcggatttcactgacccctctccctctttttctctgtgccccccgccccgccccgagcagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcgggtgagtcgcccctcgaccccaccggacaagctatctccgtcccgcctggcacaccccctgccctccgcctgggagattcttcgtggggactttatgcttcccgggagggacacactgccctttgcgcccgtgccgctcccctctctacccagagcctaagaggcatccaaacaacacacacacaaacacacacaccccaactcaatcccagcatccgaagagattaacttttttattgggaggtaaaatgcccttaacagccttacaagacctctcccttcttctctgctcccccaccccaaaagcacacacagggctcttacacaagtagcaattaggtcttccggaccctccgggccccagaccctcccctgataaaagggggctgtccagtgtgtaccggcgggttaatcattgggcgacttatctccggtgcagcgcgcctcttgcgcgggtgcgggcccttattacactttagcagcgagggagggtccccggagggtgcctaagactagggcgtctgcacagcccttgttgattttctcgtgcttgttcttttattgtccacagggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgacgatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttttttttttgtatattattgtttacaataaatatacattgcattaaaaagaaagtggccctgtggatttattcacccagttctcctgttggatgatttggcaaatttgagcacaaaagacattgtggagtgctgattgctgtgatgtttttgttttttatcagcacctttggcaatcctagaaaacaagctgaggaaaagactgtatctccaaaaatctaggcagaaaaatcttgaaaagtgccactccaatagatcacacagaaaattacatgtcagtagttgctcactctggcaaaaatgtttgttgtggttttcatgacctcatgcttcagggcaaaagctgtcccttgtggaggtcacagggaatattagacctgaaatcaggagcttgtcagtagacagaatgccagaggggtgacttgcttatctggttttaatatggcaaactttccgttcctatgaacacatacccaagaaatggagtatccacttaaaaagcaaaggaagccagagaaaatcagtgtctacagggaaccagagagaagcctgtcgtattaacccattaaatgattcagagccttccagatttctctgtagagacaatgaaaggggatgatttttctgctccctccagtttaactcattctaagcagacgcaaagccattgtagaagaaacaagacctaatcctgttttccttggccccagttagatggggagtttccaggttcagagaaacgttcaggtcatttttcattaaatagatgaaatcactccttccctcacatgggcacacctccccatccccactcccacaccccagatgattggagaagtgtctctaaagagtcagtcaccttcaccctctcaggctagttttactactgggcctgtgtctctggcagtcttaaccagagtccaacctctctggcattacctcacattgtctgtttctgcttattggattcctggctgacatcccacaccaggaacatggcaaccaggaaaatggtagttatcaaatcgaggcaacattagtactcggcctcctttgcaaattccttcgacaaacattgattgagggcctgtgatctgcgggggactgtgcaaatccttccctaccccttcagacatcaaattctgttccttgtttgtgacatagccttccatgcgctgaggccctcccttcttacaaaatctctatttttttttttctcttgccaacactcacaaagtcctttttaaaagtctctgtggtgttcactaattcttgcctaccttattcgttctaatccctttgtctattaaaatcaacacacaccattccactgcgactacccccttccctagcaaatctgtatgtttgctagactgttctcccttccagaaatatgctctttttcccagtatgtggcctttgccaggacttcttgaagccaaaatattctgttcggacataaacttgtgaagggaactgaagcaagttgttttgctttcccgtgcctcactttccccttttgctgagtatgtttataattcctcctacatagagcagggttgttaatagaggagattttagccagagcaatctgggagttgactgcattggagtctcctggtctgtacagcagtccccctgcattagaattcctgggagtaatagccaggaaaaagagtttcataagctccccaagtggctctgatacacagtaaaatgcaagagacacaggagtgctgggagagaattcctcagaatcccgctcacccccatatctatcagatctagtcaaagcccaatatcaccagattataaaatattttggaggaatttttagtctaacaccagaagcacagagcttatcaccctggcaacagcaacacattgactggaaacctaggagagtcctccacaccggaaagagtttgtatgtagatccagggttatttgtttgtttgcacttaaaataaaaccttttcttttctaaccattttaacaaaactgaaatttttagcaaaagggaataaaaataaactcatttaagaatcggtcttt

SEQ ID NO: 15270 - DNA, 192302 bp, Human
  misc_feature (1)...(192302): n = A,T,C or G
acctttttcaaggattacagatattgcagcattaaaaaaaaattcagaattcaataaatgtttagaaagttaaaattacataaatgtttaaatttttggattttgaaattcctgttcactctaaagagaaatagaaatctaaaatgataacaacaacaataataattagacaatgtttacaaagcctttggaattttcaatattcttgtgtctctgcttgaagcaacaaaattaaaatgatatagtcacaatttgtttcttgactattttatattcagtaatttttaatgaagcaactaaattaggcataactttgtacagctttaacatagttatgatgaatatattttacttgattaaaaatgataaaaccagggagccttaaatattatcttaaaagattaactactgtgtcaattacaaatctaggagaaagatatttataaaggaataactattctaaacagtaacttccttttgttcatttcatttaattaatgactcaatcaactttcactcttaatactaaaattttcctaaattacacattggtttgcaaatgggatggcatatagcagggctacgtcaatttaatactggtgaaaattcagcagataattcatttttcatttaatcaggaaggaaaaaactacttggcagtgtagagcgacctaattaactaaataactgccaattctacattgtactttgtgttacatgacatatcatgaataaataccagtcaaaaatcaaattatttggatacttaaatgatgatgaggcctgctgtgccaacaggtatgctaatgagtagacatctcccagcctcaagactgagtgaatgaggcaaatattttcacctcccaatcttttagggtgttcaattaactcaagtatttaagaagttccctactattgggaaggaagtagatgtaatcatctatatgcttattttgtcaactgagttggaaaaacttgcaaaggaacagtttggatatatgtattagatttttatcaaaatacaaataaatggtcatagatgacaattttcacctaaggaatacaagtaagtttatctatgttcagttaccaatcgcctctaactaaagttaacaatgtcttccttctaaaacctttctaaagagcaccctgcaatcacaccttctagcaacagccatttctcttgaattagtaaggtggctacaccgccaatttgagctgttctccttcagtcctgtagtccatcgccaggggagtctccaaatgctaataaaaatcaatttcccagacaaaagaacatatacacgtttttttctttctttctttcttttttttttttttttagaagagggtcagggagcatctgacggacgtttttaaaggaaggggacagctacttccatgggactgcattttagttgtgctaaaagtgatgaaagtgggtttgcattattctaccaccaacacccaaaccacctgcccacggaaacccccgccggagaccgaagtttacccaaatagcgctcggcaaagcgctgccataaattcaaaactaactctgccgggcccgcgggggttgcgagacagggaccgaacgtgaaacccggggagccccgcgtctcttgcctccgaaggttttccgtgatcagtgtccccttctctgctggagtcggaagtgcctgtcacctgcggatctgcccgactctcccggtcggcccttcttctctgcccagttcggacagtctcgaattccccgtcgcagccccggccacctcggactccctggtccccagcccccgccccaccccccgcctccaccacgtcccctccccgcggtcccagcctctccaggcgctgctgggctctgattggcggctgcgctgacagcaggcggggcctggaagtcgcggccaagcccgccctcgcgtataagcccctctcagcgctctctctccatctctcccctctctttctctctcgctgctcccttcctccctgtaactgaacagtgaaaattcacattgtggatccgctaacaggcacagatgtcatgtgaaaacgcacatgctctgccatccacaccgcctttctttcttttctttctgtttccttttttcccccttgttccttctccctcttctttgtaactaacaaaaccaccaccaactcctcctcctgctgctgcccttcctcctcctcctcagtccaagtgatcacaaaagaaatcttctgagccggaggcggtggcattttttaaaaagcaagcacattggagagaaagaaaaagaaaaacaaaaccaaaacaaaacccaggcaccagacagccagaacatttttttttcacccttcctgaaaacaaacaaacaaacaaacaatcatcaaaacagtcaccaccaacatcaaaactgttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgaggtaagcgagtctgcgggcaccgaggctccccgagtccggccaactccagccagacggggagatgggggaggggagggcacccagcagaaagggaaagaggttgcccaggcgcagttccccgaattcgctctcgcaggtggggctgcaaatggcctgggcgtagaaagttgcgggaaggtgttgatgtctttcgggagttctggagggacgcgggagggcgcttttttggagaggggagacaggctagttggttcttaccagtccttgagttgcactgaatcttttttgcttgtcgctctcgggtgcggaagcggacgcgggatggagaaagccgaaagagggatgcctctggacaggagcagtttggaagcgcccggcgcgcagtggtcgccggccgggtttgggcgcgcggggcgcaccggccgggggcagggtggacacgcgcgggcacacactcgccaggttacgaggcccactaagcgtcctggccagcaggcatgtcccttcgctggagtagcaagcagaagagcagtgctgcgaggctggacgcggctgaggaaacagttagttccccggcacgcggctgaggaaacagttctgcggcgcgcgccttcgtgccggcgctgcgccctggccaggtcctcgtgcccgagcccgcgcggcccagggagtagtgcgaccccggaaaagttgtaatgagaaagttctggaggcttggaaaggccacactgctcacagtcggagagtcatgggctccggctcttttgtcagataaagggccggtagtggaaggaggtgctggtgcaccctcgggccaggaccctcgcagtcgcaggcggtggcggcggcggcggcgggaccccggggcgagctggggtctgcagggatgcgcgccagggactgtagcgttacgcttgctccggctggactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccacccccagtccctcttcctggccacacagcggttaatcgggggctcttctctatccttcgcacgtacccctgggtcttgacaacagaaagttagtaacggccagctccagaccttcttgcatcccagacccggagagaggtggtctaggcagggagcacttgggagagttgggatgcaatcactggtctcctccttccactgaaagtgatcctctcccacccagtccccctacgcccctagaggagcaccccaggaggcagcgagtctcactcccactccctcccgcacccggtgagccccgagcctggactcaagggtttgctggctggacgctgggatgtgtcaggaaagggaaggagaagaaggaacggagagagactgtccatgggggagggggttgactgtagataagaaacaaggacgtcctgatgggatggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctgggttcatactttctgaacgtcgtaaactatgcgccacctcagctcggacccagcactaggacctagggcataaaatccgctcactccttacatcgtagaaggagtgcggcgcggggtggggatgggttgtagcttgatctagcatctcctgaaggagcagtttgcagatgactgtcctggttcgccacggcggtcgctttgaggactccagaagctggaaggattgaaagccaggcgctggtcctcatgctcaccttgagaaaaccagtttaagcccacagacctatcaaagagggcgccagcctcgccaggcgccctaggaccccttacaacttctaacttgaggcagctctcaggcggccttaggggaatgcgctggagaaaatgtaagcttaaaagatgaccaggtcactctatcgccattcctggttgccctttcctgacccctagtgtctttccttactacctcttcatattttccccggacagtgccctaccacagtatgagaggctgttccgtaagaatgggattgagaaaagatccaggctactctgacgtcttgtggagttgggagttgaacttgagagtgaacttgagaagtgaaagcgggaaaagaatcagctttcgctcgtgcagggctactaagcaccctatgttgggagaggggccatttttgacctgggctttacggtgggcccactgcatttccctcatccacacgcgcgcgctttccattcccaggtggtcctagttagcgcctgggctccacagtttgcagctgacaactgtcctgaatcagggcgctttgagcgacggaaaggtgatctgggattcagtggtctccctcggggccaatccggcaaacctattcccaccccctactcctcccccgcctagggcatttaagagactatccccagggaagctacggggaaagaaaggggttaagagtccctgatctttgacgtccttgtcctgccccacggctgaactgagtcccggacacagcgcagttgcttactctagcctggggcggaggaggttgtatttggtggcgcacaaagcctttcatcctttgtctgtgagagggtaccacagaagttctagagaggcttctccgtagatttcattactgaaaggaataacttctgaaggcgaaagggaggacctttaattgggcccatcactaggtgagaaagaagtgagccgaggtgtgggtttcagggttccttcttgaaagatctgtgggctgtttattacacaggggcgcggaaatggtcggatttttcagtcctgcctccacggaaaaccctgcttccaaaaacaggggcacagatgtcgtcgcaatcaataggtgattgtcgctggggcggattagaaatctggttttatacttgctataaacaaggattgggtttggcttttttaaagtctagttttcctctattatttgcaggtagttaatttttgccaagtgctaaactttagaaaagaggcttcttgctctcagaggtatggcagcccttcagaagtatggagctctgaatgtcctgctggcagggcctttagattacctaaacaagttctctctcttaatttcctccacaagttccaattaaatatttctaaccaacattccacctcccgcaattaaaaaaaacattgctggaaggacatctctgttagtagtccattaataattgctcattaagtaatcatcagtaagctgtcttcattccaagaaatgtaattattcaaacagtttaaaaagaaatcctaaagctgtatttcaactattgttgaaataatatatagccataagaataaaaatattttcttaaatggttacatctagcgactctctcctccttcctcccccagcatcatgggtgagtttgtaacaagtattatgacacagaagtgcttgacatactggacttctgggataggtattagtaccaccaaggcttttacttttctatattttctaacaatcacgaattgggaaaccaggaggaaaatgtagatgaagaaattttgaacagcaaactttataaacctgagggacacaagattaaaactcctttcttggcatttacttaaaacttactaatctttggattttccatcaaccacaatatagcttttgctcattagagaatccctaagagatgagtttttgcatcattattaaagtggtttatgtgatcatttaatataaataaaaacattattttatactcttaaccaaatatgaatgttaacatttacttattttggcagcaatttgataatactaaactatgatcagccataaaaacaactattcaggagtgtatttgcatagattatattttaaatttaagtgtttccaagccatgaaacctaattttacaggaacaataattttactacaccaaattacaaagtttttgggttggtcttcatgaaaatgacatttaaatctcataataatacctacttttttcccccaaaagtagcgtatacacagttgtcaacagggatttaatacgatttgatacaaaaagcttttctacataaaaagataagtaaattgctttttcagctatgacatcaccttttataaacctgtattcaccttttagaaatacaagatggcctatatggtttttagacctctcattacaatagttctaagatataaaagtataaatcacagcgtattactagattattccattgcaatgaataatacacctctaatttaaagtgcatattatagcattcaattaatagtttaatattataactttaaaaattattagttaaaaattatatatgcatgggtctgctgggattctgcaaatttgtatataaagtgaggcttaaaattgtgaacaataatatcagtgccagtgtgcattggtgaaatttaagccttacgactaaacatattaggaaataagaattaattccaaagtgaagactgtcaaattctggccaaattgaaacacatcaaaggttcataagcacatacattgtgagtgcaaaagttattagtgattgaggtgacattttaataatatgaggataatttcttaagactaaactacttctgtatttattctacaaagacaaaaaaaagtaaaggctttatttatactggcattcatttaattaacattaacaaaacatttattgtgatgttaaaatatatagaaaagtaaatattagaaatggaaattatgcttaataattaatgtatgttttttattctagatgtagttctgttattctatctattcttatctaaaggatagaaatcaagctgactaatgaaataagtcttttgtgatataatgaatgatgacctttgatgaaataagcactctaaacaaaaagtattattcctgtaattttgtaatcatcttccaattacagctttttgcaaatatttatcttactttgaatagaatctctgacttaacagaatccccagcagataatagcagtctttggaggcgtctgttgatacacactgatacgcaatatgtatatgtatgtgcctataaccacccactcagacaagaagaatgaatatttgagagagaaaatcattcttatctttgctttcacaatccagacttccaaactcaaacatatttagagaaacagagcaactttccagagcattcaaagggaagatatgaatacacgtggtactagagtcgcataaaaaagaaactgttaataacatctatttataaataatctacacaaaactccattatactacctaatgataattagagggaaagggaatcaaagaattcaggactgccaagtaaataaaatattccctctcaaattaagcaacaaattcatagataacaaggtttatgccatgaatttgaaggatgtctcctttgtagcgcaagacaaaggaagcatagaggaataaatattgattgaactaatcatctgatgaatagaaatgagatttaccagtgcaccaatataataggctatgttaactagttctttcatagcgcatatgctgccctttcaacccctgaccccatccattcaattcttaatgagggaaaccacaggtgttataacggcatttatagtgaatcaagctacatataataaccatgtggttaactaatggcactgggggtagattcttatgaaaggaaatattgtgatcataatgtgacaaaattattgtatatttcaaaccacttagaattttggcttgctcaggtaacctctaaaatatacctacgtggccattaatatctcaagtcccagatttggtggctctgtaataagtgcaaatttattagtgcatatctgaggagcaagaattattcaatatatattctacccaccattgttgtacaccttgcataataagcatttaaaacattaaaaaataacacttagaaggtacagtattttatactcaatatgtcctgcatgctgcttggttagtagttattttataaatattgtaaatagattacaactttatagtaataattaaatgatacattttgtgttaaatttacattagaacattcttgaaataggcatgtttttacaaaagccaaaacgaacatcttgccttcgccaaaatataaggctaaaatcttactcaaaaatatgctcttataaaagaacaaaagtaatttgctttgacttaagcatgttcacctctgggtagtaaatattttattaactggctgggtatgctgacattaaaattactaaaatgggtatttactaatgtcatttttgtgtgattagttatgatatcatgtggtcctggctaatttagaggaatcacggacatcagtaaagaaagatcaaattaatctggttgtttactaaattatgcttttcttactaccctacgtattactttgtgctcatataaaccaaatatcttggcactgtggagtatatgaaaaacttgggatgcttaaagaaaactgttacatagtttaccttatagtaaagcttttttcaataaataattgcaataaattaattttaaattgtgtatttaaaaaattctcactcaactgcccaatatagaattcttcttttaaagactgctacaccattaactaaatttcactagattatgttgtaatcatgtgacaaccagagatatacaatattttaggactgaattagatgtacaaatggtattctgaatttaagcacaaaattatccttaaaaaagaaacagcaagagctttttaaaaaggccttggcatttataaccagaacttggcatgaaataaatgagtattattagctgcaaaaaatgcagatttatttaattttaattttctgaccagctttattttgttttgttttgttttaatattttcaaatacaaatgtctctccttatctgaaaccagctaagcttgattctcatctgttctgaaaactttgtcaaactcattgatcgactcatttttaggagcccaaattaagatatactctcaagtacaagaatgataccatcttccccaaaatatttcagttttaattttaaaaagaataagctcaaagatgatgtcatcttttacagccatatatataaaaagaaatgtacatgactcacatatttatttattaaagatttattgaatacatccacccaaagtaaggtacagggctgaaccccagggatgctcaggttaataaagcacagtcagtagtcgaagctaggatcaaagagaaagcagaatggaacatggcaaggacgctaccagaaagtcagactagctctcaaaggggaagtgatgtttgagatgggcctctaaagataagtagaactccctctttgggttaatttgttcatcataaatgaggtccattaaattactgttagttgtactcctcagttgccttatatagttggtgttatgtgaaattgagtttatagtagaactattccaaaaagaacataacctgatgtagcacaaataatagtattgctctcaaaacttttagtagtaaaattgttctcaagtgacaattgaaaacaaaatcctttaaggcaatttttaaaattacaaaaagaaagtatattgaaggtgagacgagtatcagtgtaaggaagagggtacagcttgttttaaaaaaaaaaaagtatcaccaagaaaaagaaaacgtaaaaatactttataatatccatatacatttgtttttataaggaaaattcttatttattttttaaaaaaaggaaatgactgatgtatattgagtttcattttctttaatactattatctgaaagtagtgatatctgctctagagagtaccttagattactagatatcaagtagaacaaaacccattgaagtaatagagtatgtaggccgtatctgaaggccacaatgatgttcttcaaattcttccattccacatacttggatataatactgtactctgaagattaagttataaaatcaacacttgctgacttttgagctattctctttcttcggcatatttaaagaaggaaaattctggagactcttagtaataaaaacctgagtgtgagaggcaaatattagctggttccatcccagcactgtgagtgagttgctgatcaggctgaaaaaagtgtccactacagtcctcagttaaagctcagtcattttgaaaggatagtctgtcattctggtcttacacattagctcttgtgaacttagttaacatgggtcctcatactaatgtctgatctactctgaaacactggtaagatcaaatttctcagaccacaaagctgaaaaacagactctgagctgggataaactcacataagcaaatgcctccatttgaaacttgcaggcagccaaactgtcactcttggccataaccctctgcattagcatgaatctcatcttcaaatttccacatagtgggcaggaccacagagtcataccttttaagtcctgaaacacaaataattgttttaaatgctgaatattaactacaatatattagaccaaggaattgtgcccttcggttgtaacaatatccagataacatagtggctatggtaattccagattttttcttggaaatagaagaattcgagaagtgcatgaatgatttcatttcttgaggtttttccaaaaagatgaaggcttggaagtctcctgtaacttttactagcctgattaaacagctatttaataagacaaccagttttctggacaatcattcacccacgccttattgcaatttgtctctggtgttcctaggttatgtgacaatggacacatacaaccacttcatgttatgcctgggccagtgtactattctggttggtgaatggaggctaaaccattggagaacagtcgttttacttgaagtgttacatataacttaagtctagtgtttttctctagcttttatgtaaatatgcatcatacttagtaaacagtaaactgctattttggtttttccattaaaaagcaatttaaagacaatcttattaaataggatcaaaatgtgttgttgctggtaatttgctctgagaacatgaaatgcagacatactattgttatttgcctagtgtaatgaaaattagtgaaaccagttgtatttgacaggctacatttaaaaagtttcatttcacctctccaaggaaaggatcacatagtgcttcgtatgagtttgtaattctgcattagtatgaaaactcatattctaagtttccgaagtaaaaatgttagcatatagcttgaaccagaataaacactcaaatcatatttaaccatccagcagctgttgacttccagaatccagaactaaacaagaacacacaagcttcaagaacttagacatactgagtttctaatgaataactggctttcattatcattgccaggacaaataataaaattattacacaaaacatttcctgttaacttgtatataaattgtgcctggcatatgtaaaggaattaaagacttttaaagaaaggagaagaaaccttgttccaaattttcacagttgttgagtatgagcaaatgccacacagtctggtagaatagaggaacatttgttcaggaaaaacacatcatatcgttaaggtacatccttcttggcaatactttattttttacaaaaataaaatattttaaataaattatttagaattttttcagatctcaacttattgatctgtttgctctaaaattaaatttaaaacaaacagttcaatatgctgagtttttttccccacttaaatgctgactacttttaataagcttaattctaagcacttttatccttgcatatatactttcattcttgtgatttcaaaaaaagttaagtaccaaaggaaaagagcttttggagtaaattatcccaaggacaactcagaaatatcaataatgagaatcctagtcagacagcattaatacccttccagttgtgtttttgctttgcttactaatataaccaaagataagttctggctgccacttatgtcagaataaattaaaatttatgtgattggttttagaaagtgttcttttgcaataaaataaactgatttggaattttttccaccaaaattgtactgtatccttatgttcattaatgatttttgaaaggttgtctaacatggttgatttgtgtattgattaagagtaaaagccatactttttgaaactaaaataatgctttaaaagtaaagggaactatctgacagagttgtaggtgacaccttctatagtgaagaaggtgtaaatgtaactcagcgaatcttaaatattgagcacttatgatgtctaagaagcaataccctccaagataacagtctcaagcacagcaaaactacatttcttataaaagtcttaaggaattccttagatactatttgttccatttgaatttctcaaatgtccaatattgattatgtctcattttcttaaatgagaaaaatcgatgacttggtcataattatttgttaaaagagactaatatcaacatttgactggaaacaagggttcctgcctgaatccagttctatttttattaatctatgctctctctctctctctctctctggccatactattttttgccacccctgtattcgtagtagatatccctaatcaactatggcattaatacttgctaagtctgaatgcaacctccgctaccgtttggccagcattggcccttaagataaaacttgttaccacaactctcaccagtgttttgaccacatgaagaatagagaataatacagtaaaactattatttaatcacaggatccccttgggtaaaccatagctctccacagctttcactcccaaaataatgataatggcatttaccaatctcaggaaaaactaaaataaaataagtattatggaaaaatctatagattatgaactagatctgtctagtcaaaataataacaaattcaaagtataagtagtaaattttttatctttccataattattccctggaaagttccaaatatttaattttataaacaaatagatctccttttatatatatttcaaaattttgaaaaaattgcatatttatggatttttttcctcactaagaatctgtatccactttaaggcagcaattttatcagaaatagctatgaagacaataaaaaatttctcttcattcaatagccaacatgcatttttagtttgtgatgtgaatgcactcatttgaccctcagcttgtcaattctttcctctagtttttatgcctgttaagaggcgggttctctatcttcagctataagcatttcaatgaaaaaactgtgttaatagctgagcataccaccatttatccacctgatcttaattaattttgtctgattgactgagactggaactctcatcaacacactatttaaatcaaaggcctattatcatccttctgtgttgtgtacaagcataagatgttttcttaaggaaggaaccttgacaacattaagaaggtgccatgtctaatcatgctgagcattataaagaaaaaaaaattacatttgacattaattctaaagaaatgcggagttctgctcctccttaacaatattgcaatttaatttgttttgcattttggctgaaacataatattccttacatcaagctatcatttatgcggttgatttttatgctttcaaatgaagttaatttgcaattctttaaaagcacagttattagtctactgttagtgatttttcaggcctctttaatgtaaactgtactataaaaaacatagcttgaaataccaaccctactcttcatttattctgcaggactccaattgatcgtattatagaatggtcctgacacccacaatttgactaaatttgaccacagatgctattagaaagaaaatgagccacaatgggtttcttcctcttatatttagtatctactactgtgtttaacaatatcaggttggaaaagattgtacacttatctcaggtgatcctctttgttttacagcatgtaaaatatcttctttgcttgctccattttagatatagtggtatgtttcttcatattcactaatcctgtcagtctgttctgcagctgctcttaaggaaaattctgaaaacatttaagagaggaactatgtaaacctgagaggagctgacagatgcagtctcatctctacaaaatgtaatagcagttaaaatttataataatctcttgcctgtgtttcgtactctatagctctcaataagcttatgtagccactgtctcaatgacacacccaacaatcttgtgagctacgcaggacaggtatgaataggaatgtgtccagagtacccagatcaaagaaaactctaaaatataaaagagtgctttttaaacagttttaaaatgtagtttccacacttcaaaaaattgtaccagatcaaaaatataaatatttgatttataaaaggaggaaatataagtggttaataaacatttgaaaaaaagagctcaacttcacttattaaagaatgcaaacagaatgagtagcatcttcacctgtcaaataatagcagttgtgatgacaccctcatattctgtagcaggaatttatagtgatacagtcttttaacttaaacccttaaaaatatcatactctttagcccagtaattcaccttctgggatctttccaaagaactaaactaaagtacaaaaaagactttatacctaaagacctgtgcctaaaaacgtattgcagcctcacagtgatgtttagggaaaccttagttgtaatgctctttaccacatactttcatgtaatatgtattcactgtgtatactattatatactcatgatgtattcaatatacgtcactggcattaaatctctacatgtacttaatcatttattttaggtactggggataaaatggtaagcaaaaaagacatcgtcctgacctcactaaacataaagactaacaaaaaataagtaaaatgcaaaattgtatgtactatatgatttaaattaaataaaaatccataaaagagcaattgaagaaaacataaaactgttagaaatcaccccttgatattaacatcttagaaactattttcttcttctttttttttctctcctttcaacttttcccacacagtctctgtagattagttgtaagtgtcaaagtgtgggaggcacagtgacccgggcctgtggtcctggcacataaggcggctagggcaggagttcaagaccagcctgggcaacatagcaagccctcatctatatagcaaaagaaaagaaaaaaaaaagtgtcaaggtgaatgaatgttcagttactctggcatagtaataaggctatgctttatctttcactcattgtgttttagctcatccatttgcctgaggtcatctagtatgataataaggttaaagttgaaagtttaatggctcatttataaaattaactgatttgatgttgcacaactgctctttccttcatcatccaacatttatcaaggatctattatgcaccagacactatcttaaggttggaagatacacaggtgaataggattccatcccatactcacaagaccttagagtctggtctttttgagaatcgtatattacagttcacaataggtactagaaatggcaataataaaagtgataacaataataagaagaaaaatgaatttaaaaaaactttttccatcattgagaaaagaagaattctgccttattaaattctttaacagtggattaatactgtgctttttgtctctaaaggctcctaattggggaaatttattttaaatgttagaggaaaaatcaggatactcatatagaaaaattagtcagctagtcttcaatttgtctccattaaactagcttgtgtctatcccctgacaaagctgcaagactgcaattcctaaggatgttaaagaatatcaacacagacataccagttctcaaaatacaagatgaatgatgaattgattcccattggtggagttgtgggaatgctttaaatattcctacactctgtggtaaatgaagaatctcaatttgctcataagactgttataaactcattggtatttaatagggaagaattcattatgatgttcactgctaaagtagtcttcatatattagtactaacacccctaatacagtgattcaaaacaggcagtgattttgccctgcaggagatcaatgacaatatctagaaaaatgtggagttatcacaactgagaagatgctacaaacatcccacaggtagaggtcaggaatgctgttaaacatcctgcaatatacaggacagcccacaaggcaaagaactatcctgtccaaaatgcccataatgctgagattgagaaatgttgccctaggactatatgaaggttttccgaatagaatcactttaggatcctcagtttttttgtgtattctctgagaaagctgcttcctcttttctgcctccccctttacaataatctcatttccactccacaaagaaagattgaactctctcactcatttcaaatattattatgtgcatggttcccaacacggaaaacttccattgcagtaaaaaacagacaatttgaaatattgattttgatgctgagaaaatgatcgattttaatgaatgagcaaaatcgtcttttgcaagtcaggtagtttcctttactttcaatgaaattgaaggaagatgtattcaaattatcagttattggtcattaaaatagtttttgataatagaatgctatgtgatttgaggcatatatctcagaatgagtttaaagaagtgagttcaattgctatggcaaaattagttccactttcctctgcatatttttgtgaataagtttttcaacacttgtattcctaaaaacaaaaatataaatagaatcgatgtgaaaccccattacatcctagtagtaaataatagtcaagcaaaagtaccagaattaagtgaaagaaaaaaacctcgctctggtccattaacagataatttttcttttaatatttattcttatatttagtattaggttgatggaaaagttattgcagtttttgccattacgtcagcaaaaaccgcaataacttttgcaccaacctaataaatataacatttgtaacatatttgtgtgatttttatcaattgtgttctagtgataatgataataattcaatctagaaggaattttaactcagaacctgtgttcacagagaaaaaaatggttaagtctaaaatatatacttacttttttttggagagtggtataacctagtaactaataaaagactttcaaacatgagaatttagacattagaataaaatcatgtgcaggaagtgaaagtatgaattcaaggagaaagtagatattgtaaaatttctgtaaaagagtttatacattttcttttcaaatgtatgatatgctattaaaacattttgagatttagattccattggtatatttaaatgaaactcattagttctattttaatatataaaatctaaaatgcttcaaaaattacatcctttgcagtgttattgtatatactatgtaatctacttttacaatagttctgaaatgaaaaagaatgccgtaggatccacaatttctattccacagtgttcagccatggtttttcaggtccgtattaacatggtatccttattgcttagaaactgcattagtcaagtacttgggcaacaactattgcaaactctttgaagaacccagaatgataattcattcttcgttaacttttcttagatgaccacgcacaatcatatctgagaagctttggacaacagctactgcttatttcactcaagtttttgaaagtgctagttttctaaagaaattgtgaataactaccaacctcagaatcagcaaccctgaaatccaaacagtatcctcctcaaagagacacttcagtacattccactagaccacatatctgcaaacttttatgtaaagccccaaatagtaaatattttagactttgtggcccatgtggtctctgttgttctgacattgtagcataaaatgtcagagtagcacaaatatagccacagtcaatgtgtaaatgaaaaatcatggcaatgttccaataaaactttatttacaaaaacaggtggcaggctgttgctgaccgccaacacttgaccgtcaagtccctaaagacaggatatatgtcttattgaacttagtattcccatcacctagcacaaaacctgaaactcagtaaatgttgaataagtgagtagaagtatttaagccttaagaggataacagtatacttaaaatatgctaaatgatatttatataatatatatttaataatatatataattatatatacgtaaaatgaatgatagaggagaataagacaattgtaaacctcatcgaacttagatattggccaaggagccctatttctagaagtactaggcagcttgaccacagttactagaatgaagctatagtattgaattatttcaatataattttgtatataattcaatacagttatttcaatataccattgactaataattatgcaacataatattgaataattaattaaccctcgagtataacttctgaaccccttgaggtcagacagctttgaatcctcaacttcaactctatatcttctccatagtaggtcattgaaaattcaaattaattatgaatgaggaaaggtaaatcaaaacctggccaattaataaatcaacaaacatctggtgtatctagtgtgctgtaagcattacatagttgttgaaaaagatccaatgaagaaaatgtatttattcaacaaactaacaccattatagcacttacgtgtcatgtttgcatctaatttctaacaaatattaactcagttaatcctcacagcaaatttctgattaagcagtgtttattattaggtccatttgatagaagaagaggctaaggtacaggaaggttaagtaacttgtccaaagtcacacatctagtaaatggcaaaactggaattcagacccaggcactctatctcctgagtctgtgcgatgtttcctcacataccatctcactgaatattattatacccattgtgttttttacatagctgtggaaggttgatttgttctttcaggagagtgttttatgaaggagctcacccctttttcaatgggagctaattaatattttattttctcaaactttacacataacttttgaagattcttccaagaatctaaaatagctgagtctttcctttccctcccatgaaaaaatatgctttctattagaaaatctcaaaattctcaaaacccaccattccaaaatgctgtcacttttcttgcaaagtgaacctataatgtttcaaaataacagatgcaaattgttaagtaagagtacaacacactatggcattcccaaatgacatctgtaaccagtaaaagctggatgagttaaaaagatcaatatcccagtgactaggaagaactctgtgagaagtcacttgagccaagctttcaaattgtgtagaattttattgccaaagaatcacagagaaacttttcaggtgaaaggacagaggaaacaaaatcttggcagcaaaaatcatgtgtgtgcaccaccgcaaatgaaagaaacaaagcataagagagagaactaacattgactctactctatgtgtcagactgtgtttggtccttgacctcctagggaggctagttacaatcccaggcatggaagtaaagcagtccaggtaccagtgccacctctactgcttacggtgctacttaatttctctaagcctcaatttttttgtaaagtgaagatagataataccatcatcgtaggctcattgtaagagttaaatcaaattagataacatcataacatgcttagcattgcacctgatatttagccctcattaagtggcttaacattgttcttgaatttttattgtcacacacaaaaaagtgaagtattgttatctctacattgcaaatgagaaagctgaggctcagacagtcttagactaacatctataatatatgtataattaccccagtacaataggcctccaagagagttctcactgggaagcagagatttggttattagaagaaagaattgagagatgctgaaatgtcaaaataggagttttgttgtactgagataaattgaaaatgttaggggcctagcgtttgaacttttgaaaaaaaggaaatctgtgactgttcctgtgtttaaaacttgcctcttaatgatttaggggtcactgaataaaaagaggagtcaagcatgaagcagagaagcagtctggggacttggtttggcattcagtgacagcaatgtcaacttaactgacatatcagttacctccctaaaacctgtctcatagtaagtgtccttcctcccacctaacagttcccaacatacctggtgcacttgatttgagtctggtgttttttccttatatttatttatatttgtttagcacaatctggttgaaaaaatttatagacacaacatttaccaaatataaattgcaatgtttcctcacataccatctcactgaatattattatacccattgtgttttttacatagctgtggaaggttgatttgttctttcaggggagtgttttatgaaggagctcacccctttttcaatgggagctaattaatattttattttctcatactttacacataacttttcaagattcttccaagaatctaaaatagctgagtctttcctctccctcccactaaaaaatatgctttctattagaaaaactcaaaatttcatctgagtctactttcaaatacacacctgcaaaatgcatgtgtcatcttttaaaaaaactgaaattctctcatcatttttttcttaaaatgaatcaatgtttttcttcataatttcatttttaagattccctttattcccatgattccaatgttgttttctgctgtaacgaaaggtactgacatcaggagatctaaattgtgaaacttatgtaacttgcactatactcggtccaacatcttgtggtctaattaaatacaagccaagtcagttggcagaaaggtacggcgtggtggtgtggatattagcaccttgttagcagtcaaaaacctgctttctcaggcagaacctatttctgaatacaaagttttatatagattaatgctgtaatgtttgaaaggcatttgataaacaaacttatatttgaatctggaaatagaaatattttcttaccagacattttaatctaattttatttttttaaaaagggtagccccatactctattgggcattacccgaaaaccattgttttaccttttagtgtttaatttctagaaatagaaaaaattatacttaaaatgtcactatgagagaaatgatcttggaaaaaatattataaatgtgtaatataaataaaaataagttataaggttcacattccctggcattagtctaaatcttcttcatcataggtaattcttgttgaacactcactatgtgaaaggcactgtgctaaatacttcatgtgaattacctcagttaatcatcagaataaacccttgagattagcagtatttttatccccatgtcacaggtgaagaaaatgaagcacagagaggttaagtcatttgtccaaagttacccagatagtatttgaaggaactgagattttaattcagatttttaacagctctgccctccccattacagacctatggctacaagatgcttcaagctgacctcctcctctgggtctatctcatttgtctcagaggtcttttctggggtacacctcccttactctagtcaagccaacgctaagtgagtggtctagggaaatgcactaatttatcttcttctttaagtcatgcataagatgaaagcttccctccgtggcaccgttaattgaacatgtgaaatgagaggaagatcgttcaaaaacattgcaaagcatgtctttctaccgaatgggcatttaaaaaattgccaccaatgaccacacactgcaactgaccctaagacaacctgaattaatttgagaacatgtggttcacacctaagtgcaaggagtatccaacatagtggtactttgctatctcacaaaagacagactgtcttctgggggttcagtggaaagacttctagaatttaaatcaagaggtgtgttgttacccttaactatgcagcctgcgcaagtcacctctttgccccgccacgatcctcatttctgaatgagaatgtgggctgtggttgtctcaagagtactttccagctttcaaagtccataagttcatgccctccagtataaaacttttcttacattgttacaaggattggttttcggttattttagtttttgagggaacaggagcttttatagactaggtaacctgtccaaaatcaaacagatataagatgtgccgctgggatgctaccttagaaccatgtaattccaaaatcctgaactacagtgtcctttgtgattttaaagtctagtagacctgtcccctaaaatatgctttttctccaacttgttagaattacagttaatttttacatagtctcataatcttacaatacaccaagaatacaatattcattagaactatagtaaggtaagggtcgtgtatatcaaaagaagagtatggctgttcttgaatgctatgataaagtatattttacagagaaattcagcctagattttatttataccccagtaaatgagtttaccgaatcctttcctaagaacctattttcataggaatatgaggaaaaagctcaaaggcctgaaaacttgaaagatagttccatcccctcttgataaagtcgagatggagccagaaaggttgtgctgatttcagataaatatcctacctactgcacaattttgctgagggctagttggagtgtgcacacgcatgcacgcgggaagtatttagagaagtcagggtgggtaggttgtgtgggagacaggggaattcaatgaagggagattctttagcctttccttcaagtacatctttctcctgagtacatttacttccatcacaatggactagaagagatccttgcttagtggtgcagaacccttgagacctaatttagcttttataggaaattcaaaaagagaaagacggcacaagagcaagagaacagaacaaagatatgagtttgtacagagaatattgatacttgtggactgcttctgtaactcttttaaaataaattttctaagtaaatgctgacgtagacttttctgttagtggaaggctgagctcctcccgccaaacaatgcgctgcccaaatcatctttacaattcccgacagtctgtcgtctccgaagctcgggttcattggtttttattctgtgaaggtcaggaagcgttttggaaaaataaattttcctttttaatttcttaaattaaatgtgtcttcccaaggatgcccagaaataggaaagttacataaatgctaattaaaaacatgcctgacaagctgtgcccactagtcccgttgatcattctttaattcacatttcacagcaatttctaagaacatcaccacgtccttcattaactacatatcaattaaaatacctctgagaggcaggtacaataatgcactatatattatccttgaaaactgaaaggcccactttgctaactgctacacacagcacatagagacttagagagagaaggaaaaaaaataaagcctgcccttaaggatttcgcagacgatgaagaaagacattttttccaatgctgtacaaaaagaaaagaaagaaaaaaaaaatcagcggcttaaccagacaatcagtgggagggataggaccagacctagacattcttattctttctcatgtaatgcaggcacaaaatctaaatagtcattcgcaagcaattttgccacacaaatataaagttgttaatgtaaagagcccatattatatttatggatggctgtagcagtgtagtagtaaaaggcagactgactgaaagaaaaaaacaactttgaaaaccttgaattctgaaaataagtgtctttctgccctacttatgttctgcatcggctaggatcgtttacctactcctcttcatctgtttcctcacctgtccaatatgataccaatgacagctacatcattgaataggtgtaagaattaaataaggcaataaatatcaaatctactaggttcttttttaatttttttttgtttattaaattcagatgatagtgagataaattaccaggttcttaactggttgtatcattatttgatacatagcaataatatacaatatttcaacttttaaaagttggcttcaaacagctacctagaatttaatatgccttttatatttctgggcctggctttttttttctgcacattgtgaacctgcctgtggttctgttgatcttgcatcttgcctgataatgagctaaccattatcactaaccttagagtcttacatattctatagtctatttcctatctattgctccacactattgcaggcctgttagacatgaaaataaatggtaaaattctgtgatttaacagattaattaaccagatcgaggtgttaaattgaggcaatcatcttcatgtggctaaccctgtatttagtttattaggcaaccagatgccaattggcattccctatcagctagaaaaatacataaacatagcatcttcctggtctctaaatcctgctgttaactaaaacttcattgtaccactgcattaatcaccaagcttgagctgaaacttttgtttttattctggaaagataatttattccaaataatgtttcacttaagggtctaatcgtaagtccaagatgattcagatggtgaagtccagctgtaacaacaacagtatcatccagaaaaataaccacatgtatattgaatcccttgaaagttttccataacagatctgggggtgataaatcatgcaaactcattctataattaactaaagtgtttcttttccttcaccataatccaaaaggattagcccatgacatttagctggataaatcagggggccataatttactccactgtacaaaattaaattcagattttaaaatctaacaacaaaaaaatcaaacacaccccaaagtgagccttttctgaaactttaaaataagtcttcacagttaataaaagtttgaacaatgaacaatatctctatgataaatagcacagctttcaataatatatttcagaacttttccgtaggactctcctgaaatgtcatgattatatcatctggaaaacttattgagcaagtgacatggataaactaagagagccaggcttctacagtttactcctgatctcggattgtcacaggttaatttttcatcgttttatccctatcactgaatacagtacctgtcacgagtgtctgttaaatgaaagcaccaagaaaattgaaccataccttgtttcctaatctgtaatagtatgaaagtatggttagcctctttagatggttcactataaaattataaggactagtgaagcaacattgctgcagtttttgacattttataaatatgctccttgtgtattttatcctatactaatttctgctcttgtctgcaacaggccttggttctgttcttatttggcttttgttttctgttgtcacaccactgatacattcaatgaaaatgtattgagcagtcacttaagacctttctgcaacaaagcagaagatggatggattgatagaaagataactttctctagaaaacatttataattactgaattttagcagtaaacttagtaaaattactgtattttagcatgccttcaatttgttttacattttcagccctctaaaaaattggctgtctttggagaattgcattgtgttgaacttattgatttccactgaacatgctgaaaatgcccattatttgatgcatcattaatataataatagagatcaagcatttttagattcaaaataactgacatcaaaatcttacaagcattagaaaaatagaaggtagaattcaccttctctccaggaacaactaaccaaaattattctatacagtgatttttattacattattgtctgagttacctgtatgtaggtcaaataaaggctgagaaattgagttcacattattaacccaataactgatcacaaactggtaatacagcagtggatgggtgtttgcttcaataagggtaaagcccaattctttgattttgctaaaataaattatttacaatgtagtgcattgtctgtcacttgcttccttagaggatggtgttgatattcagttttttaaaaatggctaccaaaaagaggacaacgtaaatcagaatctgtgtaggttattcttcacaaggaacaacttgtaagccaaagtcattgtttggtgctccactgtacccagataatcaaccaaagaatggaaagaagtgttttgatgaataggggcatcactgcaaatcactactggtctaaaaaaagaagcagaatgtaaaatgcatgtgagcacctcttttcttacttctagttctacctaattcttattaacctagcacatcacactgatttataggatagggatggtgccacttgagtttaggtgcataacaagcagtaaacatttggtagatatttcttgaggtttgactctggttgttatctgttgattctctcaaattcctcctcttttaatttaaaaattaaaatttaaatgcagtcttttaatttgctatagtcttatgtttttcccttacattttcttacaagtctgtttgttttctgtcatttctcagtttttccattatctcatagttctctcccttaagattgatgcattttctgtcttcttttgttatcctttcatcttttcgtcttgtttccctctttttcattgattttatctcagtagtcttctaattttttttccatttattttcaaagcatttgcttggcctgcatcttcctcttcctctcttcaatctgcccattttcatgctttcctttaaatagctccacctttagcaaaactttatcacaactgccactggattcagaaaaaaagattgcaaaatcttattcttgtaccttcattaactgggagagatgcaaagtataaatctgtatttacaagccatggatctgatttaaaagtatgattgtcccatatctgtgttattgtacatatatgaacaattcacaactaaaggactcaagccagagctttcaaaataaactcgttggcctgattgccagtgccctataatcagaacattaaaaggaaaaaaatcacctgtgatgctttttccaaactagctttaactaaactctttgtctagaagacggttaatccaaacactttttaaacttgattcttttaataaggataagtaatcttttgtttcctgttgaatcttccttcttgaattaatattaagtatggcctgacttttgatgaactgatatatgcacctaaggctgtttgggttcatagtcagtctttaattcctgagctgtgaaatgctcttgagaatgagtcaatggcacaccactccagagtttgaaatttgcaacatgaaaattattgccatgactttattcactgaatcaacgacacctttttttttttttttttttttaccaaatagtatgtaccaaaacctgtgctaatttggagggaataaagaggaataaggtaaatatctcatcatctacagaaagctggagacatgaccaaccagtaattccagtatagtgggatatgccagggtggggttttatgtgaggtgctaggaggtcacaggagaggagacttagtttgtcctggatggcaagtgaagagaagactgtggaaaggcttgaagaaaagtggggttccagaggaaggaacagttaaggtcagtcaaagcaagagcaatatccaaaaagtgattcattttttactagatgctatggataatgaaattgggtaaaaacttgccttgagtgattgatactacagcagagtcattataatctcttacatactaaatcttaagagatcttgaaggaaattcaaaggtcttgacttctgctgaaaagctaattacctttattttttgctgaccttttcatttcctttctacaagatgagctgttgatttaaatgcatgcataaaagattccactaatttatagaagaatgtaatgtttaaatacctatcctattgtttgttcaaaatatgcctgtggtatcttctctatttgcataatgtaaatacttttttttaaccactattgattctttccttgtcgggtaatcaaagcttagatcaaccattgtaattcaaatatgaaaagccacattcaaaaaattataatatttgtctttttttatgttcaacaatgaaagagaaaaataaaagtattatatagcctgcaaagatcacatctggaagcctggtttttctttaaatttgttaaaaattttttgaaaaatatgtctttgattctaatttcctaatacctaatatttcaatattctaataatctaataaggaaaatctttagaaagggaaattattattttcacctggaatctgccataacacaaagctaaggatataaaaagtacccaataattactcatcaaattatatttaattttacttaaaactaagtctacttagtgatttacattcctaatgctggtaaataaacacaaaagattaacccaaagctgtataatctttagatcaagaatgacaatattagactcttgattttcaaaaagcgagcaatacttcattttatcaactgaatggagaaagaagtgtgttttatgtgccataatcactactgtggcttattaattcctttgtaagaaaaatatagaggttataaagagttggaggttatattgatttttcattactagctaaaggtttgcatgccatataaaatgcattctaaaatcaaggtgggagaagtcatgttcccaagatccttttttagaaatcagtgggaaaccaaaaagttatatagtctagttcataaagttaggcagtagggtggtaaaactgtattgttactctttcatagaggaagctagaggtttatctttatacataactgatcaaataatcttctatttcccatcttacatttcacattttattaaatcagtcagattttcttcctggtcccttttaaaaggacaagaggatgtcatgcccacacagaattttcactctatgaacagcaagtaggcaggtatgtgggaaaccggatttaagttcagatgttcccatgggaaaatgaataaattaaagagcatacattttcagtttttgtaataagtatagaattctactgttttttgctttccatccccattctaacagaacctcgatgaaattcaggaaccctttgcgtcccgaaattcccaactaaatgaatcttttttaaagattcaggtgattttcacgtagagccaacgctgagagacattgagaaagcaaatgcaaatttactagagttaattactaaattttttaaagtataggggaaaaaattgcaaaatgactagttagaaaatacaaggatgggttacagtcactttaagaaaaaattgtttgtgccgatgaatctaatttacagcttcttcacacacggtctctttcacaataagaaaccaaaatgggctatcaaaaactcttctaatttggaatcactcaagttgtagtaggcactcctggcttgcatcagaatcacaagagaatttatttgaaatgcagattactgaatcaaaatctgtaacagagggacccaataatttaacaaacatccactttcactttcacaaaaacccccaaaatgattcttactctaaagcttgagattcattactccagttaactcacacactttccccttagaaaataaaaggtttacatttaactatgtggcttgagcaaccaacgagaaaaccctaaaagacttattcagacccaactgggcagtcagcagtagtgatcccagcatggagctcgccttccttcccctgctcagtgcctcctccatcacactttctcctttctcatctttgaagctgctctgccacaatagaatgggtctattttcatcaaatgcctacttctcagaattttccattacttcttccagctaatgaggatgcatctgtaagacatccaacacaaacttcctgtcagctaccaaaaactcccatttgtgccagaaacttgaggaaggtgtattttcttagatgcccaatgtactgtgatttgtgatattgctgcagtggtatctggtttttaaaattgtgtagttataaccaatttcagaatgcaccacatctgcaataatataaaagagaaacttagggcaaacatgggagatgctcatggctgatcagaagaaaaaaagggggctaatataccttttagaaattgatgctttaagaaacaaaaagcaagcaacaaagagagttgcatcaggctctatcactggacttatgattagagagagcttggaagggttgcctttcagggaggtttacaaacataagccttcctgaatggaacgttgggattaaagagctaaattccatcaagtgccaatattatatgttgatagatttacagctactctcaaaagacaacttgtgaaagacatccttattaattaaagctagccaaaagactcatgagaatttagaaaccgtaagcatgagtaatcaaccattatctgttactataatagtaatacatttttcagtgtgaaaggactttgttattcagatttcacattagaaatttagtctcaagcattttttagataggatgtgaggagtaggtttagttactatactctactatggaaaacaagatgctaaattatggacagttatgaatcattcattcttaagtatttactgaacacctattatgtgccagtcgctgttccaaaatctgggaatcaagcagacagaaaagagaccaaaaccccctaccctaatgaaacctacattccagaagggaaggacagtcagtaatttaaaaacaagtaaaattgaaagtatttgtgacaatggtaagttctacaaagaataataaagcaaggaagaggtttagaaactgtcaaaaggatgcattgcagggaattttttttatatgacaaaatttaaacaacatctgttattaccaaaaatgattttagattttacagactcagtatcatttagctcaaccccctggttttacagaagagagaacacaaccgtccgcaattcatgttttgtcaaagatttccaagtctgatcacatgaaggccagtgctctttgcaccatatcctgtgcctgtcttgggagtttaggagttgtcccttcaaatctgttttgtcactacaaacgagcccaggctttgactaagaatgttttcactcttccaaaatatttctctctgtgtatctcaccagcagcgtgtttatagggtagcaggttgacttcatgcacttgaagatagatggctgctaacaccatgctgtgagtggtgacgtaatttcacatgattccaaatggggtttcggagctactcttccaagacagagatctatatagacgatcaacagatgaccataaatatagtttgctataatttatttttaaactatctatgtgtttttaaaagaaactccaaatctgtcactttcttttccctaaacctcagtggcataaaaccagagatcattttttcactagggcaaggatcagagagaccttgaaggaagaggagcaagaaattacccaacttgagtgaaactgtaagctacataaagggactgaggggttcttagagtccaagtgttgaaacacttttaaagtgcagttattactagaagtaactgtgaaaatactactctcctagcgcagctgctccctgcatatttgctttactgaaaaaagaaaaatgtttattctggttagtactgcaagcctcaggcatcaacgtctcaagtgtctcctaatctctcctcgcacagccgtccgtctggcggtgggaaaagcagcagctctggatgtttgaatccaggatttagtgtgccaggccaaagtcttgttaccctttccacttgtaagctgtgaacaaatgagagaaagacagagacagactgtggatatacctaaactagtttttacactctaactgtgagcctaattgggttttcaataccatttaggcacaacctgaaaattatttcttctgaatgtaacatcttcttttgtaatattactgaaattattttcttcttcttttgtaatgttgcactagcttttattgaagagctactaggtgctattctatgtcctatgctttagattttgttgcacagacaagaagactgaccaacatttgttgtgtgcctactctatcccaggcactggataggcaatcccgtgaagtggatattgctattaatgccatgttttccatgaggaaatgagactaaggtaggttaaataacattcctaagcttgtgtactcactcagtgagtgttggagctaagatttcagaccagcaggattcaaattcttgaaacttctttcaaaaaatggttgattgaactctctttatttgacaaccattttaaggagaagtgctctattcgttatctatgaagatggttaaagagtagaggaaatattattgcaaggaccaaatatttcataattaagaaaaatttatcctgctattacagaatttccaagcatggacttttagatgataatatctaattttcttgatacaggggagagatattaaaacccaaggacttctaaagtttgatttgttatagaaaaattagggaagaaaggaaagaaggatagtctgtcatggaagcaagactgaacagaagaatgaagaagataaataagaaatttataatctaagaatagttaatgcaaagctagaaaaaaaaaagtaacactgagaacagatttaataatttagttcttaaccataaaagaactctccatagtttctgctccttgtaggatcactgcatatttctccaatatttcaatctttgaaaattgaggctttctttgcctcaacttctcatctttaaaatgggcataataatagtacttggctcaatgacttttgagaattaaaatagtaaaatatactattaataaatagtaaatttatgtttattttaaaatataaatagtatgtttgaaagagctaatataaagtaccttaaaagtgctttaaacagtgactagtacataacaagcacacaatgaatgttggatattgtcatttttattattacatatctttgtataaaagcatgatacctagggaaatgaaaactagctccctggtttctgtcctaaattatagatttttaaaattaaattggtatattagggtgatgggtgcaccaaaatctcagaaatcaccgctgaaggacttactcatgtaaccaaacaccacatgttccctaaaaaacctattaaaataaatacattgaaaataataaatttgcatattaatttagcaacactccacagctatgtcaaaaaaaagtgcatcagactgatggtgtgcccactcaagattctgtggtataaatacctgtctctcatcccaaatgtataagcacttcatgtttcttctgaaaattgatcctccctttctgtttctacaaatctctgagataaatctaaattccactccaagtgggatgaaaggtcacataagcaaaatattttccaagtggaagtaaaattgtattccctcttagattttggtggttgaggaagaaaacatgattctattcatttcttttggtcgttgactgaaaattctccacctttaggtttagcaaagtcaaatctatcatagttggtgtaccctgaatttgaagccaaatacatccccaagattaaagtgaagccagtatctgtaaaggtgacactggtcatgttatggatgctgctgtgaaaacttcgcattgctttctgcaagtagaactggccatatggccaccgggagagaaaatttggtctttcttgtcaggtagatccagagacgatggaccaagtagaggaaaaattgtcacgctgacatttatgctgataaccaaaaggaactgatctgcaaatcaggcaaacacctacggcttgtggtttgtaattattcattttcctttatatcattcctcctggtaggtatgaattaagaacattgatccttccacgctgtcctcaaggtggcgttgtttctaatgtaggctaattgtttatttcccaatgactaattgagattttttattattattatattatactttaagttctagggtacatgtgcacaacgtgcaggtttgttacatatgtacacatgtgccacgttggtgtgctgcacccattaactcgtcatttacattaggtgtatctcctaatgctatccttccccctaccccctaccccacgacaggccccggtgtgtgatgctcctcatcctgtgtccaagtgttcttaattttttttcctttttattattttcatttgttaaacgttattcttatcccagaaatgatttataactcttcctttttccttgtttcataaggcactagattattatattgttaatgatactatcctgcaatatagtactcccccaatgatgctatttatgtcatgaaaaagccttcaatacctgagaacattttgctaaggagtcagtttacttttaaatagttatcagtcagcatgagtgagctcacatctttgtaaacatgtaaactgatggcctaaacactgggatttcactgattattgtatcaaagcgacaatgattgatcaaagtcaagttttctgctttttaaaacgcagccattaacccaaagctgcctaccaacaatgggtgcaagatgccaccttcagactaggtccatgtgcacagccaaatcaaaagtggccccaaagttttcagttttctatgtattatgcccaagataaactgaagatctggaaatactgagaagctgaatttcccctcctgaatgaatggcattcccatttcagaaataccaagcttggggttttatgccattttatccctctgtgaaatgcagttctattacgagatccgtttagagagctcagacatcttaggttcagacatctaaacttaggatatgtataaccactgcataattgccttctttaaatagaatgacaatcaagttttattgttatttggctcctttaatatacaagagaaaaaaataagccctacattttttaatgatatcttcttttgaaagaaaaataagtacaaatgaactcagaatagcttttctctttccacactcccctagtaaattttgagtgtaaacatactaaactttacatgagacttttttttataaagactgctgtcttcttgcagatggggtgcagtttatctggaggggtgatgaattcctagtcttgaaatgcacagtgtcaaaatcattgccatttaaagttacatcttgaaaatttttcatcagaattaatgctacgtgatgtctcaagcccttgaaaaaccttcagtgtttctttttatctaagctgacacactgtcactgtgaataaaaataaaagaacatataatgctgtggaatcatttgcaatcagaaattttgtttcaagcttacctatccttgatcagctatgatctgtagagtcaatattaatttctaaaaattaaacgaatagtatttatataattatttcctatgctattctatacataagggaagtgactaacaattctgtttcaacagtcacatcacatagatgtgtatatctttgaagatcattcaaatctaacacattctccagctctccccactttttctcagtgatcagttctgatatccagctccaaagcaccactctaagtttcccttcccactctccttcactcctcctgatctttattcctcaaaagcctattttagtcttattactactactaatcagagtgaagaatccagtgctatactctacattgctgctttccttattggttcagctatacatcatactcttcaggagtaaaattcttgtcttcaacatatccaacaaatccttcagagcattaatattgagctttatgttcaggagacccttagtaagtgtggacagtgtggtagcatattccatgagctaaaaatggcagctggtgtgatgaattccatatatgtgtgtatacatatattaaatatatgtattatatataacttatacatatatgtttatacatatatgtgtgttacatatgtttatatacatatacattttttctatatacacacgtgtatgtgtatatgtgtatatatatacacatagatacatatatatatacacatatatatgtgtgtgtgtgtatatatatatatgttagtttttgttgggctcattttgaataagtgaccttcattttaaaatcaggaaactttgcaaaaattcagattttcagtttctcttttaaaaagttaggagattggggcccccactcccataaggcagcacatctggagctgagaagtggcttccatcttgagataggcatcattttctctgtatttccatttcccactgaacttgctttactcattacaccacctgcttggactctgtaggcacttgtgtttgctacctctgctccacacaaacattgttcaaagactttctaattcgttttatagaattatctcacaaacgtaacttccccatgaggaaaatgatagatgtttcccctgagaggatcccgtcagtgtcaaaatgtttttcctggggctttcctcatatttatgcaaaattttgcaggactttatagttccacaggagcctcattcagctgctcccattctgggaatatgatgagatctacatttttgaaatgttctgtaaaatgtcctgaaaaattactcacagtggcagtgacagcaacatccccaacctggagaagtactaatgatgataaaatagaagcagagtccctttgacatgtatgcttttcatcacaatgtggttctccaagagttaaccaggtctaatgtgtattattttgttgtcttttaaaaatctactccccaacacacacttttttgaaaaattagtttaatctggttgggcctggtcaagcttatttaaattgattgcagggctgagcatcagtccagagagacaatgctgtcagttctcacacgtttggctttgccattatatccatcagctatagtagttatgattccttaattaggaggagcctagataaatgtctaattcctttttactaaatatattcgtgctgaaatttcagacttttaagaatattgaacttgttctcttactgaaaagttaaaaagttaatgacattcttgaaaaaaacttgtgcattaggggttggtaaaggggacattaaagaaggatgctgtactgttgacttgtttctttaatcttgaattggggagaaaatctctccaaatagtggatggccactgtggtatcaggatagccgttctatgacgaaattatttatatctctacttggtgttcttcaggactgagaccacatttaacttttctgaagctgttccttcttctatttcataattatcttttccctatgtttgctattttcttcctatggttaaaatggcgaggttcatatacggataaaaatagactaaatgccttttagcactcccttaaggagctaagagggttctgagaaagaagtttctctcagatacggaatggtgaatggaggttggtagttaaagggcactagttaactatgattgataatggcctgatattatttctttgatcttatttcccttcccctttttaatccacatgaatagtaatgaacacagctgagtgaatgaacacaaaagcagataagccactgtgtgcattttataccctccaatctaatgagtgcgttgtctttagcatcattaatgagttttgcaaaatctgtaatattttcatagaacatcattgcagcttgtttaagggtcatttgaccatattttgcccctggcaccagagtgatggcttcatttttaatgacagatgctaattctaattagcagtctggaaaaagtcagactgagttctgggtgagcctgcctgcccacccatacaccctagatgctaacttgaaccccagtgccaccatatataaattctctctgcaatgcctaagaaaagatgctgacgttgctgctgcaccccctatggtggatacagaggaagggaatattttgacataatgatcacaataatattttcattctgcagctactgtaccccaaagtggctatgtcaggacattacttcgtctttttctgttttctcaaccacaaaatcagactcacaattggatttggcagctgccaagctaccctaatatagcagcagacgaatccaggcaaagaacagatctatcactgtatctgactgatctttctgcttatgcacagtgacaaattctcacctctccatatagatcagcgggctctgtaaccagtcagtcacgcataagttgtgacagcgcatcacaagactggcaatttggagccctggagaacaaggtgaaacatgcagttattttacatgaaaactgcagtctttcccagagcaccataggggtgtgtgtgtgttgtgtgtgtgtatgtgtgtgtctgtgtgtacaacattttacaaaaagaaacagattgttctattcactatattaaaatacacagaaaaaggagatgaaaaaacaaatctttgcattgcaggagagggatttacattgcccattgaataaagactaagcagatcttttttcccaccttcttctaggttactcagaatggctaaatcaagggaatgcctggctaatgagaatatgtgtatgtgtctctgggattccagggctgtgcctaggatggcagaatggaaaaaatcttggaataaattttccaatcttcctctccctagttctagtaaaacgcaatcacgggaggcttctgtttaccctagtaaaatcaataccgcccccccacccacacacacacacttttatgtctcaatttaagaactttgagaaatggttttgatatttgatatttgcaaggattttagagaaactccctttgtcattttatggtaagcatattaacaaaagaagatgtctggctgcttcagaaatgtttcagggtatgaggtgacaatacttcccatgagctatccaaattcagaaaaaaattggggaattgctaaaaaaaatctagtaataatgcatgcatgttggaatttataggttagtagtatacaaattaaatatattttaacattactcatttataagaagccaaatgtaagtacaaatgactggaaaataaaatggcataggattttagggttgttgttgttgttgattatctataaattatggatataagggatagtaggtcctggtcttaggacactcttaggtcattgattcaacagatattcccaaatggaaacaatagagtcatatctaaaaagtaaatttattacgaagtctcataaaatataacgtatttctctgcttacatgaagtattcttctgttcagttacttccatcaagaaaagacaagactttattcagtttatggtttattatgatttagataattaatataacatcttgtttttaaaaggtttaaaaaagagaggagtcagttgctatacttactgtgctaaaaaagggcgggggctaaaatactgcattaaaactgagtaggattctgatgatgctgaagaagaggaggaggggagggaagaggagaaggagaatgaggaagaaaagaggtagtagaagaggaagaggagattagaaaaattatactaactctgatgtatttctgcaggataatagacagagaggatcctttctatgttaactagttcttcgagttcatgtaagtccttggaaatacattaactgaaatccttcacctcttttggggaaatgacagagccattagttcaaatatttggtaaattaattataaacaactgtaaacctccctgctctcactttctggagcaaactcaattgactacattattccaaaccaattgttcactctgactgtcccgtagcaataagaccaagtcagtaacttcaaggttccagaaatggactgtgtatctggactcatttgttaaattgtttccatagcaagaaaaaaaattctgaaaatgtaagaaatacaaaaagaaaacatcagcttactagcccacagtcacctggtgagacagcaataaagacagtagtttgatatctgccattcaaaaagcttttaacttgcagagagagagagaaagagagagactttttaaacttttctatagtgtgttaactatccccatgacccacacgagggagaattctctcttatattaatatcgcacttttattctttgctcatacagtttacttatttgaatttgaattgattcctacaaccacttggtaatatatatataaggcagttataagacccattttacaaataaggaaactgagcccaagaggttaagtgacttatttcaagttatagagccagttaagagccaagctgaaaacagagtgcagctctttattttctgaatttaatgtagttttctagaatgtcatggtgcctccttcatcattcatcgttacctcttccccgtggttcctggcatgaaaatctgtttttgcttgggaacttgaagaataaagactgtgtatcctcttatgtagtaaacagagatgaacgaagtaataacgtattaagcatctgaaagcaaagactttttctgcatatggctttctagttcttaaactttttatttttttctcttactcacttttgtttattcaaaagaaagtccccacagcatctcctgaaacttgaaaaggctaatttgtttcccccacatgaaatcctcatctcctgtttttttaacaagagttgaaaaaaaatcatcaaacaggtgtttgttttcttaaaaacacaaataacatttaattttattcattctgcttcaaaaataagcattttattcattagtccagaattaaacattttcaaagagctttgttgctgactagttgcatgccatttgaagttttaaatgtcatttgatgagttttagcagtacagacatagaaataataaaaagatgtatgctaactaatgaaatacataatacagtcatgtgccacatagcaacattttggtctgatgagggtaccataaatttataatggacctgaaaaatacctatctcctagttatgtcatagcagttgtaacattgtagcacaattacttttttaaaaaatatagcatagcctaagtgtaaagtgtttaggaagtctacggtagtatacagtaacgtcctaggccttcattcactcagctctcactcactgactcatccagagaaacttccagtcctgcaagctccactaatggtaagtttcctatataggtgtaccacttttatcttttatactctatttttactataccttttctatatttagatatgtttagatgcacaaatatttactgttacgttacaattgcctacagtatttagttcagtcacatgctatacatgtttgcagcctaggagcaatagttaaaccatatagcctagctatatagtaggctataccatttagacttgtgtaagtacactctgtggtgtttacacaacaatgaaatcacctaacatgcatgtctctgaacttatcccccaaattaagtgatgcatgattgtattcttgttctcaagaagccctcttggatgatttttaaaatagtaaaagaaatgttaacaataaagaaatttatttggttttgtccactgttcaccacctcagttaaaaaattaaagctgaatgaaagaaataaaactttaggatttgaaaagcagggaaaaaatttcaagagattatttgttttgcataatttattgtgaaagtgcttcctctgttagtattttgcttcagcaatactattataaatactgtacacctcaattgttattatttattagcaattattaattaatcaatgcacaaataaaatcagaaaactttgggaaacatttatttatatatgtgcatgtatgtacagattatacctgatctacttcataaagtaatttttattagcttacagcaaaagacaaagatgcaaaaaaaaaaaaaacagaattaaaaggaagggttaaatagtaaaagggaaatattccagtcataattaagagcatcgtctttagagtcagataaaactggcagcttggcatttctaatccaagattgtctggctgtgtgaccttggacaattcactcaacttccctgatccccagctcattacttaatcaaacacagataataatgcccaccttgaagaagatagtggcagctattgttttcattcctgaaatgctcttgctaatgaattctacactaattaaatacaaaaacaaaaatctgacctacactccctgccccacttatgattatatagaaatatatatttaaaaagctaaactcaagttcattttctatgaaggttagaaataccaagttaaattttaaaacaaacactgtagaatggtattcatgaatacacctcacatgttgagcaatatcttatggaagtaagcaatcaattaagaaccacagcagaaaattgtaagcaaacatcagagataatgacatatatttagttttaaatttataggcatgttttgcattaagatttcatttagatgttgctggtttctctttataacaccccttgaaatgcaatatctttagagaaactacttctatcatgctgtaaaaatgagcgcacagctttccaagattggctgttgttcggatgagaacaaataaaagaaacaaaatgtcatgtacaaaattgctcattttgaatataaactggaactttctattcataactttcatacatatttatggaaagcaggccacattcaagacactgttttaaagtactgggctacagcgttaagaagccagaaaacgttcttgccctcatagagcgttttgttcatttgtagtgaagaagatcatgaacacagcaacaaaaaaatgatacaaatggcatttatagataaatgctatgaagacaaataaagctggataagggaataaagaatggcagggaagacaggggccagtgagatggggccagcttttactatgaattccatgtgaaggtagaaggaaaatattatttcaagcacaattccagaaaaccttaagtttcgttgttaaattgccaaatcacttacccaccttaacctctcaaaaaaaaaaaaaaaaaaaattccaaagaaacagagtaattttgctccttgcctcagccctaagtcatctcccagacaaaaaagcaatcatcattgtcaaatttaaaagggaaaaggaaagacttttatttgaatgaaaagatttttttcagtgtgatagagagggaagactgaaataaacagaatttacaaccttcgcacctttgcaccttcctcttctagcaatatggcaaactaaataacttgcactgaaaacgagttaaaaagctgtatacttttttaaaaaatatattttgtttatgtcattgatctgcacagtttgaatacaaaaatatatataacagagaatatattgagggcttttgctgccacccctgccccctctgctcactctgtgccccaacctgcctcctctagcttatcacttgtgttactttcttttgcatccttccacgtcatagctgtgtaacctcagtcacattatttaacccctctatgcttcaatttctgcatctgcaaaaataaataaaacagtatccacattgaagggtcttaatgagtattaattggtttaatattcagaaaacacatcaaagaattcctgacaaaagaaatgtgtaagctatcagttaagtaaatcaacgcatacagcaaataagaaaatatattcgtaacttcctcctcaattgtacaaaagatagaatataataccctctagtttgtgatttggcatttttttacttaaaatatctcattattggtacagggatctttctcattcttttttttttaagctgcatagtattacattgaatagatgtaccatatttaatttaaatgcttctctgttgatcatttgggatgcttccagtcttctgcttttagaaacaatgcttcattggaaaaccacataaatatatcatcttgtaggtatgcaggtaaatctatcggacaaattttcaaaagtgagattgcagaattgaagagttaaatacatcaattattttatatacatttccaaactgctctctgtagtttccaaattgctccctgtagtgtttgtatcgtgttgtaccccaccagcatctatgaaggtgcctgagaaaacatcttttaaaaatacattgttgagccgggcaccgtggtgcacgcctataattccagcactttaggaggccaaggcgggtagatcacctgaggtcaggagttcaagaccagcctggccaacatggtgaaaccctgtctctactaaaaatataaaagtagccgggtgtggtggtacatgcctgtaatctcagctactcaggaggctgaggcacgaaaatcacttgaaccttggaggtggaggttgcagtgagccaagatcgcgccactgctctccagcctgggcaacagaaagagactccatctcaaaaaaaaaaaaaaaaaaaaaaaaaaagtaaaggcttttgagaaccaaccaaccaatcaaacaaacaaaaaacacatatgacaaagctagaatcaagagaagtgggctctatattaaacaattatattttaaaagatttaaatgataaaataattcttgtcataaaaacttagagtgatgtgcatagtacaaaagaacagccctcccctgtaaacagccgtcttatcctccagcctcccttcactttcttaaactgactctatttaacctgtgattaattattttcctaaactatgttttgaagttttagatatgatgtcgttctgggaacagggctatttataatgttgatgtgtgtttaaactgtgagagatttgcaaagtttaaatacaaatatttgggtagaaaaataagcttccctttaataaacttacaaacatacctaatccggaaaggagaaggagggcatttaagcttttatttctgagctatctgccaaccctcatgagctttcatttcaataggtgtggggagtacaggagacaggatagtaatcttaggaccttctcctaatggagattctaataggagacctccatgacattagataatttttgagatttaatagctgcaaaaattcctgagaattaatactacaaagttgttctcttgtggattttcagcccaaatttatactacctatgtgggcgagagggagcccaatccaatacaaaaatttatctcaaataaatggtagtacccttagatacctatcttgaagcaaatgcaatcctcttaaaaaaaaatgaaacttcaatccagacttcaaagaattcacacaaagttctacaaaatataaattaacaatcaaaaatgacaaaaacactaaagtaaacaaaataccctaactgaaacacagacagaaaatctagattccttaagacttcagatactagaattacaggatccaaatatgaaattagtatgcttcctgtgattcaagaaataaaaagtgatacatattatgtaagtgataagcaggagacaatgaataacaccaaacgtatttgcaaaaaagcaaaaacatttgcagaaatgaaaaatgtattgtttgaaatcgaatttcagtggacattaaattgcaaagtagacacaactgaagagagacttagtgaagacattatcctcaatgcagcacagaaaggcaaggagctagaaaatttaaaaaacaaaggaagagaaatagaagatgaaggtctaccataaaattaactagaatcacagaaagatagggagagaaaatgagaggcaatatttaagaagatactctgcagtttttcacaactgataaaagatgttacttctctgacttagcaaaatcatccctttcctgcttatccaatatctttttccaaaaattgtggctaactctactcaagatgctcataattccagtattaattatctaagaattcttccaaggatctcccaagaacacatttctcaatcttgtttctcagggtctacttaaaaggtagtggggtattgtggaaagcctctgggagtataagaatctggatcaaggtctggtctttgcatagcctatctttgtagtgccaggcaacgtacttaagccttctgagcttcagcattctcatgcttaaaatgggaataatggaatctaccttaaaagacaggttatgaaaattaaatgctgtagcatatataaaatgcccagcatactgcctggcatattttaggtacttagcacatgttcattccatttgcacatcattaattctcacagtcccagatcatgagagccttcagacagacgggcccatcaaagcccttctgtcaggtacactcacaccactcaatcattcactggttttggtattaatcacaccaatgagcttggtaggagccagcatgcttctttccaccacatatggcaacccaccctcaagtgagaatacttgttttcaccccagtagtatctacaggcttcagatacaggcagatatatgagcaacaggacggtgtggaacacccctttgaggaggagctgcatcatcacatgccactcgtccaactcatgtattgtgggaaaacaacagaggcccatttgctgttttaatttcaaagaatcctctttgttcattctttattatttcattcaacaaagatttgttgagcccattttttgtgtgtgccagacactattctagccctgacttcaggaccacatcagtcccagaaatcatgaggctgttttcaaaagaccactctaggtgaatccagaagttcaaggaatttgagtttaattttttttttaatcttcaattgatggaggaggaaccaaaggagttggaactattttgaaataatgcacatatgtccaaatgaaaacaaattgagtcagtaaataatatctccctaatcacttctatcaaaaactaatataatccccttatcaatgatctttaaaagagagttgggagatatttttcttgtagtaatgcaaaggaaattaatatcacttcatcagagcctaggaggaaattactgtgaaacacagtctcagctaaatgcatataatatgaaacctagtttcatatataggtgtaaactaggctgtgatgtggatttgcaagtaaatagaacaccttgaaactagactcaagctgctagagggttttgtttccaatcccttgacctagggtttaaattggatgaaatctttcaggatattgtaccagtgactctctttggtggaggagagccagtgaaatgtactgtcagcagacacaataccttttcactttcttattttgtcttcattactcagcctctgttgccgcctcctccaaacactctcaggcttgccgcttgccttggtgcctctgtttgctccattctctatcattatccttctgatttgaggacacagctattgatgttgattgctatctggtcacatgacggaggctgaaaaggcaaagtaaagcaagccctcttttcctcactcacacacacgcaaagactgttcttcggtttccagagaccacaggatgtctatgcacaattcaatactgtaaatggttaaagccaaaggtagggggaagggatgtgctccagtgattgctttataattttctcatttgcatacagtggggctaagttaataaataaatgtgctctgaggctgcaggcctgatacagaggtctagttctgtgctaaattgacattcatcttcagagcctgaatgtcttcacctgactcccttcttgcctattcttctccctccaaacgcagccttactgggctgtcatgcaatgccgtagctcatggaagtccctgactaggaaacctcatcacgaccagccctcctctgtgtttttaccacgcttgtcctggcagaaacaaatgcacaggttcctgtctccttcgtgtgcacaggaatcctgaggggaaaaaccttcctctatccagccagctcgatcagctgagtcaatccccacctgcagaaggataacaaatgtcacagtcaggttcccatcacatctagaggagtaaacataaactttgaaagcagatctttagaatttgcattcagcatggccactgactggtcaggcacaaatggggaggccatttaactcttggaggctcattcacttcatcctaaaatggggattagcaatatgggatattgcagcgcttgaatatggggatgtattgaaagttctacgaaaattgctatgtactacagaactgcaaattttctcttcccttctatgttcactgcgagcaggtttttttttttttgcggcgcttattggggttgaggggtcttccttctgttttgccaagtgatagctatctagttaactagtgttaagttgcatggagttcatggcttaatttactcacaggccctcccttccaattttgtgcctcaaaagagatcttctggtacagtgtttaacccagggttatttcagtcatggggatttggagcacgttggtagttctagttggagtaagattgcggtgcctttttgtatccatcaaatcactccattattttacacaaacaactggcccacaggattttcttgagatagcccaagtcatttatagtaaatatatctaacattatcattgctaactcattctctgtttcagaaatgaatgaatccaatttcccagtgtaagtgatcagcagtgtttgtgaaataggtaatgtctaagaaaagtctttgaaaatcagaaaaagaagcagagtaccctcaagaagaaaaacaagcaaaggtgaagacagaaagatgagaaggttggagagaggttgtagaaaactaatctgattaggctggggaaatttctcaggagagaaagaagttcccaggtcaattacatttagaaacacttcaaacagtctttttggagacttgcagtgctccttagaatattaacctgctatatggaaatcacaattgagtaactcttattttacctgacagtttttttttttcaggggacatatatctattatcattggcataagccaataattgatggacctttcgtagagcctttaaatcagggcaatggcgcagtcaatattttgtttcaaacatagccatctaacaaaatgcaaaggcgtaaaaataaaaggaatctaactggcaatagagaaatatgtacaggttgttgtgttagtccaggagagtgatactaatgatagtttttatagttctagataaaaggatgaatataaagacatggcagaaggaaaatatgtgagctttggcatctgatcagtggggatgatctagataaagcaatctaaaaatgacgaagatttcaaactgccatgatgggaagcaaaaaatgatttgattttagatagagaagctcggaggttcccgtgggaaaatggtagaaatctgggtttaccacttgaaaggagagatatgccagggtttagggaatcatcttcagagaagtcatcattgaaattgctgaagcagctgatatctctgataaattatatagtaagaaaagagatcagggttgacatgagaccttggaggattgtctggctttaaggggcagaaagaggaagaggtgctaacaaagaatgcagcaaaaaaaaaagagaaaagctagtgtagaacactgtcacagaagcaagtgaaaaaggttttagaagaagggcataatcaatggcatcataaactgatgagagtttcaggaagaagaaagctaagaaaaagccattggctttgatgcttaatcatggacagctcagagggaaatgttctcagagagaagtggcagatagaccactaggaactgagactgtggtgctaggtaggtctagacaccgttgtgcatttgaatcagctgtggatttgattgctgttgtcgtttaatgcatgtaatcaaaacccacctagagattctgatgcagtaggtttatgatagagcctaattatctcttgtgagtgagtttagaggtgatacaaataaaggactatgttttgagaatactgacaatgagagtgaagacagaagaatatcaggatcaaaatttgggagtttgagaccagcctggccaacatgatgagaccctgtctctactaaaaatacaaaaaattagccaggcatggtggcgcgtgcctgtagtcccagctactcgggaggctgaggcaggagaatctcttgaactcaggaggcagaggctgcagtgagccgaggtcacaccaccacactccagcctgggtgacagagagagactccatctcaaaaaaataaattgttggattgttttggttttttttgttatcagaggagagacccaagtatgtgtgtaggttgctggagagaattaaaactataagaaaatatgtatgagagagatcattgatgaagcatggcacagagcaagaatggaagagatgggatctgaggtgtcaggaacctggctttaaataaggtggtggtttgaacttggagggaagaaggatgaaaggaagaaggatgggtaaagcctactaagatttagagctagagaagagggaaaataggtgatgattaaaaatctgtcagttaagcaaggaccgaagaccttctaccaatattgaaggagatagagttaggattggggaaccaaaattggaggtttatcacagccaatttgggaaattctaatagtaaacccaagaggcttgcaattttaaatagagttgtcagggaggcctcactaaaatgatgatatttgtacccagatctgaagttggtaagggagtaagggatgtggatatctgcttaacagcaccccaagcaagaggaatagcctgtgcaaaggccctgaggtaggagaccacccaatatgttaaaagaacagcagtgtgtgagaagatgaggtcacagaattaataaggggaggagagacagtgactcctatgacccatgattacataagatgttgtacaacattgtaaagaatttatttttatgttaagtaaaataggaattcattcaagggtagaatggagagtgatattatctgacatgttttttaaaaatcctggctgcagaaaataggctgaaaggaggcaagtaagaaaccaggaagaccaactaccaggctactgtaataatccaggctagaaattagagtgacttagaccagaaatgtagctctgaaaatggtttaaattgtttttaatgttgagttttcaatatagtttttaaagaaagaacaaataggttgctgatggattaaatatggagtgtgagaaagcactcaaaaaatgactccccatgttttttagcaagagcagccaggtcataacgttacccataacggcatgaccgtgtggggagagggtgagggcggggcagatcaggagctaatgagtgtgagttagctgttagtattgtagcttctcttatgatcaccttctcttatcctagaaattatctttttttcattgagtggcattggctttattgagattataaattaggtatttttttatatttggaaagatcttcacaacttcagcttctctgaagcagcagtttctgctggttgagaagtatgagaaaactataatttcaaaataatgcagggacaaaccctacactggaaatgagctttctggttagaaaatattttctttatcccatggaattcactacttcttgtccagattaattctttttagtgtttcttattttgcaatttactttttcagaataagtggatttacagcataatctaggtttgctgcacaaacagcacactgcacaactttgtttatgttgtggcttcttgctccctagagtggctcggtgcagctaccctgagagcagtgtgaacttcgaaagtaataactggtcattgcagagaatgtggaaaatgcagaaacataaagaaaaaataaacatgttaaaatatgtcagtgaattctcttccagccttattttctatacataataccgtaaacaaatttagtattctactcttttcattgaaaatattctaaggatttttttatggtttcagttatttttcatgaactttcatggtgatccgtaatatggataatacctcttatgtgtttaataattgcatcattattggatatttatgttcttttaaataaaatatattaaaaataatgctatttcaatcttttatttaaattttcaatcctttatttaaatctttgaccacatgaaaatgcgatattgcatcaaatggtatctgtgtttaaaaacttttgaaatatgcgtactgctcagttgctttctgtgaaagttgtacctgtttatattctcagccacattgtttaagactgcttgtcagccggctgcagtggctcacgcctgtaatcccaacactttgggaggctgaggcgggcggatcacctgaggtcaggagtttgagaccagcctggctaacacggtgaaaccgtctctactaaaaatacaaaaattagctgggcatgggagcaggcgcctgtaatcccagctactcaggaggctgaggcaggggaatcgcttgaacccaggaggcggaggttgcagtgagccgaggtcgcatcaccgcactccagcctgggcaacagagcaaaattccgtcaaaaaaaaaaaaagaagaaagagagagagagagaggtagggagggagagagagagagaaagaaagaaagggaaagaagggagggagggagggagggaaggaaggaaggaaggaaggannnnnnnnnnnnnnnnnnnntgattcgacttgatatatggttagtgactacagattaaggcatgattgataattctggaagcattctgctactagttacttttcatttaaccccattaactaagtctccaaaataaacaagtaatctggaattttgttcttgttattagattttcctttttcactcttcaaccaccaactttaagattgccctttcccattgctatttactacttgaaacttgctcactttccaagacctgtctcataaggcacctcagcaccaaaccttcccagcttgccccagttcatattaacatcgtcttcttccaggtttatttagcagtcacctgtctgccctgcattcaggtgatgtaaacatgtgtggctgtagaattatagtattcattgtgaagacagaaacttggttttgcacataactgtgacctaaaataagtagatgttggctgagttgttcttcttttttttgagacggaattttgctctgtcacccaggctggagtgcagtggcgcgatctgggctcactgcgaccctccgcctcccgggttcaagcgattctcctgtcttagcctcccgagtagttgggattacaggtgtgtgccactacgcccggctaatcttttgcatttttagtagagacggggtttcaccatgttggccaggctggtcgcgaactcctgacctcaggtgatctgcctgcctcagcctcccaaagtaggattacaggcatgagcccctgcgcccggccgattatgtgtatttctaattccctttcttctggccacactaagcaattgcatcaatttagaaacgtgaattcaaaatgttcttatcaatattttcttaagtattgtaaaatattttatgttgtaccactgttaaataatttgatatttttaaagtggaatatgtttttaatctctggcattttttcactttaagaagaaaaaaaatctatgtttgaaaatatagattgtttaaagtcacttgcaaataccaatctagatgacattagagagcaaaactcactcttttgggaaagacacactttttcagccctaaatgactgtaataagtggttcttaactttgaccacaaatcaggataacctgaactctatctccagaaattctcatttagcagaccagggtggggcttgggtaactgtaagctttgaaagctctacaagtggtcttatcgactagctagggttgagaaatacttttccattagtttccaatgttagagaagtagtttttatttctagctctctgcaagtttctcttaattggccaataccaactttggtcccttccacctttcaattaccacttgacagtacatttgacagaaaaggatgtcacttaaaaccattttctcttttcttatacagctactctggaagaaagcaattgtcaggttgatcctatatgctggtaatcataaacagcaaaatctaaagggcagcccaaagaataaatatctgctgggcattatctcttctatgagcatttagagctgcattgtccaatatggcaccactagctgttgagcagttgaaatgtggccagtccaaattgacatgttctataagtgtaaaatgtacaattgattctgaagactaccaaaaaccattaactattttattaataatttctatattgcttgcacataaaaataatattttagatatattggattaactaaaatacattttaaaattttatctatttctttttactttttttaatgcagctactaaaaagttttaaattacatgtaacatttgcattctattccatggaacagtgccgatctagagataatgtatgcgcactgacacaaattaaatttgttgttttcacattatggtattcctcatttgtctgaggggggatatattccaagaccatcagtggatttctgaaactttggatagtagtaaaccctatatacagtatgatttttccttattgtaagtcaaaacttttacccttttcacttaaagcactttatggcttcttttggcatatgtaaatcgccagcaaatgcactggggccatttttaaataaaagaagggtgacttgaacacaagcactgtgatatcacaatagttgatatgatcaccaggtcagctactaagtgactaaggggagggcatcaacagcacggatacagtggacaaagagatgattcatgtcccagacgagacagagcgggatgacaagagatttcaacacactacttaaaccttatgaattgttcatttatggaattttttatttaatgtttttggaccaaggttgacgactggtaactgaaaccacagaaggcacagattggggcagactactatattggaaattaatttagggatcccaagttatacaatataattagagacttaacagtagatagtttagtttaacttaatcttaggttttttcatagtgtacatggaaatatctcagagtatctctcaggaatgcaaaagtttgtcctgggaaaaaaattatagtggttgccattcgtttgattttcaaaagtttattatggagtactttttcacccttttttgttgactggatcataccaaaaatatggtatccagtgctgggaccaaatttttagaggatatagactagatggagcatattcagggaagagcatagtaagagagctgaggtatcactacacaagaggctattgaaaggacaaaggacggtcagtggagaaggaaagattcaaggaggcaatgctgagtagcttgcaaatgctggggggccgtcaggtggaagagaggttacagttcttctataggtctcaaggagtgaagcttcgactaaagggtggaggtagctgggagaaatttggggtcagaaaagggagaatttcttatcagagctttcactgtaagaaatgggctgattctaaggtaatgagaatctcatcagtggaagtgatcaagtgttattgggtaatcatttggcaaggatatgttttgtggggaggattttcagaatttcatcttatcatctataacataatgattaagaacacaggctctgaaaacagacaacctgagtttgaatcctggccatgtacttcctggctttctgactttgagcaagtcaataacttctctccacttccatttcctcctttgtgaaatgtggaatatgatgatgggactacatcttaagagtgttatgagagttaaatattaatatattaataaatagagcactttaaaaatggctagcatgtaatatgcacaacataagtgtttagctatcaatagttcaacgtagggtcatgtttctatactgagcaaaagggcttcttttgctcagtatagaaaatgatatcatgtttataatatcatttatttattcactcattcattccataaactaatatattgagcacatatcatgcacggtgcacccttctaggctctcagtataaggcggtcaatgcagagaagatttctgccctcacagagagacaggcaataaagatataaagacacaaaataataataataataataagtgctatgccgttaaaatagggcaatataatggagaaagactggcagtcatggaagaactgtctgaagatctgaatcaaagcggggacctaagtgagagagcatttcagacaggtgtttttggtggaaagaccatgaggaagaaataaacttggaatgttcaagtatcagaaagaaggtcactgtggagtttaggaagccatgggaagctgacttagggtggatgcgttcggagaggggaaggagccttgataaagagtttggattttattctgagagcagggagaagctgttggaggatcttacacagaggggcacggagcagaagtggaagcaggaagaccaattttcggtagtcctggcgggagcagatgggttttaacaattatttttcttcctgaatctggagccaccagatgagacttacatagtttgcctcttttttcatttacattttggttctgtttcaggaaccaaacatttcatctacttacatatttgaaaattcagaatcataaataaatattaagaattccttgtaagaatgctctttttaccaataagaattttgagacccggagtagtaaaattacttctcaaaggccatattttatcagtaacagaactataaccagaattggcatcacataacttaccagtgactaacagattaccacttatgtatcaagcactaagggtagtattcaacagtgaggtgaaatttatgtcaaaaatgtgatttttaaatgcaaggagtaaatggattcaaagagaaagcacaagttctataagcatgaacttaaatgaatcacccactctatctttgcaggccaatttgtacaaccactaattgatagaccgtgtacctgtttgaaaaaattattttgcactttcaattattttacaccctctgttttaagtatcaagcaaatgacttcaaagaaaattgggatcttatgatttcctacaaaaaccagagtaggctgagctatggagccagttttagttttcttgacccaggcgtaaacaatatgcaaccatctagaactgacatgaaatgatctgtagcactttagaacttgaagatctcttggaaatcatctaattcaacagttctcaatgagtgactccctgacccacagcgtcagcatcacctgggaaattgttaatttccaattaacagttggagatcgcgaattctcaggccccacctgctgaatcagaccttagagatggagtccaacaattggtgctttaacaagccctttcgttgggagatctcagtccacacttaagtttgacaaccactgatttactccaaactcttgattgcacaggtgagataaatgagaaccagaaaagtaaagtgatttgcttggggtgatccagcttagcatcaaaatcaggaccagaatctgggcctcctgactcctagtgccatgtatttgcatcttgaactggacttccttcccttctctgcaattgcaacctgagaagcccaggttaggtccaatcatcattgctttttgtctgtgccctcctatcctacatcagggaaagatatgcttcaccgaagcacctgggctctttcatttcattttggacagttgcaggagtttgttatttaaaagctgcataaataatgagcagacacagtcagccctgtttagccatggctaaaccttagaagggagtgtagaacaacccaaagtccagcctcttccagatgcaatttgaataacttaaaaaaaaaaagaatagaaggtcactatctatcttcacaagcatttatctgatcatagcttcaatacaagctttctgtttgtttgtttgttgaggactgaattaatacaaaggtctcagttaaagtagaaagatagttgaaatactagcctgaaaattcagatgaccaatgaatatttggcagcgccaggccacagcagtgtgccccctgctttctctgctagtaagatggcattaagaattcagtccccactaaaaagatatcttgtcatcctagaacatgagccagcatctcctttctatagttgtaaatatagccaaatacgatacagttaccccagtggttgggtggtgtttctctcaatcagaatgtgtctgtgtacagaagaggagagcaaaaaaaagacctagagagaaacgtgggcgcagaagcaaaatcaacactgggaattggctatctgaggagatcagtcattaaaactaggcacatgctaattgcatggcctggcccccatttttctccctcacagccccctctcaattcagttcattctcctaagcactgaggctacagcctggctggcctcttatgtaagtctgaaatcagatctggcatgcggtttgttttagcctgtcacagacgcagggcactgtgttgccctcgacaaggctgttcagcatagcatatgactgtaaatcttctttttcatgtaccacagtggggacctttgtcctagcagtgatttagcagcttttattagcctgagaagcagccagtaatcaggagacatttaaagtggaagcttgctcatttcgatggagaagaatccagaaaccaacggctctttgaaaattacttttgatgggagagaaataaaaccttaatacatataaatatatggtatgtttccattttaaatttattattgctcaaacaaatctatacataattcagcaaagactcaaagtcacatatctttaaaactttgcattcatcaagtcatgaagctcaagggtttatttaactctgagttttcagaagtatgcatcttgaaagaacgtaggtcttggatggcagctccctgtatgttattcagatcctggagtgtccacagcttttaaattcactgtaattccaattagagcttgggctcaggggttggcagcagctgcaaataagaactaataatgtttcattccactgcttatgtattctgcaaatgcgttcttgacatggtagtttgcatatgatgtcagcgtgggaaaataagaaggtattagcatctgtaagcccagcagaaatttctcagagaagtcacttctcaagttcatacagctgattccacaatttaggcagtgttcacatttttaaaatatattttggtgattttttaaaattaattgagtcataaaatatcgatggttctttatttgcatgtatttgcaaagtttaaattcactttttctgagatcaagttttctattgcaaattgttgacgtcgttactttctgcctttgtaattttgatgctgatataacataattattgttagaaatttaaacatttatgtatagccatcaatgtgaaggctagtggttgaaataacttctgtaagtccttggaactatttgtgggaagacggaagcattatatgaatccagttcatttatatattatacttattactgagatacgttattgtagaaacacaagggcctctgctgtaggtcgtaggaccctctgggatggtgaaagagtgtcatatgacactaaaagagtaaaatgagcctttcaaaaggaactcttgcttttaaaatgtggcataaatgatcttatctctacagcaaggagtttgatcctgattcacaaagagctggagttatgcagccaaagaaaagtggagccctgtccatttatctgaggatttggggaccatccacagcgaccaagcagattgttcaggaaacaaagcccacccttccctgcattatctgatggcatagatggtcttatatttcccagataattgcaccacacactgttttactttgctgggtcatagcaattggctgatctgccatgagataaatggcaacaacaacaaaaaaaattcaccaggaaagtcattcctttaaaagtatttacctatatgctgtagtgggtgctttgtgtgctggggagcaggcagccaggatgggggcggtaggaaatgagtaatgatctgataatggagctgaatggggccatagaaatattttcacaccatcctgctattgctacaatagctgaaacccagaaattttgtggctttcttcacagtcaaatgatgtgttaatgtcaatagattctggatgtcttgactcatttcttgataatttttttttctgctctgactatactatcgtatggtagatatgtccttgcctatttcgtattcatttcccccttttttctacccactagtacctcccctcccagctgttcttccaggagcaaactctttccccatgtagctcataagacacgggtgaagttgatcctattctcatccccattatcagattgaatcagtctaaatgaatcaaggtgacctcttcccctttgcctgggattgctctgggaaacaggcttaagccagtcatcacatggcattctctaacatcgttgttggctcaaataaatagatgagaaaactactattctatacttgagacagagctactcctgcccctccacagacacgaatgaggaggcaggtaaccccagttgctgctggcaaacatctggaaccatgcagaaagccagcatgaggagcaagccttacacacagaggagaatagtgccaagagaacaatctgaaccttaatggtattgaaccttgagcttttcctatctctggatattttaagggaattaataaattctttaattgtttcagccaatttgagtcaggagttctgtgacttgtggttggaacatccaacctcatgcacactaatataatcaggtatgcaaatataccaatacttatgatttggactaaggaaatggttttgcttttacagaagatcccactatcattgttaacatggctttctgcaactttggccttaattacgtaacggccgaggactctttataatatccctcacaactcaagtaaccaggacaaacttattagggcctcagcacacaaattgcaacaagcagaagcatagagagtaaagttctgtcttgttccttttttttggttttgcttttgatttcctaacaaggaggaaacattatgtttgatttctttctggttgctcttatgaggcacatttattggttcatgttgtgtttttctctaagttttaagtttatacaacttaagatacgacaaccaattactgtataaaatttagaaaatatttaaacaacaagaaaataagaatggcctgtcatagtcctaccctccggagcaaacaattattagcagatatttacatatgcttcattatgtatatattttcattaatatttactttatgtaaatattgctatttttaaaactactatatttttcccatactgtgaacatcttgattaatgttatattccatttgaattctcacagccctcagagctacccttccttttgcagctgctcctcaaatagctgcatccagccctgtgtgcctacggtttgaaaggatattcagttgagctcgagcaggatgggtgactgtcagagctggagactgttattattaatcattcagaatctgtcgtcctnnnnnnnnnnnnnnnnnnnnnnnnnnnnnnnnnnnnnnnnnnatttccagtgtatttagagcagacagaactttaaaaatatcacagcaatgcaatgtaagaagaataaggacaaagtgctgagaagagatagagggagaaacaatgagaatctgcaagccccgcttgtgttcaggagctttgcaatctgtataatgtcattttacataagccttaagactggttatttgccagttatcctgggactttagctgtagaaaggatctgagtacttgagtgctatattaaatatcccccttgaagagagtctattaaaagcagacacatgtaagtggtcattgctaccaacaattatgaaaagaaaattctagggagagtgtaactgacccatttaattaagactttagtctcttggattggagcatggttgtccactttaaaatgttgtatttggtggccatattttccaaactccgtgcatacgatttgataaccaccatgggcccagggcaagaggcaaaatatataaaattactactgtttcgaaaaatccaaggcaccagatctctgtaaacaatatttcccaatatttccttgtagatttgtgtctttttaacaaatcattttatttaccatatataccagaatgccaggcttctaaaaccccggaagaggtagagtgaatcgttataccttgcctcccaagctccaaggtacagaaattaatggaaggcagacacgtttgacctagctgctcctgccagaatatgaaaatgagactggtattgcgtggagttactggatgacaactccctcgacccagacccatgaaacccatttcatataaccttagctaccatgattccttgcatgtttttaagtcttggtaagctgtttttctttttaatatagctatggtttcacctttgactttgcacattattgatagagctaaaaacctgatgaaatttaaaaacaaatccagatatttcagactggatttttatacacaaagacaggacctttggactttaaagatcactcaggctagacaggataataatagtaatattctggttttctatgacattttcctaccaaagagatgaatgcaccttgatagcaatattgaaatattcataaccttctcatacagtagatgtaatactgttatcctcccttgtttatgaaaaaaacaaggcctgcttcttttgaaggcattgttcaaggtcatatagaaggtagttgagttaggactctcaggatctttcaagcaaggacagtaaggaaagatctaagaattccacataaatgtcatatgaccacattgcaaaccatttgcaaaatgtcatttgaatgtattaatattgaatagtcatatggaatgaatcctgcttgaaattcatgtctcaaaaaactaaagcaaagctattcagaaaatgccaagagaattggagcatttgtttcctctacggtttacccatttctattcactattcttcagtgacatgtgagaaccttaaggttctcatacaatatgtcgtttaggagtaagaatccatctctagaagcatcctttgggtgtttaccttacagcttagtctacagagttcatgttgcaagtcacgacttgaaatgcaaaatgtttttaatttattgtgtgcttgtcagtgtggcttaatgaaagtactcagaattcgaagtagggtggcggaaggctcaatatgccacatcccttaaattctctagcaatgtaagaacacatccacataaagtgtattaaagagcgctgtatctccatctacgaacaatcatctccaactctaaaccaggttattgaactgaaaacatcagggaaaatggcatgagcagggttgctttttcatagatctaagaaaatacatatattctcagtttttagatttggtagaaacatttgatatctttccaaagagagaccaaaagtggttgggttaaattttaaggcagattccaaagatcttagtcattcttttgaaatttttctgataaatttgtctaataataatttatataataaaataataaatttatataataataaacctaaacctatttcagtattgataaatggtacgtgattatcacagtttatttgtagtttcataattacttgccctcactaaaaatcaaaagtaaaacacataaatggttctttcctacaacgacgtgggtttctgtttctcttacatagtccagttacagcctgggaatgtatactgtttgccttcattctatctgaaaatacattggttatcaggattaagccttgaaatccagtatgagactgtagtcttagctttcattctatagtgtgggtaagaagcagttattcctcccagctcctgagtcaaatgaaagatgatgttgctgccaatagattcaacttcccttccattcttctttaagagagtaagccacactcttctacatactcccagtgaattgaatgagaagaagaaatattagaatcaaattataggagtggaaatctccaacttcctgagaggtcttcattgagtctctccccgagatgtgaggaatagactatttcagctcattaaataatcatcgctgcattctatgtttctctggttcttgttctaaatgtcaatcaaaaagaggagtgaaatatcaggagaaatagtcaataaagaaatacattcccctgaaaggtactaaagtaaatatcttatttttttataaataacataagcctatacaatcatgttttgacatctgtctctaagtaccaactaaatgaagatgagtttaagatttcaaatcttttatttctagtataaagtaacattttaggacttaatgtgccatgttcatccacaaaattggaaacattcaaactagaattgtgatagttttattgggatgaatgagtcctcagtaatattttattttttattttgaaataccataattttagacttataggaaggtgcaaaaatagtacagagagttcacacacagcctttacccaactttccctaatgttaaaaatttacataaccagaatactgtgatcaaaaccaggaaattaacattggtacaatactactaattaaataaaaaacatttttcaaatttcaccagtttttgctctaatgtcatttttctcttccaggatccaatccagaattccatgtgcatttagttgatgatgtgtttctctaatctatgagaatctctcagtctttcttgtctctcatgaccttagcacttttgatgagtactggccaggtattatgtagaatgtcactccactcaatttgggtttgtctgatatcttcatgggtagattgtttatctgcatttttggccagaatatcataaaaacattgtatccctttcagtgtgctatatcagaggatggtgcatgttgtcagtacgtcatattgctgatggtgtttaattagatcatttgcttaaggtggggtcttgcaaatcactagtaatcttgactttgctacccttgaacccttgaaaacttctatactcaaatgctgtatgtatttcagtctactttcttattgtacactcaattatatgtcagatgtaactccgtatctaacctataaggatatgctcaaatattattcttggtatctcaaagttagatccaatggagtaggaattcaaataaaatactttataatgtactgtgattcctgcaatcttctctgtgtgtatgtatgaataaattgttgtatctgtaatatgtattactgcaatgcattttataccaaggatatcaagaaatttatacattttcatttgtttgggaatctcatctgagaccagaggtggagctctgaatgctttgggaggcactccaatcactgtcttgctagtttgcctcttcttagacctgatgtactaggaagctgacatttttttctccctactccttcaccatgacccagtgttggctcatgtatctctgaagcaataaaggagttgaatggtgggatcatcatttcttaacaaacatcagtcaacatggacattggaatccatgtcagtgaggaacttagcaagaatgagagcgcacaactaggatttttgaaaactctttttaaatgtttcttattttgaaatgctgtcaaacttacagaaaagttgcaagaacagcaaaaatactcccatgtatacctcacccagatttcccaattattaacactttatcactgttgctgtttcattcttgttccctttctccctctcccccatctaaaaatcattttaagtggaaacatgttcttttacttctctaaatacttcaatgtgcatttcttaaaataaaaacattatctcatataatcacagtacactcatcaaaatcaagaaattaacaatgatatgttgccactacctaatgaacagaccttatttatatttcacctactttcccaataatgttgtttttagcaacaactaaaaatcttaactggagccctatccaggatcatgcacgccttcagttgtcatgtctcttcagtctttttttttttttttttttttgatggagtctcgctctgtcgcccaggctggagtgcagtagcacaatctcggctcactgcaacttccaactcccagattcaagcgattcttctgcctcagcctcccgagtagctaggactacaggcacctgccaccacgcctgactaatttttgtatttttagaagagatggggtttcaccatattggccaggctagtctcaaactcctgaccttgtgatccacctgccttggcctcccaaagtcctaggattacaggcatgagccatcatgcctggccctcagtatccttatcagaactatttcctcagttcattttcttcctttatgatattaacattttaaaatgtaaaggccagttatttaactgatgtttcctccatatggatttgtccaacattcctttgtgactagattgaagttgtacatttttgacagtgatgtgtctcgaagagacttgtaatgaagggactatctacacaggtatgggcagggttaagggatgctgaggcatgcagaactaacaacaaaggaagtggctacaactctaggggaggctatttccagctagaaccttggagtgagtgggttagggactgaggaaagcaagtcttagagggatgcagacactgccagagctgtgccaaaggcaggagtggaaatagatgccttccaatggtgactataacaagaagccagaaggcaggaaagaccagtgatgtgcttcataagtgccagccttctgaggcccaaaacaagacaaacaatggcaagagaatgcagctgtaggcaaatggagaatagccactgcaaaatttaatatgcctgtttctcatttctcttcttcgacacatatcatcaagctgtcatgtgcaatgtcgtacacaataacatatataaagaattctaatctatgaattagaaaacctggtctcggttgctggtatcacctgctttgggccatgttaccttagaggagacacttagcccctctgagtctctgtaaagatggtgttctaacatctgtccatctcccccatgatgtgtctgcaaagatcattatcattgctatataataggcatagaactatgaagttaatcacaattcattaacttacagaaaaagcaaatgaagcataagcatttgtgtttatgcctcatgttcaaagtaataatgcctatgcctctgtatttgaattgttttccaagaaaaccattttctagtgtagttttcccttcttgcatctacttccttgtgagttatgtaacctgcaaattactgtaactcgcaagcccaccattttctcccatttgggtagattgctgaaaagcattgtacttgttttggctgctgtatctcttggttgctctgtttttcttccccatttgcatttctgcagtcattactttgtatagccgactatggttctttgaatagtcagtaaatatgcagctggtgaaaggtaggtagagttaatgtaaacgtggtttttatttaagtctcctttttaaaaaatatagcattcactaggattcaaaaaaacttagaaatgaaaaagaagatttttaaaaagaaagactaggagaaagcactgacaggttgagatttaatgggatctcaatttctcagttctggtatttttttaaaaggtgtaaagaggccagaagcttaggcttgggttggtggcattgataaagtgtggctttctgattggcagcaaacattcagaacatctttctgcttacaacttctcagcatgagttgagtaaatattggttcactggcatttttgagcagtggcaactatcacaaagaagatctctttactgtaatgggcacttgtcagacacagaaaaagaaaacaagcatctctttaaatttcctattgtgttgttacatctctgtcagtggtggttcctattatgtgttacttgaatctggtattcagtaactaatgacatgaataccagatatcagaataactctgagctaaaaacacccaatctttgcaaagacacaccactcagcagaaagggtcctgtgcaaaattccacttattcacaaatttatacaaataaaattactgtttgagaattgctagagagaaccaacaggtggatttctaactgtttcttctttggtttaacatctagtaactttgagtaggagaacaatgaatctttgagacatattcacttcaaaatcaatatgttgagtaacatcacataaatgatgagtttcgtcactgttcattgccagctctcatttttgctggcaaatatcagcatcaaaattttcataagcattctgtaccttagagatcaaagtggttttgtttacttttaatttgataagtagacgtgtgacccctaagtagttaaatttatcaattgtgaagttaagatgaaaattatttatctttacatttattcaaaaagtgaaatgtaaaaacttgtcttaatatcttagaccatgcctttccctaaaaagcatcttctttttcatacatttttatttaagcttttctgcttgtgtgttggcaaaataaatctttttcaggttatatgtgattatcctacagatatgctgttgagtgagatctcctactttcatcatctatacttagacttaagtcagagtccccttcatgtctcttacatgaatatcagaattgcctaattcgaattaaaacttccctgattaatgacaagtgctctttgaacaagatgttctgatgatctccaatcctaaaattcctcattcaatgggttgtgtaaaaatacttcatacatttcagtattgctctcaggcactgatgaagtattaatatgggtgaaaaagaccatagtcatcaatgtatgtgctacttattgagggcaatggtaaatctgcttccttcctctgctgtcctttaccaacccctgtcacctcaaacgatgaaaggaagagtgaggaaatgataaaatccaagaccagggaaatccattagcccaaatatgctctccattattgcctttcatcaaaagcttttacagcaattcatttttttctggctctatgaaatctaaactttttaagttagaatctcaaagtcattctgcttcatagagttgttgggaagatactagataatgcatatacatttcttctcatgttttgagaacatattatttatgttattttctattattttgttagttgtattagttgtattattctgtctctactactatcaacagttttgtgtttccacagtggttctttacatcttcttctccaaatcttcatcttttataaaataagcccttccggccgggcacagtggctcacacctgtaatcccaagactttgggaagccgaggtgggtggatcacctgtggtcaggagttcgagactagcctggccaacatggtgaaaccccgtctctactaaaaacacaaaaattagctgggtgtggtggcatgcacctgtagtcccaggtactcgcaagagtgaggcaaaagaatcacttgaatccaggaggtggaggttgcagtgagctgagatggtgccactgcgctccaacctggaaacagggcgagattccatctcaaaaaaataaataaataaaataaagaagcagggtaagatataaggctgatagccccaaataaatcagagatgtcattagtatttcagttattcagccatactgacgttgtcatttgtttatgtgacttttctttctatgtaggaacctaaaataacccagaagtttctgtgggttttggttttccaaaagctgttgcttgcctacctcatttggggcaacaaatgcccaccccaccctttttttttttctgagacagaggctcgctctgtcgcccaggctggagtgcaacggcgtgatctcggctcactacaacctctgcctcccgggttcaagggattcccgtctcaacctcccgactacctggaaatacacgcacacaccaccacacccggctaattttttgtatttttagtagagacgaggtttcaccatgttgcccaggctggtcttgaactcctgttctcaagtgatccacccgccttggcctcccaaagtgctggaattatgggtgtgagccaccgcgtctggtcggaatgccctctacttgagaggaccctctctagtcccaggaaagctggatggattccaaaggaaggaaacagagattgacacaagacaacattgaattgaaccttcacattttcttcttggttgctgagctcacataaccaagatagggaaagggataggaattcagagtaggtaatggcaaggacagaaaagtcaagttccccaatgtcacagctctcagaaacaggaacatgataaatgtagggggaaatgagggtctccactgaaaccatagttgtaatagatcctatggtttaatagaaaccatagttttaacaggatctattaaattgaatttaattcagcaccacagtctcccctcattctgagactttgttcccactcgtaaggaaaatggtaccacttatgaaagataaagactcagcagtcccattttcaaaactctgaagtattcctctctctgagcgagtggttcctttcattcgaaggcattgcatgtatgtgtgctttctttggaatggaagtgccatgaaagaaaacacattttgacgaattccagaggaagcatcaagaactgccaggtgacttgtcatagagctttcaagcctagtgtcattttatttttacaacccagggttttagcaactcaagaggctttatatgtgttcattaaccgcaaatctgtaatttaaatggacaaattatcctggttaataatctaacacatcattcccaattcttcctgctgtcaatattcgaaacagagctcaatattccaaatttttataacacctttcacatgttaagtgggtacagttttgacacacaagacaaaataaaataaaattccgtactggacaacactcacaaaagctgcttgattcaggtgaaaagtattttgcttccatattggcctagagcatctatttatgtatttttttttttgaaaatagaaactcaaaaaaattattgtgatttttttaggtcattatataagggatagagagaggtcacctaaaatgatgaaaattagcacaataaatatgactgtgagagcagcaatcaattcttttcttaagaaaattaaaccggagccgggcacggtggctcacgcctgtaatcccagcactttgggaggccgaggtgggtggataatgaggtcaggagttcaagaccagcctggccaagatggtgaaaccccgtctctactaaaaatacaaaaattagccaggtgtggtggtgggcacctataatcccagctactcgggaggctgaggcaggagaatcacttgaacccgggaagcagaggttgaagtgagccaaggtcgcgccattgcactccagcctgggcgacaaagaaagactccatctcaaaaaaaaaaaaaaagaaaaaaagaaaattaactggaagtttgtctttaaaaatattacaatagtttgaactagcattatcacctagagtgaaatgaacatttaaaatctaaacctaaaatcatatttataagtataaatgtatattaaaatatttgcagtttcctcaagatatttatagtgtcacagttctaaagttatgaaaatctttcatcttttatcaaatattaaaaatcatacactcaaaaaagcccttattagaagaactcttcttctaagaaaacataatatgtttagctagaaacgttagtatgaatgtaccaatgttaaggtttttgttagctgaacaggttgttgctaggataaatataaaccattgatatattatagtgtaaataaccatatatgaatgtacttcagtcaccagacacaaatgaaaaaaattcttaatagatcattataaaatggaattgttattattgttatgcaagtccaaattgggaggtcattaattaatacaatggtatatctgtcattatttcaagctttatcttataaagcttgtgtttatttttcttagtttttatgaatacatgagatgctttttttaactctgctgttaagaagactgtactcaaagacattgggaatgtaaatatatattaaagtatatagtgtatagtgtagccataggcaggtttatttataaatgtcaatgctattttgttgtgaaagttcattatgatgacagttttaaaagtagggccaattcaagagtgtttattacataccaaaaaaaggaaaaaatatttaccttgtattttttgatgtctggggataagattaatttataaatcgatgtgttgcattgaaatagcaaatgtaaaaaccagtcacaaatactagccttaaaggtagaatgtgtgctgtttttataaggccctgctcatcattgaaaccaggtgactttaaaaataatctacaaaattaaaaaatttgaaatttggtttaaaattttaaaatacctcagaaaaacaataaaaaggaaattgtatactgcatttgtcacaaatctgacaactctaatacaaatatgcatttctctttctttgactgtatataaataaggccaaatatctagcttgttaaattaaagattcacctgtatgttttctccaccaaatatttggaaactcttgaaatttttattcgatttttttagatctcactaaggtttttgattaagatcttttttattttctcctcccctcctatgttcctttaaaaataacagcatatccattttaacaatataaaacttcagttgatattttttagagctagtaaaattgccaatcttataatactaaaattcttccttcttcagaaatcttctttggagtgaatagagaataatccacaaaataaatttaattccttagaagtttgttatttttaatggaaggatgttttccataagcattcttcaaatagctttgctccataccttctcactttttaatatttgtatcattacgtgtatcaatttatttataaattaattgaattctgcatacaggcatatatgtgctgaatgtgtaaatgaatatgtatttgtcatctttaatgtatttgaatttggctgatgcacccataaaaaaagcctccagcatatttgcataattaagcataatattatgataaaccatttcaagggaaaaagttggtcttacaatcacaatatgtttatttttttaaccttgtaaattcagaatacatttgtgggaagaactggagatagaaaagatcggctttaccttcatgaaaagaggtcaaatgttactttaattaatcttgtgttatgccaaaaagagtatttatataacacataaatattaagcatggctggtacaattttaggggagcaagagtattctattccttctagctttcacataagaaaagaattctagaagaattcttgattaagactcaagtgtgctacagcttatgaatttgtgtgtgcacacacgtgtgtgtgtgtatgaatgtgtctcaccacagagcctgaaaaatagtgttcaatacatgccgtttgattaattcttactatacctccgagttatatcatcagaacatatgtgaaggtgactaagcaaatggatcttttaaaaggatattacttttacattttattattaatattttttaaagtaaacctcaaaaattgtaaattctgggaatcacactattgttgtgaattaataataaataatataattaattatattataattaaatgattgctagttttatagatggaaaattcatgaacaaaatagaaaataatttaacctatggagaaatgtgtgcattaaagtttcatcccaaggctaagtcagtactgtagttattggtgacatcgtgtggttgatgctggtatcgacagcagagtcagagcatttcctaaaaattggttaaattactataagcaaaattaaagtcttaaaatgcacattgtctcgattaaatttgaaacaaaaaatttcacctaaaccatgactaaatcattcatccctcaaattctagacctcttttagaatattgtggtatgcagacacatgaaaattgatgcattacaatagtacacagcagagagtactccggagcagtatttttcactacagcacttgctactttcctttaaaaaaaaaaaaaaaacacagttttaattactagagttggggaacagttgttctctccaaaaaaagggtagaattctctattcactgtctcacatttttacttgaaaaagttatcgttgttaaaagaattttaaaaacttaatttgcatcctatttttatttaaattacctctgatattttaaccaaatattatcactgctggagagcacctaatattactcaatattatttttttcgtaatagtaaaaggtgaactaattttgttttaaactttgaggttaattttttaaatgagagttctggtttttaatatggtaactttgacctccacaatgtcatgctcctatagtttgacaaaataggaggttgcagatgttaaatatagccctgttctcgtagaggaaaggcaaggttgcaaggcaggatttccagcacagattgtagtaaatgctttctgagccatcttcctcacacaaagaagcggtgataattccttccgtggacattcccagtcggtgcacatctctgcacctcccccgccctcctgaggctcttacctggtttctgcataacatcatattgcatagtgcagagacccctggggaactttctttctctacctggggaaggccttctaaactctaacatagcaccacctgagatattaatttgcgactcttgctagggtttagtgaaagctaattccctagagtaactattattgtaccatgcgatactgaatgaaaagctccatcgttctgtctctttttaaaattcagactgctaaattcaacgggatagggaagcatagataacatttattaatatagacaattttcactggttttaaaggaagatggttatgatgggtactgatatgaaaaaaaatattatggtcagttatgtctcaagaccaaagtcacaggaaatataatccttatttgactatgaacatgtcccaaagaaagcacaggtatgaagtctttttcctgagcttagatgactgaggaaatctggggttacctggcactgcatgcaagctatttttggagagagccaagatctgcctctcatcaagaaagatgccccaccatgatagctggttattgaactggtagcattgacaattgatgaggtgatgttatcacctttgaagtgcgggtcacaggagggaaaaagggtgctcttgagggtaatgagatacaaaaccagcagaatcacactgccattgcccagagctaaattaaaaccggtaaggagaaccccttggaatattttttctttctacacttggggccagtcttgggattaattagctaaattcagctgaaatccctgttttcctcagtaggtttcacttaattactttatatgtttcctcatccaggtgtaacatgacaatataagttaaaacaattcccagtagtaccaccttgtgaaagatattcccaattttcccttcgtgtgtggcacaaagggtaagaatgtgaggaaattgcatatcgaacaactgttccaaaattagcaaattgtagctgaatttgagacggtaattttcactcttcagaatcttttaattgtagatcacaaaaatcttatcttctttgtattaaactattttggtaattcggtcaggtgcccattttcccaatctactaagtatataacttgaggtaaaagtaacaaaagtttcacacatacttcaattactgaagactagacagttttcaaacgtgtttttttccacatcttaactccatggacctcacttttttgaacaaagtatgtggtgccattttggacatttaattaactggcacatcttgtaaagaattcacacatgatctgtagctgttttgagggggttgcacatcagatatcaatgaggggccaatcagccacttgtgcatgtcatttgtacaagtgtgttttcccattcaattttggctccactctaaatgacaacgtcagtgcttgaattttttccacagaaggccaggaagcactgcattccctaagcttgatgtgacaaccttcaaccaaaggctgagcttttgttattaaaaaaaaaaaaaaaaaaaactgggcctaatgattgcagcaaacagcgttgggattttattgatgtactctatgtgactgtgacagtgttgacatgaaatcaaattcaattagcaggggcttgctaatgacttacactgcttcaaaaactcacaaggacaaagcacttggccagaaatctcccggctactgtctggtttccaactccttttggttgcttctcagagcaataaccaactgccagattgtctccatagattaatgttaaagaacttcactaatgaaactcttgacaacatctgtgtgtgatgagagggaaagggtagggaagggagacggaatttctgtcctcaggtgctcttgaagcaatttctaaaaccactgtggagcacatcgaaagaaacagcaactgtgtctctggaggataacttggctggacagggtatcaaagctgcaaggggaaataaggtctgtggtcaggatagggtttcagtaaggctagaggcaccctctcggaatgcgtgggaggccaggccattatctgagcagtattttaaaggaacagaggcgccattatgatgcctgcatcaacccagcaagatgaagatgatgtccgttctagatttccacagcttttattgacggcctcctcattgtgtctttcctgattgtctggcagtctcattatcatacccactccttcccctgaaaaggagcaggaacagctttgactcacacatgcaactcccactacctgattagcaaacagatccagccctgagtcagtttcaggggtcctccgtaaatacaatgtcaagtaaataaagtatgatcttaattgacagaaagtttacgaggggaaataagccagtattctgctgtgttgttatatcactttaacacttcaagatggtttacttcaatgtttatcctcaaattaccttctccattttacctcacagatattttcccttaatatttctttctttattaatttaaatatgctgttaacaacaattgcataaatagtagcattaaggagctctaaaaaataaataaataaagcatggaatctggtaaaaacatggctatttgtgtgtctttaggccttcaccaccatccacattatagtgcaaccagattattgtaaaacaacaaaacctcagagtcagaattgggcacagactccaaccttttgggatctcccgtaacttgtaggtaaattgaccatgtaaccctgcaacctgaaaacatcattaaaaagccataaactagtcatacgattgagaatccaagccactagtgatatgattttcacaagcaagaagaaatcttaaaattctagtgacttctgagattataaagaaagaggaaaagacagaaagcaacacctcaggaaggagttttaacacgaaggagagcctcttcctatcgtcagtcccaatcacactgctcagtggtaagctaagcttatatgggactgaaacttagcactgatgggggccaaaagagtattgcataccaggaatatagaagtaaataactataagaaattgaagttacataaagtgtgtcctaaacccttgaaaaactgcttgagccatgttaacaatgagtacggacaccttaaatacctggactgatacaaaaaaggtagactgtgcctctctcagtaacaactgcaagactatcgttttatgcccagacgtgtaacaaatcacattgtttactctttaaaattacccggtattactcttctcattttacaaacaaggaaactgagtctcaacctccttgatggctccagaattgctcaggaaaatgtccactcgttggagacagtcccaggacaaagggaagatggaggacctgcagggctttgcatttgcttagcagtcaccctcttttcacccaagtcgattgtttatttgacatgacttaacactgccattctcttcacctgagcacttcagaaacttttctgaagccccctgagcagtacaggaagtggtagagcgagaatgatttgtattcacctgcctgacaggaaagcctgtgtttttatggatcacctgcaaaactttctaactttcatttactattattatcttccaggacaaatggatatgcctggacactcaccaagaaataggctaattatttcaaaaggcccaattgttaaaaaaaatctgactactagagctcacaaggcagttgacacagaaaaatgttgttcagtttcctgtataagttagagatctgcctcctaaaatcttgcatagattaaaagtcagaagagggagggataaaaagcagtctccttatacagtggtacagggaatattagaccccacagagtaggaaggacaaatcagacacaatattatgaagatcaaatgagataatgcatgtaaaagcactttgtaaatgaaaaagccctgtgaaatgtgagctggtgttattattaatattatcacgcaggatttctttgcctccttcttaataaaataatggtcttcttcaaggtccctcgaagccaaaccaaaggagtgtgtttccagagaaatgaaaagtaaaggtaattgtggatgttcaataaatattaaacagcctcgctgtttgtgggaagcttcaagtacatgattaagttgcaggtgatagtaaaggaaaccagcatgatctttaattataaaatacttgttaggtttgattccagtaaaatgcaattaccttgagacttctggtaatatctcacaagaggctatgttctcaagatgaaagcttttgtggatgcatgttagactccattgtttgggaccatgtacacccatcctggctcctgtctgtaacagctaatcaccattaactggacgagccttgcaggaattcccagttgtatgccagccattctgtggcctgccttgaagtatggaaacatcacagaagtgggaataagggcaacagtggcagaccacagcattagctaggcttagggagaaagagatttgaagggaattcaagatttcataggggacaaaagagggcccagtaggagggagaaaatggaattgtccttgtacatgtcacgatgattataatgcaaacaattttttttaagactagcagggaaacctctggatttcattttggaaaagtatccatcaatctgtatagcttcattttaaaatgaaatttttaatcagtgtatattttttgaacccgcctgggaaagcaattggtgggcttagaaaatgttattttgaaagccttttttagtttcgtgctggtagggttccaaaagccttttttaaagaacattcttatataataatgatagctaacacttaactagtgggtactacatgccatgtaccggcaagtgctttatgtatgttaactctgtcaatactcataatgaacccatggggaaaccgtggcagtaatgctcattcatttgtctacagtcacacagcctgtaagaggagaatccagttttcatgtccaggcagtctggatgcagaaataatgctctaccccgtcaacattgcctccaaggccagtgctctagaggtttcaagtgtatgtaggttacaagaaagactgcatgtgtgtgtctatgtattctgctgaagggagatgcttaagatgaaaatgtttacccattaaaaactatgttgcttatcttcttacacactgaagcaattgaattttgctgggttttttttctctctatgttcatcagtttcttcttgtacaatcagttctatgaattggacttagtttcttcactaatgtcaaaatcgttctgtaaaagagtcctatcctccttttaagaatgatcttggtgtctttcctttggcttccaaattattactactttaaattatagtcaagggctttaatgcagggttaccatgattctacttttaggcatctacttagtttcctttgctcttcctcaccctaaatttgctctagggagcactgtcaggcgtcacagtacatgactcttcaaatggaaagtacctgtcagtaagcaaaatagtgtgtatatttctatttggaagaaactgtgagctatgggcatgcaattgcaaggtgaatgatagatggctccaaaaccaagagcaaaacacttcctgagagaaagttagcagaaggtgacacccattatggatgcaaagtgaaatggggcagagacaccaaaaccaaataagtgggtttgccccagctcttttactttccagttatttagcctcactgatccgcagattcccaccctataaaatggaggcaaaaacattggctctgtaggtttattaagagaaataaatgaaaacctgtataaaatgcctgacacactgacagatgagttatggtgccaagtagtaattgcttttgttcaatttggtttcttaactaaaaggaaccttgtgaccctccttgagactgtctccacagttctcgggccccaactcaaagaatcctaagtattagcagaactgaaagaaatctcaaaatattatgtagcctaactggataaagtattaatccctacccaccctcccattttacagatcaggaaactgaggacctgagaaggtaagtggcttgctcaaggtcatacaggagcaaatgaggaagataaacttgggactaaacactgcctccttattgggcatttttcactatgcttgctgtttttctttgtactaaaagtcttaggacagtaggggtcatccaagagcaatcctctctaaatttttagtgtttccaatcaccaagatcatatgataaaaacaggggtctagaaaggggacaagatactgattatattaggtcgttaatggctcatgtgagaaagaaagcagtaaatgtttattgagagcattatgaagatccaaactgaacatctttctagagatggtcctattgccacattatttggttgagtaaagtatgtttaggtttagggaatgaaggactttgggaagtcaaagacaaccgtgtaaaaacaccaatgacatgcaatttacccatgtaacaaacctgcacatgtaccttctgaacctaaaattaaaaatggaagacaaaaaattaataaaatttaaaaagacgaccaagtgatacagttgtcttatcaaatgaattctttaaattgtgacatgaaatgctgtaaaagatattttattttgaattgtaaaggtttatttggagtagaagatccttttaaggataccttattaataccatataccacaagtgtagttaaaatggtacaagactttagtcttcggcactgtttctatatgaagtatattctggttaactcactactggggttctatctttcctcccaaggccacccaagtcatttgcacaagttctgattgccagtcaggtactctgctggttggtatgtttcagcatgtcctcatcctttgtcctctgcctgtcctgctgtactccagctcaccaatcagcaattatctgcaagtgaaaagagaggactcactgaccttgattttatatatatgagtagatgaatgtctcttcccaacgaactagtgtttatactgtattaatcctatgtatgaagatttttagttgaacattaaattatatttttgagattttctaatgtttattccattgtttcctcatctagactaataagcaacaatttatatttagtaaataatatttagtcttataagaagcatcccatttcataggactttcagcaagtcaagcaaatgaacatagaattttaaactaaatagatattaagtgctggacagtagcaaaactactgttttattacttattaaacacaattaattaattaaacacattaattaatgatttacacattgcaaagtgtactttcacagttttatatttctttcttttttttctatttgtctgttttaagttgctggcagcatctttgagcattttaaacaggctgaattcccaaaggctttcctcctggacaacagaattaaatgaattctgaggggtgggtcagttttttttctcctggttttgttaaaagctacaatgttgcaatacacaaaagttgggttgacacaagattaaaatattgatggttaacaaagcttctggataacgagcttatttgcctaaggatgtaaattgcaaacctgaacttgagaaaccctttcattgacttttcctatcatatcacactcaccacaatagaagggagtaacatataaagccccagcaatacgaaatggaaaataccagatttttatttcaattggtaccactcagccttggctctcatctgtcagtggacagagtttctttctgggaagccttatctgaccacagaacattgcgagagcaagagcggtgtttcagagcttaaagagttttacagtagttccctcttatccacggtttcgccttcagcaatttcaattatatgcagttaactatagtctgaaaatattaagatattttgagagagagataaaccacattcatataactttttacagtatgttgttataattgttctattttattattgttgtttattattattgtgcctaatttttaaattaaactatcataggtaggtatgtataggaaaaaacatggcatttagaaggtttggtgctatctgtggtttcaggcatccactaggggtttaagaccatatcccgtttgaataagtggtgacgaccgtatttagcaggagtaaaatttggaaaggcacagacataatatacctcaacaagagtgtaagtggagggatgaggaagtcatcagccagtgtaaaataaacttccctgtgacacagagaatctccaaaatatgtataaaatacagttgaatgtttttctatggtaatttgctaacccaatgttaccttttgccaagatttgcatggatactcaagaaagtgaaattattctaatagatcttgttccttgattgggatccagaatcatctttccatgagatactgcctagcaaaccgtgtaagaccaagacaagagtaaagtctcattggtacactaattgatggtggctaatgggaagattagagagactaccacttctcatttgtcactgcagtgccccaaaaataattctataatgatttttttaggaatatactttttttctgaaaggaattaaggccatcaaaatatgttcatcagggatagtaaatcagttagttgcattttccttaaactgctgatcccaaccaattcacagaaatcagcccaaacaggtgataagaaaactcgctagccaatgttttatagtgatgtcatcttaccttggggtagccactgaaataaactgtgcctcagttactttgactgtataatgggaatgtttataacagcaaaagtagtaagacaaaaatttctctagaaagtccacaaataaataaggggaagtcatagctctttcagaatcaaatactccattgaatctccagacgtgaatgaagttttgccccacccagctgtggggaggagccagaatttcagatggggatgcagtccaatttcttccctctacattaagggcttattcctgagtagtctctgaacttggtagcacagaatcacagacatcttacataatttctctgtgtccctaagttgaaataagaatgtatttactagcttcttccctcatgaaaattcaccaggcccttaagaacctcaaccctttaaaccttcttaaaggtcctaagccccagagaaaagtctccgtgcaatctcagagaccaaaaaaatgcacctatgacatataaaacagatagtggtaaaaggttaggaaaagatctactctttcttgagctgtaaacaaacattctccatgtgctctactgctacatcagctgactaataaactaagaccagtttcagggggaaaatggggaagagatcatttactaaggaaaccaggtttgttttgtttttcatctcttatcccaggaacttaagaccaaaggaagtcttctattaacaagtgaggtttgccagaaatgaattgattgccttcacaacctcaccacacttttggaaggtgtctccacctgcttgagcaggaaaagtttgcagacctcaaaccaaaatacaaaggagcaagagatattagccataaaatgtgagcctaaatcttcctctttaaatcttctactctccctacaaaagtcgggagatctgcatcactctattcagaggttctggtctgcaatgaaattctctcttaataaactgattcccccctgagaaccaagcatcatttgatattgaattcatgagtgcaagtaggcatgagaacacagggcattcctctgatggattattacattatatattttatgccacaatttctatagggcttcagaaactcaaaggtgcctgctatgtgctttatacatgtgtagatgattattttacattctaaaaaatagcattgctattttagctcttaaagtctatactcatgaagtgaaatgaagaattttcatctgtatcaatcagttcaaagaaaaatcagattccttgggtttgtggtgacagtataaatattctatcatctattcagtgtctatttatatctcttcttgaagttagcagcatggatgaaatagtgcattctgtcaggagaagtaacactcaaaatggcattgtgctttaagtggagtgggaaaattataagactacacaagtttataaccatacttagttgtttaggccatgatattaataagaccaagatttaggattgaaattatgagccagtaaaccattctagggtaactgacttcctacctttctcgattatgaatttccagctggcttttcctatgtgtacaataaagaactagtcaagagggcaaatgggccagtggaagatttctcccatattagaaaaatggctcagagcccatgccctaggaatggcagataaggaatgtgattgttactcaaaaatgtgagcaaattattaaattgaagagaaccttacagaggttacaaactggcagactgcatgccaaatacccttcacagtgttgttttgtttggcccttacagtatccttaaaacactaggattagttaccaacattacaagattggaagatgtcacacaaaaatctgggtggccctctgagtctgcattcttgcttagcaacaatcagctggatctgagcagccactgctcctctggacagagcaggtacttactagttcacctcagccccctcaccctgccgtcttgtgcccatctcccttcaactgtgtctattacctacccaagcctcagaaggcatattagcttgcaacttcctaaagatcctgtatgcatgagataaacagtagtaggatctgagtagtgtatcttgcaaaataaaaaagattcactttttggtaggtgtcaaaattttctttgtaggagggatagaaaagtgagagctgctaaatgttcaagagatgacccaagagcttcaaccttctcaggtgtctatatgggatcatatgtcctacaggccctactcatgaataaggcaacaatgtggcacatggactgggcccccatgtacacaagtggaaggttggggaatgcatatgttgctccctctacccaccctctttccccaaaagtctgcaaggcataccacttcaaggactgacacaaacctactttttaatctagggctcatgtaagtgtttctttttaccaacttactattgcctcagtagatggttataaagcagcagctagactaaataagaactgccacgtacccaggcagacaattcccaaagctgcacatgcccccaagcaccttctccgaacacccaaacatttcccacagaaacaatggatccattttctgtggacagtcatggtaattctgcaaaacagatactgctttacatctcttttaaggatggtttatatttccaaatatttattatatcctgaatttgggttactaattctacaggtaacccaaattaggttactaatttgtaacctaatttggttacaaattaggtaacccaaattaggttactaattctacaggtatttgtttgccaaatgattgttttgtccagggagcattttcaatcaaacagatttccaaaagttacccccaggttgatgttctgtcagttgtagaagatgaacagttcagaccacaaaccagctctatccatccttagaactcaggctgtagtgaggatattggcatatggctgaagtatagcatctaaggagtaaatattatttagcactaaccctctcaacttttttgagattctcaaagctgaatccaaatatgctcagtgttagttctggtgggccgtctactagtaaaagatgtctcttccctctataaagcagaattcagcatttgccagccagaaaataagctcactagcagacagactgagcactttgatggtgttgctcaagcttatgcaaatgttgtctttgtgtagaacgggtacaaaaatgcaactttttctgtgagataacatttcagaggacttagcttgtgctatctgtctgtgtgccagtcttgacagccataaacactttctctaaccttgagactttggctggagaagctgagaattaaaaaatattaatatcatgaaataggctattactggtaggctcagtgcagcaaatcatgcagaattttattgctattccctgtgcggtcttaccaattatgtgggttttgttgtagcttttttaaatactgctatgtcattactgcgcatgtatagatagtatgatggagtggtagagagttccttgggagccagtctgtctggagttgtactcgctgcataaccttgggcaaaatatttatcctctctatgcctctcagttttcttatgcaaaatgggtattatgatagcataattacttatagggttgttgtgaagattaaatgagataatagataaaacaggacttactacaatgttcagcttatagtcagtactcatttaaatgttagtttcttattatttctgcaggaagtgtggtatgcttggttctaaagagcagtctgggactttcaccatgccgtttattgcatcagaaaggttatctgttggttctcagagcccagagtctactgatcttcatttcagcccagtatcacagaggacagaaagccattaatggaacacacccagcaagactttagtttattctatttgaagtcattgtttgttggtattggaaatacatcattggtaatggagatagtggctactgtcatagaccctcagactcatggagctataggaaaaagggaggcaggagccacagaatgagtctgggagctgcctttagagtggatagccagttatgctaatgaaagcttctggcactaggactggctatcaatggatgggaagttgtgttgttggatacaaaacaacgatgcaaaaacaaatgctatggaatgtgttgaaagtgatgatacacccagggctcaggtggactgggtccccatcccccgtccaatctcagccctaatgcagtggtccagccagagatcttcagggtaatggcagagccacccaacctatacccacactaagtattgccttcagactaaataactattatctcaaatagataaatgcagccatttttcaaatgtgatgttttactgagtgcatcgatagcattttataattgttaatcctccccatcaacagcttccaaaagtacgactcaggatgggtctgaaaacttacctgttccaaagcaggcctttttattccaaattttgggaactactctccctagcataatctcaaaatatatcaaggactgaaagagtaaaaatatatgaaaatacaaaagcaaatggagttctccaaaggttgagtaacatattctatataaaaccccacacttttattttcttttaatgtaagcaggtgtctgctatcagatttttcaaccaggtcacaaattattccgaagttgtcaaactgaaaatgtagtgccttttggtaatcttggtaaagtcctctcctccttctgaattctgtgttagacagaaggcagctgatagctatagtctaccttttgccttgtcctgaccattagattatgaagaacagcctcattggtactataccgtcaactagtcccttttttctccgctataaaaagctattcacatggtttgtgcatattaccactcaattctaaccctatgtaagctcatgagcatttagatattttttaaaaatctacacagcactcttttcacaggggatatttatttatttatttatttatttattgagacggattctcgctctgtcgcccagactggagtgcagtggagcgatctcggctcactgcaagctccgcctcccgggttcacgccattctcctgcctcagcctcccgagtagctgggactacaggcgcgtgccaccatgcccggctaattttttgtgtttttagtagagacagggtttcaccgtgttagccaggatggtctcaatctcctgacctcgtgatccgcccgcctcgacctcccaaagtgctgggattacaggcatgagccactgcgcccagcctcacaggacatatttaaagagcataagatacttataaatttaccaaagtgttaatgacctacagatgttaatggcatataaaatctagagttaacagatatattgtagagaagtgtattttgggccaggtgcagtcgctcatgcctgtaaacccagcactttgggaggccaaagcaggtggatcacttgagtccaggagttcaagaccggccttggcaacatggcaaaaccctatctctacaaaatatacaaaaattagctaggcatggtggcacatccctgtagtcccaacaacttgggaggctgaggcaggagaatcatttgagcctgggacatggaggttgcagtaagcctagatggtaccactgcactccagcctgggtgacagaatgagaacctgtctgaaaagaaaagaaaaaagagagaaatatattttatttatttgtatttgtatggttgttttgaaaacaataaaattgtatgcaaatgagtacatatgtaatgtccgtgtgtgtgtgtgtgtgtgtgtgtgtgtgtgtgtgtgtgtgtgtattttcagattattttattctgggaatcattgttcctacttcttatgctactccacatggacaaagttggaatattttctctaaatgtggcacatgtttttatttgtgttttgctctgtatttgaatgtagagtagaacagggattaccagagcatgtgccagtatcactcaggaggtcaatgagattgaagaaagtttttaactttagtttaatcatacaattaacaatgtagccttctcctgtccatgtcaatgtagatgcattgttcagtttttttaacctcatgctccatactatgtcatatctgatacccagtgagctcctaaccaatctgtccactcccttggtacagacattagctggtactgccttacagatcagattgtttaactttggattttaactttctccatcaacaaattaaacaacttcatctaaactgagagtaatactatgaatgatataaatacttatgaattaataatgatcaaataattaaggaggtccagcctagtcaatccacggtggtctgaatcaacggtttcaggatttgagcttccattggtcagagctttattgctcccatcagataagattcatattttgtcttttcctaaccgtctcccagtggaatatgcgaaattctttatcagaagttactgttatatgcaaacttctatcacctctaaagataagaggcattggatggtttttattttgggaactatttaagaattgccagactccacagattaacctggaatttccctcttgcctattttatatattgttctctatgtttttcagtcatagccttactgtctcttaaactaccccaaaacttaggaacctgtaaaaacaaacatgtattattaattgtgagtctgtgggtcaactgggtggttcttcttgtctgagtcagtttagctgatctctgaggtcagctgaggactcagctagggacggatgatccaggatggccttacccacatgtttggggttgggaggatggttggtcaagggaagggggcctcagctggcatgacttatcctccagtaggctagcctgggctttttcacatgtgatcttagcattccaaagagcaacaagtgatggcaaggcccaatgtgtgcacacatgtcaatctctgctactctcaggattgctattgtcccattggccaaagtaaatcacatggccaattttaaaggcagagtgggaggcactaccggaaagtgtggacacagagaaatgtgcaacatagggagccattactgcaataatctaccagactaaactggcatgagttttgtctgaaaaatcgttcaaatataaatgtgcataatttgtcactagattttggttattgttcccctttcacacatggctcttaggttatagaattctatattgctcataggagtttttttaaacagtaagttttctctgcatttagaagacaattttcaaaatatttaataaggcagggaaatggtggcgagaagagtagactaaatttaaacaagcatccttttccaccagcatgatagtggggcaagcgtaataattaaggcaagtctctcactctcagtgagactcaatttcctcgcctggaaattgaaggatttgggctaagcctccttctgactctaatattctttaactataagacatctggaatatgtagaacagtacaaaaagtgaggttgtggttcagtaaacatatggatatactgtcttatgaggaaaatattgactttgacaaagtcaggtcaatgaattttgatgttcgccttaaaagaagtcaatacctatgtttttaatctacacataaaataatgattttaagagccaaagctattgatggaaataagtctacctctcatcctaataaatgccaatatatatggtgtaatattattatagatcatcattcattatggttgagaattctttgatttagaacaagatattatactcttaattcatcatccggttaacttttcttctgaaagtaagataaaaacatttctcattctttttgggccattagtacatgaaatagtatattcattacataagtactggagcttttaagctatcaatggaatcttgtttagtcagctaaagcacatgtattacctttttgtatgggtacaaagtgattcaaagcaagatatcttttaatcctctgaggaaaacagttgtatatttttctctggcctgctttccatgttaacatttcttatttcattctgttttcctgtggacttggctctgaccattaagtgatgattaaaaaaaaaaataagagacccaaaaagaagtgaaggcttcatgttcatgcttaggaaaataattattgtaaccataattttcctttaaaatgaaacatgatgttaacattcacagcatagtacagggaggacttattggatgtccaattacagagcacctcagaaacatcacttgaaaataattgtccatgttttaggtcagaatattctttggaatcatttgtccacagtcagagtcaatctaaggatttagtaattttgcaaatagacaggaaagacagaaagtggaattaaggaagtagagagtttcaatgtttaaatgaaagaatttgtggccctaaaagaacaaaaaactttaagtgtgttcctgtgtctttctatttcttccattcccgaaatatgactacacaggttcccacctctctcccccaacacacaaaccatggacccaaattttctcttctaacagggtccccatgagtcaatgttaagagcccagaccagaactggatacaaaatcctggcttcaacctatgagacagtgggcaagtcactttgtaaacctcgttcttaaaatgataccaagacttatctcataggacatttatgagaatttaaaataatttattgtacagatgcggctagtaaagtgcctaagactcaataaatattagttttctttttcacacttagatgcttcatttccacattcatgtaaacaaaatttaaaaagaaaagaaaaaagcacaggatgagtgtcactgggggtgccctcgcatgaaccccacgctcgcctcccccagggactttctggcctcgcttgttctgtactccacccaaaccacaagcatcaggtcttcctcagggaagtcctttctaaccacagacaccaggttgggtctccagttatacatgccctactctttgccacaatttgcacactgctattaattaatttattatagttagtggctttctgtggtggataagaacatagactttggtgtcagactacttaaaatcaaattccacctcctccattcactacctgtgtgaccttgggtaagttacttaatatttacctgcacttcagttttctcatctgtaacatgtggataacagtattacctacctcaatgaggcaatgtatagaaagtatttaaaatcctgctgggcacatagtaagctctcagtagtaacagtagtagtagtagtagtaatagtaatagtagcagcagcagtgctgggagtactaagacctctaggagtagcagtaatgtctactggactgaaatgcagtcttttatttaccactctattctcagtgcctaggtttgtgcctggtgcacagtaagctctcagatacatttggtgacagactgattgctttcagatcaattatgagtctttgtaaagtgtagtagaaatactttattacttatataatcatctgggttataatctaagagttgtagtggttaaaatgctgtaccacggtctcagtgtaagtcctgtttctgccatgtacatattgtgtggcttgaagaaatttactaagcctctctaatcttctgtttcctcacctgtacatgaaatcctcatgaggattgaataagataatccatataaaatgccaagcaggttgagttgcacacagcgagctctttccacgatgtgctgtcatgtcaagtgagacctctggtccagccagctaggggttctgtctggacctcacaaggccccaagggggattttagattttgcagacatacatcgttgccctttaggagatatttgtattttcacttcaaaaatcttcctaatctgtttttttgttttgttttgttttgttttgttttattttgtttttgagacagagtctcgttctgtcaccttggctggagtgcagtgcagtggtgcaatcttggctcactgcaacctctgcctccggattcaagcaattcctctccctcagccccccacgtagctgggactacaggcgcatgccaccaggcccagctaactttttgtatttttagtacaggtggggtttcaccatgttaaccaggatagtcccgatctcctgacctcgtgatccacccacatcagcctcccaaagtgctgggattacaggcgtgagccaccgtgtccagccaaattggttattttaaaagaagtttcagagccagctgaatagaatgaaaagaggtaacgatgaagatcccttcttccaagcattagaaagcactaaaatttctagttgagtttttgtaaaaaggaccttagtgtagactgaacttctaaaattcaactagctttacgtcaccttttaaaaatggccccaatctagaattgggaccatgatatcctatgcatgtgaatgaaccgctttccactgtgtgaatcagtgtctattcagcaggcaaaacatcatggtctcctcattaactccctttttaagatgcagtcccttagctttaaaaacattttaggagaacacaaaagttacacacactgtagttacaaagaaaagaaaactccagatttatggcaagtaatctaaataaaacaaagccataaacactctaatttaatgtggatagctgatactacgtggacatagatcataaaatcctggagactagtctgattatttattttactgccctagtgtgatatgattgagataataagtagatgctttcatggaatttgaaattgtttttcccataaaacatgtttttcttaaagctggatttacctaaattcactgacagctggaagccaaatgtattcacactaaattgtttatatcacagggattccagtagatagattaaatatgttttatttattaatgtacaacaagtagaagagaccctggctttcatattttaccaaacatttttcacattatttctaaagtttagaatgctactgaaatgttatatggggagtgtgtgcgtgtgcatgtgcctgtgtgtgcatgttcatgtgtgagagtgagagagagagagacagagagagagagagagaggatgattgcttgttttgacaatgtgccatttttatggactgctttttctttttggtttcgcaaaataggaagtagatgactgtttacaatggcccaaattttgatagttcagaaactgaccatagccatccatactcacttggatctccttggaaccctcaatcccctgcttcaggattctcacatccctagaaaataaacaatgggaatgcaggacttcaggaatgataagacaagagtttactttcttgctagagaaagtgtagtacctagagtggaaggatttattaaaaattcaaattatcaggccccatctcatacctactgaaccagaatcttataaaaatcacttataaaagtgatttttacatacattaagtggggaagcactgccctgggagatttctcacatggttgaccaccaagtactttggaatatcgccatggcgtggctatagaactggataataagaaagaaccaagggcatagagaaactcttcttttaccacccattgcctcgaaatagatgacttacatgctgatggggagaagagtacttcagagagaaaaacaagtactacctgtacatgatctgaagagccagacccaaatggctagtaatggtcagcaacatgtctcaaaacctgcagtgggtgatgaggaggtactgggactctatcaagaacattccaaaagctgatgagaatcacaggtactatcaaaatttgggccattgtaaacagtcatcttcttcctattttgcaaaaccaaaaagaaaaaacagtccatagaaatggcacattgtcaaaacaagcaattatcctctctttcaatctctctctctctctctctcactctcacacacacacatgaacatgcacacacatgcacatgcacacgcacacacacgcactattcaggggtgaggagagctaggggaagctgtcagaaggcctgcgaggagctttctgaaccttaggaaagtcttccttgtatccatagaccgtttcttgggctgatgagaatcacagcagctttctactcaaggtatcttcaggtacagccctttgtccatccattactgaaacatctagtgatgtcttccccagatacataccataagttttgcttaattcaactcaacaaattgttactgattgcaagtcaggcaccaaaaccatgacttgattaaaacagaagaggaagaggccgggcgcggtggcacacacctataatcccagcactttgggaggccaaggcgggtggatcacttgaagtcaggagttcgagaccatcctgaccaacatggtgaaaccctgtctctactaaaaatacaaaattagccaggcacagtggtgtacgcctataatcccagctacttgggaggctgaggaatgagaatctcttgaacctgggaggtggaggttgcagtaagccgagatcacaccgttgcactccagcctgggcaacaagagctcaaactccatctaaaaaaaaaaaaaaaaacaaaagaggaagaagaacttctaaataaccaaaataggtagcaaagttcattcctaaagcttatcactcttccatgatgtaaaatcaggctgggcctatgctgagtctatttttatttttccattttattctacattacacataattccagcaagcttggttatctgctttccaagtcctccataagaaggggtgaattggagtcaatggaaaagaagggacaggacagtgaacaatgttgctgcaggaaaatgcactaatccagccagaagagcaatagattctcagcaaacagaggaacagagacctacaaatagaagacacaagagcttataaagcatggccatctggtgccatttttgtgtaaacaccaacatttctacatacctcaaaagacctaggtcttgatatagtacatcagtgcaatgggttctgaaaagggagctgagtcttcacaaaaagttaactcatattcagaatattataatcagaaaaaataaaaattatgtaatatattttagaaagcgctccatgcaaagagcctccagtagaaaaataatggtgcttgaaatagcaaccacagtatttttggggaatttgcaaaggctccatctataaaattctggatggctgagacttcagtatgtttttataagaataaaacttacttagcataatgtcaattgactgaaataaggaacatttaccctgatgagccctgagttatccatatgccttttgcacgagtgagacctttgcattatctgcatcagctgtgcatgtatgaacactgcatagcactgcccatgatgcatccaaggactcacagctgtcagcacacccctctcatacttcaacccaaattttcaggtcctcgatggttatttcaatcaaaccttatggaagctccaaacaaaagacccacaatccttatttgcctactccttaagacatattcaaaactggggctatctgcatacaaaatatcatgaaaatcatatataaaatctatatgtagtatatatgttgatgtagtatacttaatacaatttttatatcatcacattcatatatatgagacagagagagaaaaaagcagaaagttgggaatatgcatagggaaagttcataaaaatatattctaaactcttaacagtgattgttttctgggaaatagtattacttgcagttttactttcttctttacatctctggctgcagtctataaagtttttgtaaagaacacacacatgcacacaaacacacatataaaattccactattttcatttgagaggaaaagaagaaagaaaaagagaaaaaggaaggaaagagggagggagggaagctgcttgattgatatcccaattttcatctatcctgtaagttcccattcatctttctctacaccaggatatcctcccctttttatgtgtatgtgacttccctgtctgtgccattgattattctacacatccagtccctgagggtgtccctttttagtggatgataaaacccaggccctaaggatgaaaaccatcctgaagccataaatccagccctggacacagccaaaaactggggacccttcaccagttgagtcactgtcccagaaacataaggtatgctgtgaccttctgcttcagttccataatgcagtcaggttatcttcctattcagaaacatgcctacaaaccgagaccaatctttggctcagaatgatgatcatcctgtcaatggttagtacacattaggacaggcagtagaaagtgacaactttggaaataggcttgctgacattcaagaagccttccctgaagctcatggctcaccaaaagtaagcagagcttaagtaacctaacaaagcagtcttactttattcactcctgaccatgccctttctttgtatgctgttcaagactaaacagtataaaacaagattgacattatgtaattacttgccttttacactgtgctaacttaatttgcttttcattctcaagtatttaagaaaccattactttcccatcagactttactgtctgccaattaaagcattagatcgatgaggtggagagagcacagtgtttggcaagatttcaggtggagcaattgaaaacaacagctttgtatccctttccttttgtcaaagacagaattgttttgccggtttaccactttctgtgtcaccctctgttcatcctatgttgttttttggttccatttgcaagtaaggatggtctagccatcgtctaagatttacaactaaatacaaactaaatttcctctctatgggaagagtaggtgggtgaggatcaggttgaggagctggagttttttggggtcacgtttactctattgggggcacctaaattaccaagcatgttgcgttgggctcctcagatgtcccacagaactgtgcggtccctctgtcttagctagtaaatttctgcaggagctacatctcagctctatagagcccacttcaatctcatgatcaaatatgatttgtgtccagggaaactcagagtttgagttggtttaagtaaggcatgatgacctgaacaaaaaatgcaagtcacttttcttctaattcactcttattttgagtaataagagctgtagcactgagggctttctatctcatcctcatcccttgaaatccagtcattttctttttctctatgtcattatgaaaacacctgtactttagaagtacaggaaatcatggtaattgcccccaagaacagcagagggaagaagagtccagggcaaaggtagagacattcgtcagctccagaaagcattttttagaaaagagaattaacgaataaaaagggtcaccatcagcacagtcagatagcctctgtcattaaaaaattaatagacttccagttctgataactcagggaccagaggatgagaacaccttgtgcaatctctaaatacaaaatatgattattgtgtgtcgtggcctccttgtgagacttcatggttctactgctgacctagaaaaagtaactccatgggtcttgatcaaacaatgggctacaggttgttttggttaccctaatcctgcatttagaacacacattgattcagtgagtccatttttttctccattctaagagagtatccctggagaagacagctgttgcctcacagattctgcctcagacttaaccctgagctcactccaagtttggattgatgattcctcactacaattactgaacccatgcttcccctgcttattggtaaaagaggttaattagatagccattaaccacatgcagctctctaaatttatatttaagctaattaaaatgaaagagaatttacaacttagttcctcatttgcactagccacatttcaaatggtcaatggtcatgtggctagtggctaccatattagagagtgcagatataaaacatttccactatcacagaaaattctatcagacagcactgcagaatgagaagctcttgctctctcggcatcccttcattcccagggaaagccctagggaaaataagacttttttagacctacagcagtagttctcaaagatcactgggacctaccccaagagtttctagctcagtcggtctgaaattaggtcccaaggatttgcatttccttcaagctcccaggtgatgcagctgcttccataggagactacgttttgagaatcactgctctataggaagtaggagcaataccagatcattggtaactggtacatctgaaaaatgaattaggatacccaagttttagtctcaattcagtcaaaactcatttgttgagtttctcctttaagccaagcaccaggctgcaaatatcaagtcttggctctataactgaaaaggaacattatgtagagaggcactggccaatacagcagccacagggcctcatggggcaagtgagcacttgaaacatgcacagaataaatgaaatttttaacattattaaatttaaatatcaaagtgatttaaaatattttccattaagcataactatatcattttggcagaactatgtttcacttgaatctttgaaaatttaatgttaaaagaaattgagaaaattcaaatgaaaacaaattgagatgtggtccaaatgtaaaacacatattggaaatatagtataaaaaaagaaggtaaaatatctcaataattttatattggtggctgggcttggtggctcatgcctgtaatcccagcactttgggagaccgaggcgggcagatcacctgagatcaggagttcgagaccagcctgaccaacatggagaaaccccgtctctactaaaaatacaaaattagctgggcatgggggcaggcgcctgtaatcccagctacttgggaggctgaggcaggagaatcgcttgaacccgggaggcagaggttgcggtgagccgagatcgcgccattgcactccagcctgggtgacaacagtgaaactctgtctcaaaaaaaaaaaaattatattggttacatgctgaaatgataatatttgatatacattaggttaaataaaatatattaatgaaattattttcagctgtttttgctacatttttaatgtggctactagaaaaatttgaattccatatatattttgcattatatttgtattggactgtgctgatctgcaactcgaactcactctcttggcgtgtcaattgcccatcaaccgattggggcctggggtgttggaggtgaagagcagtagattaatgacctctaaggccacttacatctctgaaagtctgtgattcctagacaatctactaggagatcatcttttttaggttctgtttttcctccaaacactgggcaaaatctaccatttattcccctctgaagatcctaacagcccactctcgatctgcagttcagagaaaaagagcaatcataattgaatctccttaagctacagagcaggtcagcatgttggacccacacacgcttttccaactgagctgtacttttttaaatttttttttaaattatatattgacaaagtatagtttatatttgtatatatttgtgggtacaaagttgtgttatgatttctaaatacaatgtggaatatgatactaatccatagttttgtgttgaaaacattagaaatttcctcttagcaatattgaagtatacagtactcatttattaaccgtattcagcatgctgtgcaattggtataataataatcagactcattcctcctatctaattgactgtcctgtttagtgtcactacgacagaatacctgaggctgggtgatttataaagaaaagaggtttatttatttcatgcctctgcaggctaggaaattcaaaggtatgaccctggcttctgatgagagctttaatgatgtatcataacagcagagaaggtcaaaggaggagcagacacatgcaaagagaggaccaaaccagaagaggaaccttactttacaacaatcctttccctcatgaatactctattccctcaataccttgtgaaatctctctcacgaccatgagaacagcaccaagacatgcatgagggagccacctgcataacccgaacacctcccgctagaccacacctcctgacactttcacagtggagataaaatttcagcaagaattttggtggtgacaaactcaaaccatagcaaagaggctttgtatcctttgactaatatttccccattctcctcacacttcaccctttgaactgtacttcttaaacacatacctatggaattaagtaaaaatgggcttgtttttcttgtgtatagcaagacattggactcccaactccagtctttccaccagaaaaaaaaaaatgccacgaattgaaatgctaactattattcaatggcctctaaggtcaaaaatatggaagctacttcaatcagaatgagtaatatagacacatttaaagaaattaaaacaagcccacagattttctgacattatgagtgctatctactatctcctttcctctgctgtcccggaagagcactcaatcccagagaatcctaactaatagtaatactaacaataacattcattctagagttgagttgtatttagcatggtcttttaaaaggctttgtgaatgctaaaatgtttacaaaacttttaaaaatataatatttcaatattccaaccacattgtaaccatgtagcaatacataattagctacattgaggagtaaggttcaatgacgtgcccaaggtcataaggctgagtcgtggcagggccagaactctgactccatgccctggctgttttacttgccccatacctggccttcttctggggtgctaatggctgccccagaatggtgactgagccagatcatgggacgaactttaaacatttcagaaattccagttattttagaaactactagctgtggagccactaagaaccaggtaagaaacttgaggactagcactagacaaattatgaagttgagatttttctctagtgaatttctacctttcctttttatgctgccatctcctgcccagacttatatctacctctcagataatgaacactttaccagacttataaggactagtttccaataatgacacttagggcagctctggacatgtccctctccccagctacattaaaacttacccatcctgtgtcttcttcacttagagcttagcaataagctccagacttgtaaaagactaattcacattcaagattgcagtatttctcctagaggtggttttattcttgaaagtaattcctgggtgaaggcaatgtcttaaaggaataaatgatcaaaaaatcttggacactagacagaccaaaaatattttcagacgtgatggtgtctttaatcacattatgaaaacatttatttataggtgaaggtcatgttcaaagtgaattaaattaaacctctccgttcatcactgaggtgctttggccatcttgctgaaagttaatgaagatgtagaaaacttcatgaagtccttctgaggcaattggtgtttctgggatcactgatgggctgcacagtccatcacccacaattgtcatttcagatcttcctctgagccacagctggtcccaacttaaactactgaactgagtttagggtctcatgctagatttggtatagttttcttactgagatagactcagatatcaagatattaaaatatttcaaaggttttagagttaacaacattaatatattgaaattttttcttgaagtataagtcctattttatcagtacatcttctacattgataattaactgtatcctttacccagtgaatatctaaaataatgtatagtttaccaaaattatgggaaatctacagactacttctatctagggttgagcagatttccctttaaaattataattctgttagactaatgcttgatacaaaacacataagagccaaaaattcatgttaagtggcaggtaaaaggcaatctgaggtaaaatatgttattgtattataatatgaagttttcaagaggccattgttcacctattacattagcaattactattttttaaaaataataacactcaatgtcagtaagaggcatgagataggcatgctcatgcaatgttcaatgtttcaaagaacttttgaaataattatactctttttcttagctattcctcttctaggaataagagaagtaaacagacatgtgcaatttatagtaggaaaaagaagcttagaaacaacttaaacattcacttatgaaaaaatttgaatacattaaggcacatcacatcaagaaatattacatatccactaaaagtaatcttttaacaattgtggtttttattttaaattttaatttaatttaattttgcatagagaatatgtgaattatatatatatattatatatatataaaatattttagttgcagagaaggttttcaatgatatgttcccctcacatgcctaaccatctccccaaggcaatcagttttaccagtttcttgtttatcatgtcagagatattttatgcataaacaagttctaacgtgtgaataaaagtttgtcttccctcaaggacatcacattaaatttggaagtttaaaaaagattactactcaattctctacgatttctcactacaaagcttcctgtgagatttccaaaattttcaatatggaaggacttcctaccgtgggacattgctagaaatcctatttgcccacctgtctgattaatagagaccttctgattaagagcaaaagaaataaggagttgtagtcatgtgggcactttccctccaaattcctaatcactggttgtattttagggggtgaatggaagtgaatgagttttcctttttctcagcctagatgatattcactcacccactagaagagatgagttgaacaagcaaagcaacttcttaattttgacattggctacagtgacaaggaaacaccttaaaagcaaaagtagaccttgaacttagcttctcacacggtcagcagaacggtgtgctggccagtcccacaccgacacttcctgccctccatcatgctgagccaggggccccactatgtcatcatggcacatttaacttccatccaggtccccatcaacatcattgccctcattgtgcttagaggaaacatcacaaaccttagaaggcaaccttcacgcactgtctccccaagccaaataaaatgtcttccacgatgacctttttgctgggactttgtgcttttttcctcagataaaaatcgcaagatgtaaaatttgttatagaaactgtttaatgagtatctggacctgaagcatcataagcacttaataattttccaagcaatgactaaatgaatgaatcctatattgttgttttaaagaataaatgttaaagatgcatgcatgataccttttggcactgtgtttggtactaaatgaaaagagcagaggtggacattttgatagtgaggaaaggacttctggatttgtatttgagaaatgtttaatgcagtgtttgattccaaagccctaatgataacaggatacacatgatgacaagtgacgatccgtccttggcagctgaccttactaacagactgttatgaccctaagctattttgttggaactgagccatacccacagagggggagacagttaacaattcttgagttatgtagcacctttctcccccaaaagaaatcccacacttagttggcaaatcctttccctgtatctggctatttaatgccttttctcctgctctgtagagaaatttttcactgtataaattggtttcatttataaatggtgaaaatttttaaattaaaaatgtacagtgccatttaaatataaagtattattatttatggtaactattattgctgttataattaccataagaatgataatgtttataatgctctcccaaaataacaagcaacttgttagctggataactagctcatgtaactagctagtgtaaacgagtataagcccaggcatttagtatgcatttggtaagaatttattgccgaattaatcagtaggtgtaattttccttgtcttggaattgtagggaataagaactagctcctaggggaaggaatgcatgatctgtaggagcagctctatttgatacatgatctgccaagtcagaagagtttcaggtactcaaccccaaaacatgcatatgcccagtcgtggctctcagagaggatgcccaaccttcagtgatgaagaaaacacaggcactcatcatgtctgggcttttgcagctctctttggtgcaatggcagtgagctcagccacaggacgggcagttttcatgctcagtagcaaccaccatcttctgaccgctttctatttgccaagcacaaggaaggaatcatggcaccagtttgataaatggggaaagttggacacagagaggttgattctgttgaataaggatgcatctcttaagtggactagtcataatatgagcacaagtccaaagcccatgccacaaactggtgtttcccaaagattcagtctcagtccactgggaggatcatgaattcctccaggcaagactctaattaactatcacaagtccttatctcaggtcttataatacacaaataattactccactgagtttcatttttatgtaagaataaggacaaattcaccagtaacttacttagtcgattactaggagttattaaaatgttggtattcacaaactaaaatgaacatgttattagatagtttatagatggctctaatacatcactctaccaagggttcaggctgacataacacattgtaaagttgctattttgcctgtgtgacacacagagagctggaaatccactagaaagtgataatgggtgggctaagcggactgtgaggtctttgccttgcttaagtgtgctgtaataatatattaaaaggttgagtgccatcgtcctaactattatgctaaaaggaaagaggagagagtttattcccttccacgtgaacggatcagtgcaagctggtactgtgttcttgtatatggaaaggtagcttaagcactaaatattattttatttttctcacatccctataatttacatagaacacaattattttaaaaatgtcctattattttctaaactaatgatctagaatctcaaataaggcaggacatatccaatgctgatgaggtcttaattcacaggttgattcattttttgaataaatattatttgaatccttgcctgttttgagggatgctaacgagcctgcctttttcataccctaagcaatataaactccttggcaaggccatttaatctctcttcagaaaatcagaataagcacttttctaaaacatacctaaggcagctgtgcattcaacacatcacccatcaactgcctttagcaaacagaagatcatttttagatacccagtattaactattcttggacccactagttgcaagggcatgggcaaattgggttatccattctatgactgtttttatcacagagttgacaatatatattgttctttagtaaaatgttcctactcatctgaaaaattctttagccgttgggatacagctcttaattttcaaccataagataataattcaacatttatttatctagatcacccaattattatttgttagtaagtgtagtggtgttaaatagcaattatttctacttggcaatttttatctcagcccaggaaaaaataaattgtttaaataaggtagaagaagaagtcttttaagtctttgatatgacatttatcactgaagattccccaggctttgttgacccccaaagcagctatattttaataatgcttttcaagcagtttgaaaacaattttcatttaccacttaatagtatttaggacagcaacttgaacaactagtaagtgttaaggttaagaaacaaaaagtaaataaaatggaaatgcaaatgctgctacattcgctaaattgtattcacattcagtactttttcatttgttctgataaagtatggtaagcccccaagctttatgtagtaacccttcatcctagaaagaaaagaagagagatcactgtgcacatgtatttctctttgtacttttttctttctttagggaaatgagagtttaatatgttttcattcagtcccgaaataacattcaacattaagtatagcatatgtattaatgatgataagtaaaaatggtaatgatgaaaatgtcgacccagcctaatgtctatgattaaaaggtagaaagaaaaaacaagtgacaattctcattcggaaacagatttacggcaggtagtcaaatttcacgagggttaggaggattgtagatagcctttcaaaccaaaaactcatggtattgttggtcagtaacctcctatggaccagcagtatcccaacaggggccttttggggaatttaaacttcaacaacaatgacatactgtattttccacagtataggcggtgtgtccaccatggtagccaccaaattgctcctagcaaggaagtgacccggtgtctgtctgctccttagattaaagaggaaaaggcttctgtaatacgtagtctgtctttgctggcaaagatcacctagccctactgaaagtatgggggttggaagcacaattcttcaagacttcttcaaatagaagaaatgtcaatatttagtacttaaacattaaaaagtacgtctttcttgaaatgctctaaatatcactcacctttgtaaacaagtctatatattgtgtacgtgatttagagaatgggcttaaatgctcaaacagacatggatccacattattaattatgtaatataagctgttgttctcagatgttagcaagcattagaatcaggctggagagcgttttcagacacagattgctatcatgttcattcctagggttcctggaccacatctcagtagactcgaggtgggtcagggaatttgtatctctaacaagtacacaggagcaggaggtggtactgatgctactcattggaggaacacatgtggagaatcgccaatctaaagttccattcctagccctgctgtgcctcagtttcttcaccagttacttgagagtactaacacctaccacccagagttgttgtgattaaataaatgagataatgcatttaaatctcttaacacaatgcctggctcctactgtaatatgctctcaatccatgctagctattactactgtttaattctatggaccctggagagatcagaaaatgaagacaatgaatggcatgatatatttgcctttggttgcctctctgaattttctgcttttacctttaagtagactaaactcctgttttcacttctgagttagaaagatgtagttcttcaatgatgctaaatccacatttagtttggcaatgtgaattgttcatgtggttttatattccacatttgtttctcattctgttcagtaaaatattcatgattttggttggctgtaagatgtcccaggatgagcgagggaaaagaaccgtgcacagttctaccttgtaagatacttcagggacaaatttccttctacaaacacaaacttgggctgcacacagagataatgctaccattcttggacttttctacatttttaagtaatttactatagttggttgttaagctgtctcctggtgagtatgttccttagaagacataagatgagaaactcaactctttcactggttttggaacagagctaagttggtttaacactaatgactgtacctgtattctttctgacaggattgtcgggttcttatgtaaatgagtatatgttgttggtgcctttgtacagaaagaaaagaaacagactgagatctaaaaaatagcaataaatgaaccaaacctacacatctagggttaaaaagcactaatgtttataaagaagcaggtattctatttgttgttgttcttgttgttgtgataaccacaatggaagaccagactcatgagagataggaatgcttttggtagaaaattctgagctagcatggatgaaacccatgcactaatatataataatataggtcccaggtgcagcagcttatagccacgtctcctggattaaagcaatcaaagctcatcctgcgatgttgcatattcagcaacatgcaaaattactaccatcacccatgacaccaaataatagaagtcttcatcacatatgggcttctgaagggacttatctgaagtcaacttccaagttaagatcccttggggaagattcttatgttatcaatttctttgtctatttttttgaatggtgtctcctccactcagggaaatgacttcagactgcaaggaggtagaacaaacatcattaaggcaggattgaagttcaccactgagttgaggattgtaacggtgaggcttgccactttacataagcctaagtgtccagatgaaagctatgttgggggactacagatgtgtttcttctttgatggcaatctttgtgattcctggataaatgaaaacatttcagaagttagaaataagtgaaatgtcctacattcaaaagcagacagggaaagacacatttcatatagacacatgtttatactatatatatatttatttatatatatacacacacacataagtgtattcataagtacataagtatatctatatacatatatacatgtattcatatagacacacatgcactgcagacactatagatactctacaccatggctgtaggacaaattactgactagagccttacgacttgggaagtaaagtggtatcattggtagtcatcttgggcataccagaaattaagtaatgacaaactaatctcatagcatttctgatactatactgttaagatcagtgaagcaacacagaattgtgtttttattttagcaaggtttctaggcatactacagacatatgggctggagggaatcataattggttgcaggagaatgcgacaggggtacttgttttgcaacgtgctgaactccccattgttgaatacatgctgaatgagaaccaggaaagtctatttctcttcctgcacaatgagcttatgggctgaaagttccatgaagtaaggttcttaactcaggtactagagtatccgctcaacaaagaggtatttgataaatgaacaaatgtcaaaatttaagaagtgattgttacagccattttctaacatccagatctctattcttaaatagcttcgatttctactgagttaggacgtgtttgcttaagaaacacgtccttacaataagaaaattgctagtttctgggccgggagcggtggctcacgcctgtaatcccagcacttgggaggccgaggcgggcggatcatgaggtcagaagatcgagacctcctggctaacacggtgaaaccccgtctctactaaaaaaaaaaaaataagccgggcgtggtggcgggcacctgtagtcccagctactcgggaggctgaggcaggagaatggcgtgaacccgggaggcggagcttgcagtgagccgagatcgcgccactgcactccagcctgggcaacagagtgagactccgtctcaaaaaaaaaaaaaaaaaattgctagttcctttgttttctattctgttatctgtgttatctgtataactttccctctgatgaaaaataaatagaagtactgttgggaaaatacttaaaactgtgaatggtttttataacatggatttgaatcaaagttaagatatttgcaaacccagtcgccagaataattttactactaattaaagcaataatccctattctacgttgcacaaaaattaaactgcacaagtttcttcttgcatttgccaaactgtaaatagattaacccattctttcagccttctaaagaattgactaaattaaaataatattgaattttagtaagtacccttcagatacctcattttgccaatacagatttgacagaacaaaatgctgtcatgactgaagaaatatttttcactgcttattcatcaattcagataaaatgatgtcatacaaagtcaaagttcagaaaaacacagatatacccccattattcccatactgtttccttctatgctctcatctataattttaacggaattaaatgtttaattagtgcctactacataccagaatattggcttaagtgcattcacatatatcatctgattcaattctcgtaacaaatacgcaaaatagtaattatttttcctaatttacaaatgaggaaacaaaggttctgaggggctgtaacttcccaacactgcatagctagagaagtgtagaaacagaaccctcttctaatgctgacacatcctttcaccattgcttttttctccatcatctaccaactgttgaccctaggaggtaatgagtagttggtcattctgattctcaactcaaaggataaattaatgaatggacacaaaatttcttttttttctttttaatatgacccatactgcctccagaaggatacatgagttcaatgtaaagacttcaggagaattttttcagtgatttggaatcaaaataagactatcaataaacatacaattgatagctgatatttactgaatatttaccatgtttcagacaccgtcacctgtgcttcatatgcattttctcttttatttctcaaacagcaaaactgaactttatcagctgggtataattttcatctctacttcacagaagaaattgaggcacagagggattgagtaacttgcactaatcatactgttacatagtaaagcctgtgtttgtgtccagccactgaaactctagaacagtggttgtcagctgggcctattttgtccccagggggtatttggcaatatttggaaacctgtttggttgtcataagtgaggggcaacactggcatctagtggatagaggccaaggatgtttaaaatacacagaacagctccagagaaaaaaagaattatccagcccaaaatatcaatgacaagcataagaaaccctgctctagaacctgccttttggcatttctctgtacttctgtactactgaatttgggcaaaatcatggaaataatgtatacagcgtctcacattactgatgattaattctcagctgcttttaatctcacgacactttctcatgacaatattgattataatacattgcaacagcagattttactgtacctcataaagatcttggtatcttctgtaaaataaaaatgcctggtttcacttcccaaaatttcgtgctaaattagtctgatgtaaatctcttgggaatcagatattttttaaaaagctccccaagtgattttaacatgcagccaagttttgagaaacatgtagagaaaaataacagagatttttgtagagaaaaataacagagatttttaaagtatggaacactttctattctccactaaaatagtatcctagtaatggttcaaagttattgaatgtttattatgtgcccagggctggactgaatgctttgcaggaattatctcactttaaattcttcaaatattctctatgcaaaattaaattaaattaatacctaaactcctaataccatcatcttgagggtaagaatttgaacatattaatttgggggagacacacacattcagaccacagcatcaccattttacagatgatgaaactgaaacatctgaaaattaacttatccagactacacagttagtgagtaacagagctgtttattaaatgtagctctttctgactagaaaacccatggtgtaaaccagcagttctgaaacatgagcatgcctcagaaccatccagaaagctagtgaacacatagattgttgagctcagcccccagagtctctgattcagtaggtctggaatggtatctaagaatctacatgtttaacaagttcccagtgatgccgctgactttgctggtctggggactacacttttcaagaacctccgtgggatggtttctataaaatcaagctatttttaatgacatttcttctatttgaggggatttatccctcatttccccctgaatcttggcagctgtgggtggttggagaacttttctgtccccctagcataatgtcttctgatactagggacggttgtaagcactacgttagtgtgaaaagtgcataatagctgctgcctactgtgagatggggtcaagggagagctacccaggggagaaatcaactcccccttgcctctaaagctaagctcccttaaccagagaaaatgaaatctaccaacaggacagaaacagacctaaaccattgggacaacaattcaaagtgacaattaaatgccagatcaaggggatgaagggacaggttgtatattaagggaaaacaggaaatgaagagaagatttttgtttcaacttccttgttcctacacttagaaccaactatgattaaataaagaacaaaaagaggcaagtgtttttctttttaaactatctctcatccccactaaacatcagcaagcaaggaagcaaacatatcccaaagatgagccatcgatgtaaaacacaagttaggggaaatcatgagagtaggcggtgagactcctatatggtcccccagtgttgagtcaagcaactagcgtgtattcacccattgatcaactccattcttggtttatttgtttgtttgtttgtttttgagatggagtttcactattattgcccaggctgaagtgcaatggcaatcttggctcaccgcaacctccacctcccaggctcaagcgattctcctgcctgagcctcctgaggagctgagattataggcacccaccaccctgcctggctaacttttttgtatttttagtagagacaatgtttcaccatattggccaggctggtcttgaactcctgacctcaggtgatccacccacctcggcctcccaaagtgctgggattacaggcatgagccaccatgcccagccaactccattcattttactgaatccttatgttagacactgggagacacacaaagagagggttttatgcctaaggagcttatagtcaaggtgaaagagaagcatataaacaggattattgaagagtaccaggaccaaatgagtggtggggacataggatcccagggtaagcagaaattactgtgggtaaatggtcaggggacactttgcaaacgtggtgggagttgagctgggtcttcaaaattaggttaggtgtgggtaattggagcagagtggagagaggctgtcaggaagttcaaggaggagatagaggtggcattaaaaggcagagaagtgaggcatttgggatggctcaggtgaatggatggctttgacctaggatcacaggtgagtgcctgaagacagagctggcccgggttgtagaaaggtaggccaaggaggagcttgggtttgttttgtggaacctagagggctgaaaagtttttgataaggaaggtgatgtgataaaactgaaactttatagacatactagccatcctccttctttcctgaacacacgctagatccacccctcgtatctgagctcctgtctccaactctgccctttgtttctaggcgacaagcatactctgtgctattaattctcctttgattctcttttgtacccatttcctggttgcgagagcgggagctggatttttatcaaggctcagtagacataaagatgtataagtttctacccctaatacttggcttttagcaccctatgaatggtgcctattaatttcatttactcaggttaatatttaataaccttgaagtagttcacagggaacaattctgtctacaatttgaactataacacatcagatatttggtatcccacagatcgatttgctttctgacaaaaaaaaagaagttcttaaatggttttcttacttatcctcattacctacagatcttctaagttagaattttatttcttgtaaaatacagaaaaataacaattacaatgaaaacaatcaaatcggattaaatccacaggatttaaatacacactggactgtgagcttcatcacatttatttccaagtacaaatggtagtaattacttatgaattaattaataaatattgaaagaatgaacgataaccagagtcaacagccaaaatgcatatctccacgatgaacaaaggcatgaagattcatattgaactatgtttactgaattcccagtgtgtttcagacacaatattaagcactttcacatttactccttttatgacttaatgagtgttacaatctgatttcagacatgagtagcctgaggtacaaatagttaagtaatttacccaagaagtgacaaccagatgtgttaactcaaagcccaaggttctttgctaaagtttttaccaaatgtatctaatcataacaaatacctaagtgcttatgactataggttcccagacccctcctcagattctgactcagtagttgctggggttaggaatctatgccatatgtctccggtgattctgaggaccattccaagggtcttcagtccctgctgcccgttagaattactttagaagtgtttaaaattccagatgccttggccccccaccaaacaaatcaatgaaagtaagaaggaaatccctggacatcaatatttttaagctctctgggttattccaatgggcatccacagctgagaaccactaagttcggctctaccatgccaaaaataatcttgaatggatttcccagcctcctctccaccccttgcctttctccccatcaaaaagcagttctactacaatgtaagccagggaaaagtggagatgtttaagagaagacaggaataaaaggaggattaacaaaccatttgctttctgttcctgtgttaattcacttcggataatggcatccagctgcatctacgttgctttaaagatcatgattttattatttttatggctgtgtagtatttcatggtatatgtgtaccatattttatttattcaagccaccattggtgggcatctgggctgattgcatgtttttgctattgtgaataaagctgtgatgaacacatgggtgcatgtgtctttggtagaatgatttgttttcctttgggtatatacccaataatgggattgctgggttgaatgacagtactgtttgaagttgagaaatatccacctgctttccacagtggctgaactaatttacactccaccaacttatatggttgcgtgtgcatagacttgttctgaaaaagaagcaaggaaatatcagtgggtaactcagtggggtagtacggagggctgagggttgggctaacacaaagagattaaaatttcccctttatacctttgtgtatgttatgatttgtttaatattcaaatatcacttttttaaattaaaagacaacctcttttttttaaaaaaaagccatttgtcataatagtgtattgtattttctactaaatgagtagattatagttgctcttggcacaaggaggaatgggtaattatgtgagatgatggatatgttaatttattccactatagtaaccattttactatgtacaatacatgtgtcctagaacatcatgttgtatattttaaatatacataataaaatttatttttaaaaaaataagaaaaggtttgtgataagtgattagtggaaagaaatcaagagctttcaaaggtggtaggggatgagaagagcaaagagaaagatctgagattcatcatgcaagcaactgagcaactctaagtaaagttaaataaagctaatacatatgtaggcattttgctttcatataaagaacatattttgttcccatggaagttaacgcaatttttacctattcatatatttatccttcctagcaaggatcagaaatttctgtctttgtttcttcatcattcttacaagtgggagcaccagggcacactggggaaatgaagtcactttagacttcaggtgtggggcccggtgaggtcacctggtgttaagtctctacactggtgctcaggctctcttgctgctgctgctcctgttaggtgtgcatattttcttagactataaactgctcctctgctgtattaactacttcatagacaactgtaatccaatatttgacagaataggaacatggtaataccttgatgcgatctttcatccaaaataatttgagacaaactaattctgaagaaaatttatgttgtacttttatagtcacagggataacttttgttacatgccatatgcatatcgaatctgtttccaaaaggatgaaaacaaaggggaatttaagtgcagaaattatatgtatctatataatttgggggtgggaacatcttgaagttgctgattgctattaagcaaatgctgcattctttagcgaataagtagcatcaaaaagaaaaaccaatattctccctcccaccttctgcgcctgagccagcctttcacccttacttaatgaaatggagccgttgatgcctttaactcctctttcatttaatctcattaatgcagcctgttgggtttgaagttgtgggttaacgcaggggcagtcttcagacctccccagtgaaaagtgtcatatttttcagttagacttttaattgctacgtcaaaatgtgtgagaaccagctcaaaactaaagctgacgccactggtgagttttacattttcttctctcttctgacatttagctgtatggaccatcctccaggcaaggaagtaagcatttataagctctcagcaaaataaattgatagctaggtgtggggacaaaaaaatattttctgactcaggaatgtatataataaaacaagtcactcaggcttaattttacactggagaagatatttatatataaatactgtcatatcctggagtgaactaccaaatgcataagtttcaagattaaattcaagtcgttatccaccacattatactaacattaggttaatcatatgaacatccttctcacagttttgtagctttgattttggtcatcagcattgctatcatgttgattttatttttctaagtttaaaaaaaatctatttgatttatatatatgataccagatgctttatcatatgtaaaaaatatattttcaaacataatagctatttggttgaatgattattaactatgaggtgaattacatttgagtttttctcctaaattttttacaagttagtgcataattctctagacacacattatctcataatataggcaaatttggagcacttgttttaagaatatttcagggtaaaatgatttattgtaatttccttgctagtactagatagcaatgcacaacagttggaaatattaaaatgaaaattgatataattgtttcaaataatataaacactgcattgttcaaaaaagttcctgatcaaactaaactcctttaaatatataaactcagaatcacatctttccacaatgcttatagcttcctggtgcttgtatttgtaggaaaaaaagtagatactgtttctgtgcaattaccaatttcaaaatatatgcatttaaagattttattggtgaaataagctattaccagcagattgcatttctgacatcaatggagtctttaagtaactatccttgctactgacagatttactcaggatattgttgctgctgttgttcagaaattaataacactagacatactaacgtctatgtacttaatcctctttgggtctgaatcacaataagcaggggctcacaggtgaacagaaatgtttctttctcctctgattttgtgtttaaaaaacatgaagttaccttctactgtaaaattacataaaacatagtggccgattttaggggtttatgtgcacatacacacacacacacagacacacacacaattcactttttaaatgaactatatgaacaaatgtgtttttacattttgcaaagagaaccagatatttctctttctccacttaaattttagtggaattaaaatgaatatcccaaattaaagctgtagctttaaaaaaaaaaaagttcctacggtagaatacctggtgctaggcttagtaattcctagttttcagtaatgtctttctcgtctaatattcccaccacccgcccccccgcaaaaaaactctgcctctttagaagtaattcaaatgtctaaaaaatggaaaagaaattttttgtaccaattcaatttacatggtagcatcaaaatgcctttgctacaaattaacgtataagaaacacagctaacaaatggaacaaccgtaagtatctccattcaaatattagtatagatctccaaaagatcattagattgttctacttgtaaaaaagcaatttgaaagatggaaatttgttaaagtgaaatttgaaaattataatgttatttctcactactttttgtggcaattatacagagtgatgttgtctctgggaataagggacagtcgacatgttcatacaacaacttcaccagcttacataaacaccgaataaagctgttagggattaggtgcagcatgctggatctgatgcgctcaaatataagatatctcgggtcccataatatttaggattatgctggtaatctctttagagaaagtgtgcagtatcagcagaacaggcgcttcagtctttgagggagctattcactaattctacatttgttgggtgactaagcctccacctcagtcccacactgacaccgggcctttgtgacatttcgcttagggtgaaattataagagggagcttctagagtgacgttctaaattatcattttgctcctgaagcaatttctggtgtggtgtgcaaatgagaatactttcctttaaattctgtatgtctccttttcaaaaaggccacctgggtaaagacaaactaaactcaaacatgcctttctctaacctctaaagtcattcttatctctagagatgaaataagaactaaaattatctctttaattctataatttccttttatttcaagattcaattctgaagcaatggaggctaaattgcaaatttgctggaacataaattatataacaacgtaattttcagtgcagaaattgacaatatatttagtcattgtagcatcatctatgttcaaaaaaatcaaagctcttgtagataatccaatcacacacagacgcacacacacacacgcacacacacgcgcatgctataaatacctcacctatattctatagtttgtgtatgtaagtatttggggcatcagtggctaaaggcacattaaaaatcaaaagtgtctgcaaacgtgaaaaagggacaaataacaatacaggcaaattgttaagatgttatgaaccagttaaataaagttactattagattaggaagagaaatgttagtagaatactaacattctaatcttacatggacattgtctcagtgtggggtgatagtccactcacatacctcatgagaagatatgatgtcacttttattttaccaggtttcttttttctaaaacaaagacattgaaattggttctgatcactatattttagaacatagcctccttcttttctctgccgtcctggctcgtctctttttttaacacactcaagagatttagtctttctttgccaccaaccagaaaaagacatgttttacttattttcaaactctctgaacaagtgctgagaacttcaggaatggtctctactgcgtctatcaatgaacagaatgagaaacagcgtgtatgctttctacaccaaactttagtcacttgacttttgctcgtgtgtgtgtgtatatgtgtgtgtgtgtatattgtggggggtggaaggccaaaggttattgtcccaacctttgatttgtctgactccaagtagataatttaatggctttatatttatatttaacaagcatgcattgaatccttggtcttttcaagtattctggaaaataatgcaatataggaattagtgaataatacttggttgaactatatgaaattggcaatattaacattttttgcacaaaaaggtggcaatttcatatgattcgacttgatatatggttagtgactacagattaaggcatgattgataattctggaagcattctgctactagttacttttcatttaaccccattaactaagtctccaaaataaacaagtaatctggaattttgttcttgctattagattttcctttttcactcttcaaccaccaactttaagattgccctttcccattgctatttactacttgaaacttgctcactttccaagacctggctcaaaaggcacctcagcaccaaaccttcccagcttcccccagttcatattaacatcgtcttcttccaggtttatttagcagtcacctgtctgccctgcattcaggtgatgtaaacatgtgtggctgtagaattatagtattcattgtgaagacagaaacttggttttgcacataactgtgacctaaaataagtagatgttggctgagttgtttttcttattttttgagttggagtcttactctgtcgcccaggctggagtgcagtggcgcgatcttggctcactgcaacctctgcctcccaggttcaagcgattctcctgcctcagcctcctgagtagctgggattacaggtgtgcaccaccatgcccagctaatttttgtatttttagtagagacagggtttcaccatgttggtcaggctggtttcatactcctgacctcatgatctgcccacctcagcctcccaaagtgctggaattacaggagttggttgttcttagcatgaagggctgttgaattttgtcgaagaccttttctgcatctattgagataatcatgtggtttttgtctttggttctgtttatatgctggattacacttattgatttgtgtatgctgaaccagccttgcatcccagggatgaagccaacttgatcatggtggataagctttttgatgtgctgctggattcggtttgccagtattttattgaggatttttgcatcgatgttcgtcagggatattggtctaaaattctcttttttttgctgtgtctctgccaggctttggtatcaggatgatgctggcctcataaaatgagttagggaggatttcctctttttctattgattggagtagtttcagaaggaatggtaccagctcctttttgtacctctggtagaattcagctgtgaatccgtctggtcctggactttttttggttgggaggctattaattacggcctcaatttcagagcctgttattggtctattcaggaattcaacttcttcctggtttagtcttgggagggtgtatgtgtcgaggaatttatccatttcttctagatgttctagtttatttgcgtagaggtgtttatagtattctctgatggtagattgcatttctgtgggatcggtggtgatatccattttatcattttttattgtgtctatttgattcttctctcttttcttctttattagtcttgctagcagtctatcgattttgttgatcttttcaaaaaaaccagctcctggattcactgatttttttgaagggtttttttgtgtctctatttccttcagttctgctctgattttagttatttcttgccttctgctagcttttgaatgtgtttgctcttgcttctctagttcttttaattgtgatgttaggatgtcaattttagatctttcctgctttctcttgtgggcatttagtgctataaatttccctctacacactgctttaaatgtgtcctagagattctggtatgttgtgtctttgttctcattggtttcaaagaacatctttatttctgccttcatttcgttatgtacccagtagtcattcaggagcaggttgttcagtttccatgtagttgagcagtgggagttggttgttcttaaagtactccttacttgtctttgctggaccctctcagatgctcctcactatctccagcaaaagaagcacctctgtgcaattcacttttttgaaaaattaataaacatttttagcaccactttagatttacaaaataattgagcaaatagtacatagagttctgtgcactcaccaaccccccagacacaatttcctctattgttattttgcataagtatggcatacttgttacaattataaaccaatactgatatattattattaaccatttattctttgtgttgtactattctataggttttgacaaatctgtaatgatgtgtatctgtcattacagtattgtacagaatagtttcacttccctaacaattccctgcccttcaccccttcatcctcttcctccactccaaacccatggcaactaatgatttttttaattatctttgtagttttgccctttgaaaaatattatgtagctggaatcaaactgtcttgtttcactcagtaatatccatttaagtttccaacatatattttcgtggcttaatagctctttttatattgccaaataatatttcaaagcacaaatgtaccacagttggtttgtctgttcacctgttgaaggacatcttagttgtttccagttttgggtaattatgaatgaagttgccataaatatttgtgtgcacgttgtcatgtggacataagttttcagttcaatggtaaatacctaggcacacaattgttaggtggtttggtaagactatgggtagctttgtaagaaactgtcaaactgccttccaaagcgggtgtaccattttgcattcctagcagcaataagcaaacattccatttgttctgtatcctctccagcatttggtattatcagttttttaagtaggtttatagtggcacctcattgcttttaatttgcaattccttaatgacatatgatattcagcatcttttcatatgcttattttccattcataaatcttctttggttaagtgtctattcagatattttgccactttttgaattttaagagcactttgtatattttggattcaagtactttattacatacatgtttcacaatattttctctcagtcctgacgtctctccattctcttaatgcaatttgatttttaacatagaaaagttgtatttttttttcattttctgaaacgatatattttgctctttttgaattattctccaaggaataaactctgcctggtcattctaaattatctctgggacctggttttgtggtgtgccccatccctgtccttcagtgaaggtgatgctgtgtaatcacgagcttcctgttgaaggtttaaactaaatgtaggctagaaaaaggggtttagaaaaaaaataaggaactaaagagagacgagttttatttactgaagcaaataattctgtttcttcttttcataactggataaaatgagctatcaagtagagtacatgtcttcatatagagagcgagaaataaataaagttctcttcacagagaggagaggtttgggaatggagatcctgaggggtaaattatagaatgtattgctttcctcttttttagaacctctgaaatgttatcgtgtatatgaatcacagagatgctgttacaacccagattttttttttttttttttttttttttgagacagagtctcggtctgtcgcccaggccggagtgcagtgatgcgatctcagctcactgcaacctccacctcccgagttcaagcgattctcctgccctagcctcccgagtagctgggactacaggtgcgcaccaccacacccagctaatttttgtatttttagtagagacagggtttcaccatgttggccaggatggtctcgatctcttaacctggtaatccacccgcctcagcctcccaacatgctgggattacaggcatgagccaccgtgcccagccacaacccagattcttataggcccagggtaggagcaaaatgctgcatgtctatcaggcacccagggaaggccaatgctactggtcagggaccacactttgagtcagcaagtctcaggacagcacacaacagatgagaggaatgccataaatatccatcatgaccattgaactccgtgttaactaatctgcctcaatgagacaggacagcttttcacatgttggatttccagaactaccgtgaatagccaaaatgagttcattgctggtttcaaaaaactgcttgatctcccttacctttatcaaaagaagtaccattcaatttttaaaatagaaaaactgtatggtttttaactgtttcaagaaagcctttgtcagtactgagtatccaaggagcaagctagtagccacaaccgcaagagtgagtgtacagaagagggaggtgccattaccaaacattgctagaatgcggagaaaatgtgggtgcaggtaacaatcattaaatctgcaaaggaagcctggtacactgggtgttaattacagtaacgcaagatatttctggaatatgctgtgttctcttttttctgccttgtcaattagtggccagagttttctctctctttttttttttttattttcttctaatctttcaattatcctactgcctttataatccaaaggaaatgcctaaaaggcaaaagcagagaccacttttccagaatccagggaaatttaaaattccatcagttcttacagttgctaaaactgtggctacctggacatcacagaacagtgcttctcaaactcgaatgctagcctcgggatctcattctaaagcaaattctgattcagctggtcttgagtgagtcgtggtagtctgcagttttaccatgatccccggagatgccaatgccactgttctgtggaccacaccttgagtggtcgaaaagacattcactcaacctgaataacgtcgggtcccacgcacaagttatcccattataattaaaatgttgacaggaaaagatgaatttaatgggaattaattcctaaagtatgagttcaaagccgctacaacttataaagtgatttactttgtttacaaggggaatatttaacttaccagtattttctcttaatgattatactaattgctgtcgttatttgttggtctcatgttctgttgtttcagtcctctggggagtgagcaaacacttcaggggtaaatgttcatatgtaagataaatcagcctctattgtgataatcctacacatgatgcctttgaaaatgatcttcttttgtcattatcatatggtagtaatttttttcttaatctaactttcgatgataaatggtatagggaattaaaataatataaagccaaatgtatctttaagttatttaggagctatcagccattggaacagaaaactcacacagcccaccacccagagtattacagagaagaccccagatgctgatagacgtgagagtgttatagtagaaattagagtgcactgaatttcatgcaccatattgtatatttagacaggaagctgatgttgagatgcactctgcactgatgagatacacatgggcacaatccaataacaggaatcttttagaatcaccaccttctagcatggtatagcggccgaagttcaagacttttatatttgtcctctgaggatcttatttttccaagatcctatcccatcccaaccttggggctactgtctgatgaatcacagttacagtggaactggttcccagagatacctgctgcatcacagacctttggttttgttattaggtgacatcagaatattttgtacctaatagagatagatacttatcagtctgccagtgagagagggaaagagtacaaacagagatttttaacttggatttgtcgcagatggtagatgagatacaatttgggtagatgagatacaacttgggctactgagaccatctgcaaaaggatttttaaccaaaatagtcatctttattggaaatttctacatgtgtaaattgtgctttactcagacattaagagatttaattgcactgcccacttttagcataactgtacaattatgggaaacagaagctaacaggtgaatccaatgtcctagaatgtagtctgtgtctaggaatacagtgtctggtgtccaggaatcatagccgggtcagatgtccttaaggcaaaaaaaaaagaaagagagcagaaaacaaagatgctacaagtatagccccaaaccaaaagtgagaaaacatagagagaattcctggtgactctttaaaatgttcagatctggcctgtccctgggtttttccaccttcgcaggtgatttatgtggtagagaaaattcctagctaataacttaactcatttaattcccaatgggtgtctcatcatatacaagaatcacttgggggccttttccaaaatatatatcccccacaatctctggttcattctctttatcccaaatatgaaaaatcagacccagcatggtggctcatgcctgtaattccagccctttgggagggcaaggcaagcggatcacttggggccagaagttagagaccagcctggacaacatagcaagagtctgtccctacaaaaaatgtaaaaattagccaggcatggtggtgcacacccacagtcccagatactcaggaggctgagatgggagtatcccctgagtctgggggtttgaggctgcagtgagctacaataacactgcactccagcctagatgacaaagtgagaccctgtctcaaaaaacattaatattgcttattgcctcttttataagaaggagtatatcaaatctcgtggttgtactgaaataaataaaacacttagaaccactactttaaggagttataaaaattctcctttagacaccatagaaaacaaagtatgatcttgtccctctcttcaatggatttaaaatgcccagaatataggaatggccaagttgaattgtaagagttggaagggtgagaattgagagccataagaacaaacacagtaaaaatgttacctccaaccagaacgtacgtgaaaagtctgttattattaccattcttaatgtatgcttttaagagttaaggtattttgttgaatcaatgtgatgcattttctagttaactcattagctggattagtttatataatcttaacacctgctgttactagcggaggttctgagggggcagaactaaaaatgtgtgtgttttgacatgcaggaagaagtgaaaacatggtagttttgtgcaaagttgtggcagggaactctaaacaaagaaggggttttcagggggagcttgggggagagaattgccatcttcaaagagggagagaaattttgtttattccataattgttgaataggatctgcctgccagatcactagatagtaaactaattgtacttcatcatttgttctaatataaagtaaagcagcaaattattttaaatctttcatgacactctttgacactgtcataatattgtttcaaaaaagataaaattatatagcattgattttataaacaaaaatattaattaatacataacattttaactatagtctccacaaaggattaccaatagaaaaatataagtgaaatgaatatctaagaaattgaaaaaatgaaaaatgaataaacctcactcaagccatctctcagggcatttcagttcctctaagtttgtctcttggggaatactattgttgaataaatccatgagtcaagcaaaatacaaaggtcaaactctttcctcagtttccttctataaccttcattgtaacagctggtgaggtccaaacagccaaatcctcccaagatgttcagttggaaaccgtagtcaacagcatgtcactagatctgtattcactgcaagacaattccacaagagcctatgcctgttatagtggcaagatattgagaaatggcaggcattggagaaataatgggatttgttgttctaatcagtttgtgaaatgctgtctggaagatgtgttttataaaacacatagtatagaccgggcatggtggctcacacctgtaatcccagcactttgggaggccaaagcaggctgatcacaaagtcaggagatcgagaccatcctggccaacatggtgaaaccccgtctctactaaaaatacaaaaattagctgggcatggtggcacacaccggtagtcccagctgctggggaggctgaggtgggagaatcgcttgagcaggggaggcggaggttgcagtgagctgagatcgcgccactccactccagcctggcaacagagcaagactccatctcaaaaaaaaaaaaaaaagtataaactataaagctgcagctcagaagcagtttatttccttacatgagagaaaatgaaaagaattagtattttaaatgacttaaatttacctttacctatcataaacctcggatgatttattatattgcaataagttaaaatggtcacagatttccaaactgataacccctttccacacacagctatacacatataccattttaagtgacttatttctctttaaaaatgttgttaagatgtttatagttcttcaggattacatgttgagtctggattataaatatgtataaatatgcagatgctctatcaaatgttccttatctcatttgtatttccaaagttgtgtaagataacctctgtggctttcaaaaacatcttgtcacaccccagggggcaaattatctctattttcatttcctttaaagttagatcattttataattaagaacttatagaagcagattctccccacgtgtaagctactccctggggagtaatttatgcaaagagaacctttgacttaatattatataagctaaaaactatacaatggataactgagatttttagtcaattttgtaatcgttataaacaatccaacatttgaaaggttattgctaaaaaaaaaaaccatagtacaaatgacttgctgtgtcatttattagattatttttaaatgaaaagatctttgataaaggaataataatgtggcttgtcatattttgtgtccaaaagttttagaaaaccagttaacaataatgattgatgtgatgatgatgataatgaagactaacatttcctagctcttcagcattttacaaggtgcttctacataaaatatctgtttgaacctcacaaatctatgaagtttgtcagttaagctttataaactagaaagcataagatcagatattttatcttggccgtggctccaatcattaacagactaaggactggagtccagaaggacagaatagaataacatcaaatctcatatttttctcctatcacaaaatcttgaaaacaaatactagctcgtgtaatctaaaagctaaaataaaaagaaatgaatagaaatgtatacttagtctcataagtattttagaggtgactttgtctcttctgtttttttatcattagctctttagctggagctattggagtaatataggaatttaaaactgtaatcttattttgtctgtgtggaagtcagagaatggttactgaatgaagtatcaggatatttagctaatttctggttgtcaattcccaaatcacctcaaaagcagaacttaacctggatcctcaattttttcacatgaaaaataggcacacaacactgaggttttttgcttacaaagatgatttgaaatttctgtgaaatatttacttttttaaaaattcaatgtactgccctaaagctaagtattgtcttttttaaaaaatgtaaaataagaaaaagagggcaatgtcttgcatttatttgttttgtatatgcaagagtgagaaactgtagaaaagcatccaagtggcagattgatatacaacgcattttgaagtatattttgcataattattttaaattgtaagaggaaatagcagatcttctagtgtgtataattttaacaactcttagaatactatcagacataggaatcactacattctaaataaattttgtctcatggatccatccataacctgtgtgctgattatttaaaatcatcttaccaagaggttctatatacaggactttacaccaaattgcacacatagaaaatagaaatcccatgccccaccatattccaccaaagtaactgccttaccaacaaccccatttctgtccaacttactaccttatctcagcctcttggctaggaaactaggagtcacctttgactcttcgtttccatgtcggttcccttttttaatcatataatctagcttctgcctttgaaccatctttctatttacatcttcctctccatttatcctaccacttatgtaataagccatgtttttatctcctaacacccaagttggaagtaatctttagttggtcttctgcttgtttatgggtagcctgccaaactcacctttctaaggtgagttactttgatcgtttctttaccctgttcacttcgttgattccttatggccagtgagatcagatgaaaacctctctgcctaaccccaggaactccataatctggcatcaaccctctagccaatcatctgacctaaatttacattatagccaagttattgtctcaatgatcacaatccacaatcatcccaggcctccaatcttttttcatttcccttctgccaacagaaatgccctttgcctttcccttcggcctaattaaatcctgcacgatcttcagaatcaacaaaaatgccttcatctccaatgaaactatttcagtttgtattgaattcatatttggtaccctcataatttatcctgatttctccatgtattaatttcattaattagattattagcatcattagcatatgttatcctccatcaatatcctttattattttagagaacatatacagcatgctcagtaaatattggactgatttattattgacatttttgtaagtaaacatccagccacacaatgtataaagctaccatgcactgctccctcccagagttttgctttatttatgtacttattttaaatatcactgaggtaaggccatgtgaaagatctcagtaacttaatgtttcaagtgcaaaataagaaaagaaaagccgtgggttcaaaggctttttgagtcccactacttttaaggtcaaattcacaaaggagaaaacagtgaatgcaagactttggaaaactggtttctggttgtatttttttagtttgagaaaaacgaagcaaactgtggcagagaaatgtactttgacttagaagaagcttaggacagccatgcaaatactaatggatgactcccacaccaccgctcacaccccagtattttcaaatacaaacatcaaggcagagatagatggggagagagataggaagagtgaaaggagaaagaaaacttctgtatgctcaaaatgtctgttttctcctttcagcacaaattgaagtgataccatgcaaaatttgtggcgataagtcctctgggatccactacggagtcatcacatgtgaaggctgcaaggtatgggactttcatacagcacggttctgtatttgcctcaggcatctgtgtacctcacaagatgcggtgacacgtttttaaggaaggctggctaaaggatccttctgcctgctgctgacattcaggaattcttgcgtggtgggtgggagggttgattttctggtcttttgccttttacctttttgttattgtctaactggtcagcagctctttaaaaatggatgcgtatttaaaaccttgggttattcacatttacagagatacaaacactgactcttgctgttttagcagtattgtctccagtaaattccaaggcacttattactatatgaaaaaactaaaggttaaaataaagattataaactaataggtatatatttaactttctgcttgagaaagaggaagtcaaggtaacagctacaatatgcatatggccatcctttattctcaagttacaggaaaaaaaaaaaaagaaaagaaaagaaaactggaagcatggtatgttagaagccgaaaagattaactctaaatcgactaaaattcacctgcccccacccacctcttcattttccgatgaggtcctgaggtataaacaagattatgtcatctgatcaacatcattgattcagacagtaaagaacagagcatggccaaaaacatggggtttttcagtctcaatccagtgttccacttccagacagattccactcatccttcccgtggcaaactaattactgtgagcaagctgctttcttaaataaagagctggaggaatagcagtaaacgtagacttaatctgaaataagagaatgttgaaatttaacagtaagttttaataatgaatccttagaaggaaagaaagtgagtgtgagagacataatagccaggggaaatcaaaacagttctatagctaacgctaaaggaccatgtgtaaccagaacaaataaaatgcagccacagtctgggaggaaaaggtaatatgctggtaaagttattggcaagagcaattatatttttgatcaaagaagcaagcaaagtgaattattcttttaaggccagtaaactgaaggaagtgtagtacagtcatagagtctaagatctaatcttaatcttaaacaggatttcaaatataaacaaggcaaaacacactgtaactgtcaaatactggtactgtgtgataaattgacaatgccttcctaatggtctcaaaaaggcatgagtcttggaattaaaactggagtgaagaaaagaaaaggaaataagtaagaataaagtgggagagggaagaagaaggagcatgatattaacgtactaacctgtcaacacactgctctactttaaagatgattagtgataatctatttgtgaatatcgtgagatgttcttcacattctgttcctctgcagatctataattaagaattccatgttgtccactttaatgcaatttttcaactcatcaagaataaacaagaaaacaaaattatgtcagcaattttttaccctccttgaataagttattacttcctctaggcagatagacaaatagttttcttcataaacagtaatagtttaggagtcagaatcctctccattgaaagtatttctaccattctattggcttgttatgcaatcttgagagctctggtttacataatatctactaaaactgatttttagatcaatatcaaaatggagatgtttggcatttgattgtataagctctatttgaaaaatgtgtgatttcaaaagatggggatatgttcaagttaaaaagcaaaatattttaaacagtaatttccaaaaaatttaactagtgcacaaatataacccagcaagccaatagccaagaacaagtgtcatcttttctatttaaaggaagaatccacaatcaaagaaattatgctgttattatgaagcatactctgaggttttagtcaaaatggcactgtacaccacactatttttttaaattcatggaaaaaacccacatttgtaaatatgctacttttttctgcaaatacagaacttaaaaattctcttcagaatttgatgccaatgtcagcacattcagtatcaacctctgagttttcataatactgttttcaagtcaacataaacaacccattctaaataacatcaattcagcttgtgcacttattcaaatttctattcattcaataaaatttggaacgcaatccctttttcatgccaaaaacctcatttgcaataatgagcaacagataagcaagaaacgagtcgtaattaatgtcaaattggtcttaaattagggctgtagctgtgacttcagagaagtcttttctgtcctgtcaactcttttgctaagtagcactagagtatccaaagataaaaaccacacaattctgtcttaaaatgtaaatttcaagtcatctttaatcaagactgatgggctgaggttatgcttcctgacagttttcatggtatataaagtacatcatttcaatccctgggagcttacgtttgatctccattctaagatgctccatgaattcagtcaaactggacagtcagaagtctcattctgcaatcactggtttattaaataaggaatgcacttggatctatagggatgaaactagtccctgttgaatggctaagccagttgggactctctctctctctgaggagatgctcggccacacctccgtgtctgagtttcctcacaggttgatcaagctctcttcaccagtgccacgctgagccatattggagctgaagacaaaaggaaaatgaataacacagatcctttctttaaactattgggtatttttgcattaatgtagatttttaacacattgtgttaaaatattgtattttctaattacaaaaattttaggcgacctttaaatgttgtgggcaaggtgtttgcctcactaggcgtacctagccctggccctgcttgttcatcctgtagatagttgaggaaacacagaagctgtttgagggaagtcaggggatctattccaggcttctctgcaagataggcattgaatctaccattcctgaacttttctagactttctccatccaaaagatgatgctatgggatatctcttcccaaaatttctcttagaaagcttaatgtagaccatgattttgctcatgacacattgcacttttccttttttgctctagacaattcaaaagcaaagagtaattagggaaatcgattacatgagtcagtgaatggacgaatgataacttatctatctctggagaaaatgcttattttccccaatagagttttctataagacaactaaggagaaatcttttaaaaatcaactcagctgtggatttatttagacaagcagtgtatggtcactggcagttcattttttacctgatgaacccaaatgtacttgcatgaagacatcttacactgagtagcctgaggctaagtagagaccattcattcagtttttacttagtactttttgttgttagacagcttatatataatattttcttttttcaatggtgtggttgattattaaaaacaactttccagacccggtcacggtggcacacacctgtagtcccagctatagtctgaggcaggaggatcacttgagtctaggagtttgaggccacagtacactatgatcctgcctgcaaatagccactgaactctagcgtgaacagcatagcaagacacctcaaaaagttaaaaaaaaaaaaaagacacttttcagctgcattcgagccaaattcaaaaattttatggtggggaaaacacatcttagaaactaagaaaacagtagtgcatactcctcagtgttgctttttcttaccaatacttcaagttcctcaccaccacagcacttgacacaaacctgtgtgatttttcccatcaagttctgtcatgtttggtttagtaatctcctttgctactccttccccactgctctttgcggagcagaaacttctgtttatttctgcatagaacagcacagctgcaaatgtctttagcaaacattgattcaaggaatgaatgaatgaatgaatgggtaaatgaatgataccctcatatctttgcagatagcatctattttccccagcagaaatatctgcaagccatacaagaagaggtatccaaagagctttaaaaattaaactcagttatgttcactgcagaaaatgtagcaaatgtatacattaatgttctctgtttcccttcttataaatctgtttccctccccttctctttttccctcaagggattctttaggaggagccagcagaacaatgcttcttattcctgcccaaggcagagaaactgtttaattgacagaacgaacagaaaccgttgccaacactgccgactgcagaagtgtcttgccctaggaatgtcaagagatggtaagacattaccttcctgtttcttacttaagccctttcaaatggatgctttgctggagtctatttaagctgctggaagaattctagatgagggaattggggataagaagaaaagaaaatcactgtgctgctagtgcattacaaggaaaagtaagaatatacaaaaatagagcattgcctatgaaataagaaagcaaagactttaccgtagctcagggagcaacttgtgctaactaggtttagtgcaagccacataggcctaggttgaaggtgaccatctgtctaggtttgcctgcaaatgagggatttcctgggacatgagactttcagagataataccggaaagtcctaagcaaaccaggaccacatctgagtatgttcactgggcaggtctgactgggcttgcttactgtgtggagacactaaggaattgcatatgcctctatgggaagcctggaagtcctgctggctggtcatagctacccagaggaggaattggactatctgagcccataatgaagtttccaaaggctagagcgaagtccaagtcttagaaaggctgtgtaggtgatgtcttcctcagaatgtcataccttctacactccaccttgacgcccacccatgctgaatggcttggcttcccaagggaacatcttagagtaatgaaagaggacaaataaactcaaacaagatgaacgaagaatttcacctagctttgttttccgttttcattcattcatccaaagtaattctttccctgctgacattggacacatcacccttgtatcatacagtgagtggccctgaatcctggggccatttctgtcttgttcccactaaaacatcaggctctgcttaaaagcacacacctaaatgtttgttgaataaactatggaaatcccttctacctagagcctaagacatagacaatgccctgacactttctgtctttatgtcagtcagtgtggattctgggcctctggtcgcactccctctagtgaaattcaaggctgtatagacacacacaaaacaagaaacttccaaattttaaagaaatgtgaataattggcatgcatttagtataaagggattttgtgagtgattagattctttaccttttctctaattcccaatccatctaaacttgtcctgcagaaaagtacacctataaaacaaatttgaccaaaaaaaaaaaaaaaacagaatctgacctgaaacccttcagtttataggtagcttccaaagctacagagacgaggtttccaaaatttttctattaactgatttttttttgttttacttgttttacttggctcactaaccagatatatttactcctaagataaatttatagcaatgggtacttctgtataatcaaggcaaataaattaagagagaggattaagtagtttttgatacttatttcgtgtaattatatgggaatctgagttgatgactttgcacttcatttctaccatgtggcagtaggtagcactttaattcgcagtgtccgaaaagctccattaataattgtgcaaagagataagccatagggtatttgattttgttacttcttcctacaataaaaggaagtatctttctggaagagcaggtctaagtctgtgctggtgaacagaatcatgggcaagagatgaatatatgatccaaggcagattcaacagatttagtgacatcagcccacaaaatttagacggtctgaatcccgtaacataaaagaaatgtgtcgggaggatgggagggtcatttaacagagccacaatttattctcaagaaggaaggaattcattgcagcacataaacctctatgcaaataagagcaatatagtgtctaaggacactgaggattaagaataatgattcatttcaactttaggtccagagacaatcctgaggctgccggggacatcttcaaaaatgcctcctaagcacatcttatgtgaaatttatcatgaggagaaatggtcacgggggtgtgggtggggtggggaatctggagaagaaggggctgtagcagaagagaaaacaaatgattctctctaagagaaaaagctgcctcttcactatatcatacagagaaagtttggtctgaaccttgattagaaagggtgccttatgccaagtaaattatgctaataccagggaagctgaataggttttacctcctattgataagtattgcctagtatgtagtattgaatgattcaaaagccctgaaattatggttgattacctatgtctagtaaaggctcaagaatgaaagacacggttatttctgagtcagaagaatccctaccttcttctgattcagcaagtattcttaaagtgctctagaaattgtaccaatagccaaagtgaggtgccctcatacctaactgctttctacagccccctacttccctcagagataaagtggcatcttcattttggtatatgcatttgctctctgtcaattaggctccaagaatgtttatttcatcatacctggctgcttaatgtggccactaggaaatagcttaaaataactgttgaaaacactggattttcattctctcctgaaatttcactgctatatcggtttattagctatcgaatatatcagaagccatcaaatttatcaataatgaatttgttcaaatttagcttaaacgaagaatcaaaaatcaaatccacttggaaacacatacgtgtgtctttatgtgtataaaaaggtgaagacatgtgtgcatgtgtgtgtctgtgtgtgtgtgtgaattggcagcatgcataagcctactgaatcttctccatcattttattttttttcttttacctacaccctttacaaaggaatcttcaggataactgtttccaattgtgctactataaattgatactcactagtatatgtcctcccaagtggcatgtctctacaaaaagacagaagttgccctaaaaggacaggtttcacagattaagcttctatccagaactacattgcccaatccacatgtcactatttaaataatttaaatttaaatgaatttaaattaaataaaatttcaaattcagttcttcagtcacactagctatatttctagtgttcattaggcacatgcagcttgcagctaccatattggaaagcaaagagaacatttcaacatcacaaggagttctgtcggagaaaaagaggaaggagaagagagagattttaaaataatgaataggcttgggtagattgaatcagacttctaatacaaagcctacagcactaaaaaaagggtggcagaagaggcacatctctgaagctgaaaagagttaaattgagaccagtttcattggtaagcagcaaaatgtaaatatagagaactttacaaccgaaggtagtagataaaatgattttggaaatttatagaaagtcatagattgatagtcagttgggctctcttgaaaccaaaaacacatgtccatgtgctatgttaatagaaatctttgaaggagctatgactttactttttagttatatccaaaacttctattccatttagaataccacaattcaaataaatataaaatgatttccgatactttcacattaaattgttctttagtattatgggatcaaaatgagggttaagagcatatcatgagcaaataccacatcattgaatatttataagcacttgcaatgtatacagaattgtgctggtttctttaagaggtagcagtttaacaaaaggctgtctttatactcaagtgaatgtcattaacagaataactcaagtttgagaggggcagacagttaaaatatatgccagtctgattaatatgtagtgataagaagaatgctaatatctgaaatattaacatggcctttgttaaaatagttctatgcatacaacaaatgtatttacaaacagtgaaaatgaattatgtcaagaaagtcagtaggtttatttttgccatgtactgtaatttttttcccaaatttgtcaccactgttattgcaagaagaggcacaaaactgaaacactggctcatcaatgtttctgaaataaatggaaaattaattatagaatagtattacagtcattgtcagtgaagtctttgatttaggatcatacctgaaataactctaaaatgtagtagttttaagttgtttctttggaaatatttcagttgctcagtgacctgataagtcaattttgtaaaaaatgcagagcttttctttgttgagtttttagatgttacccatggcagaggtcttggcagcatactcttttgacattgttagcttgtgattatgatgtctgtggttaacagcagatttctgtgtccatcagctgcaggtcagttctatagctctgctgattgtagatggccttgcctgggatgaccaaggaggtctggctctgcttcacatatcccccagcaagcttatcctctagcaagatagctcaggcatgtccttgtcatggtgaggtgcacaatcacacgagcctttttcaagtctctgctgtgtcacatttgtcaatattccattggtccacagtaagtcacatgaccctgggcaggatgcctgcaaagaatgaaagagcactgcaaactgacatggggaagggcatggaaagaaatagacaagaggaatcagggtcattaatgcaatcagtcatctacaaagtatatttcacctaaatacagagtatacagaaatctaaagcaaggattaaatggaaaagggttttaaaaaaaaaaaacacaaatttatgtttttgtgttggaagagtttcttattctcaatctttaattcctataaattttgaaccaataaaatgcaaaactattctactaaaataagtcggaaagtagatctaccctagctaaaacaaaaatcttgatctatagcaatggatacaaaccttgtattcacttccataactctacaacaaagagctattctgaacctacccaaatgcaaagggcagaagggcagcaaataaagagctctactttcctgggggagaaggggaagttctttctgaatcaatatttatagttgtttattttttccctatacaaaaggtgtttttcccctagagaataatttgtaataaattggttagaaagatgtaatataaagatacagaggaagcttgccctacaagttactgtagaattcggtacatagacaaactggaaatgtcactgcaattagtaagcaaataaatttgtctatgagaatcagaatctaataaaggtagtgtctctacaaacaaagttaaaaacaaccatctaaataattcaagaccatgtaaaaccaaccactaagatggaaaggggagtttagtctgaatgagtcagattgtttgtcttcacacagtaaaaattactagataattatcactttgttttcctacttaggcagtatcagaaagccagaatgtaggggttggttgcttggttggtttgttgtgttttgttttgttttttgagacagagtctccctctgtcacccaggctggagtacagtggctcagtctcggctcactgcaatttctgcctcctgggttcaagggattctcctgcctcagcctcccgagtagctgggaagacaaagcacacaccaccacgcccacaagcacataccaccatactcggctaattctgtgtgtgtgtgtgtgtgtgtgtgtatttttagtagagacagggtttcaccacgttagccaggatgatctcgatctcctgacctcgtgatctgcccgccttggcctcccaaagtgctgggattacaggtgcaagccaccgcacccagccctagaatgtaggtttttaagaaggattaagaagatacagaaagagtttggcttcttcaaacccagccctcacatccacaatccagcaggcaagaaggaggaaaacatgccccaatacccccaagtgaatgcgacacttgcatttacttccccttaatcagaacttaatcacctgcacatacctgccagtgagggggcttaggaattacggtctccattctgatcagcctatgctcagataaatatggtagctctgtacccaatgggaaaagaaaatgaattttggaagaatattggaggaggagggtgaatggcagctctttcagactgtgggaatctcttctgtgttccctttgtgctagagagttcttaagcacttcaccatttagatattctcagaagagcatcaaccctcatgattgaatccaggaactgagcctttttctaaactccatttccttctttctccattctctgagctcctaacaccaagaggtggtgggaataccgtcacaaaagaacagcaaacagaaactcagggaggagcctccaagtttgtggtagcccccactattaacatgagctgaacaatgcttgataattcaaacaaggtaggcctgtgactcaggatgttcacatcctaaaaaggcagttgacaacctgtgaggagaaatgtcaatattcacaacagttcaggaggttaaatatcttaagaaacaacacactgaaatgaaagcaccttgatattaccctgtgactacttgcagcacttcttccttctttttcctcagactgctgagaatattgccagaagagataggaaaaataaaacttgggagtggtagaatgagaaaagatagttactgttttggtcacttgctaggcattggatgccccaaattgctattttccaaagaatcttatcatttgatcccaaaagccaactgaaggcaaatgatgccatcacttaaaattatgtttatcacccagccccatgccttcggtcttacccaacacactatttagaaaatcggcctggccgggtgcagtggctcacatctgtaatcccagcactttgagaggccgagacaggaggctcacttgaggccaggagttcaagaccagcctgggcaatatagcaaggccccggctctacaaaaattaaaaaaaaaaaaaatagctggacctggcggcatgcacctgcagtcctagctactcaggaggccaaggtgggaggattgcttgagcccaggagcccaaggtttcagtgagctatgatcatgccactgcactccagcctgggtgacagagcaagaccctgtctcttaaagaaaattattataaaaaataaaaagaaatttgagaaagaaaacagaaaatagatttgaaagtgaaatactagggtccaatctggcaatctagtaatcctaaagattaagagaaaagttagttatgagtgttggttaacattttaatagcgggtactattgctaatttggtattttggttttttgcatttttttccacaggtaagaaaaaaagaggaaaacatgctttctaacttcatggcaatgagaaatacatacataagtttttatatttcttcctggcttagatttatttctcactgtgggcataaaccaggacaggtaccctctgaatataacctttccccagatgtggagtgcaaatgaatgggttcttaagttatggtgctagacatttgtgcatttgaagttgaagggacaaccatcccatgacccgttgtacctgaggtggttaacgcgaatgataaccacaagtgctgttttctgcttttctctccaacccagctgtgaagtttgggaggatgtccaagaagcaaagggacagcctgtatgctgaggtgcagaagcaccagcagcggctgcaggaacagcggcagcagcagagtggggaggcagaagcccttgccagggtgtacagcagcagcattagcaacggcctgagcaacctgaacaacgagaccagcggcacttatgccaacgggcacgtcattgacctgcccaagtctgagggttattacaacgtcgattccggtcagccgtcccctgatcagtcaggacttgacatgactggaatcaaacagataaagcaagaacctatctatgacctcacatccgtacccaacttgtttacctatagctctttcaacaatgggcagttagcaccagggataaccatgactgaaatcggtaagtggaagtctcctcccagtggctttttttgagattttgctttgaatttaccttggtcctatttagtatggtaattttcttaagacttaaattgaattacttggattcacagcttctactgagaaaacaaattgatttttaaatatattctaataaatgtcatttttccccaccccataaaagtttatttcaagcaaaggaagaaagaagaaattataaatagaaagatgctatctgtaaagaacagatgctatctgttgaatttgggttctcactgaaggaaaaatgttattggtataaacagggaaatttcggcatgtattcaaagttgatgctattcaaagtgaaattgctgaaggatatagaaacagtgtggaataaccaaacgaacaggggcccaactcttcctctaagataaatggggacaaactttaagcaaacagtatctcagcttccttcttggtgaagtcagggcgatagaccagaagaccgccaaggctcttggaaatctgaattcaagaattccatataggattctgaattacagcaatgaaaagagtgtagtctggaatcttatagaacatgagagcaacaaataagctagtcataggcatgattgcatcagaaagctgatcctctttccttcgattcctaaggagcgatcttcaagagtgccctgccttaggcaagctctcttctgacccactgcaactttgttttactccatcgaactcaggagtctattaaatgtttaaccagttaatctcatcaactaactgccataaaaatattgaagtaggtttaacacattactctcctgggtaacagggttgcatgttaacagtaggctagaagagctaagcaaacagtggcgatgtgatcccaggcttcactgcaatatttagtgtactggagaaagcaggctagagctcaggaaccttcaagggctctttacatttcttcaagggctctgcccaaagaggtggcagagcagagcaattaagaactgtgctacctgagtttaaatcctggctctttggcttactatttaagctggagcaagtttctcaatcccagttccttcatctttacaagggggaaagcattagcttgtagctcacagggacattgtaaagcttaaatgagttaatacgtgtaaaccatagcaaggtttggcactcaggaagtgctcaataactcttagctattactgttttatgctacatgctcggtcaccttctctgtctaacctgcaaataggagcctaaagcctacaagtgttttaaattaagctgctgtgaacacataatgaaatacatggccatattcttggctacttgtaccatctggttgaggaagaagcaatgttacacagttataaacctgaagcgttatttctcccttttagcaatgcagcatgtgacagtgagtaacattgttgacaaagcacctgtaatgactttcacagctgagagacacacaaaaaaagaaacatcaactaaaataacaaaaatagttaattattactgtcatccttaactgtttttactatatcatgggcccttcacacgtttacttttcacgaacatcttaaaagataaattaaaatagtatttctgttatacagatgctgaaaccgaagcttagagatgtctcataacttcccagagtcctataattactaaatgacagagccagggttcacctcagacagtctgattccagagtccctccactcctctgttaacctgctacctgccatgggtctcaattcatagactgcattgtcaactaatagggacggtcatttaaaatagtcattcaaacttttcaagagggaaaaggcaccttcctttgcatttatactacttaatatctaagttcctgagtctactattaatttgagagatatgtttgaatccttataaaacaaaaactcacaacagtggagcaatcttctggcctatattcaaaaggggagtcttctaagaattaataaatcataacttgtttatgatttagcaaccacattaaatattatggaaagagaactacagccaaaccatcaggtctgcgttaccctgaacaagtcatttttcctctctgaccctgagtctattctgtgaactgacagaactggactagagaatctcaaaatttatccagacactctgcacagacattgacatgcaaaataaactcgcgtatattttactcaattatttcaagatacctctagtctttagatatctttaaatatgtttcaaattttggaggatttttttcatcagacatttagggatgcaaatgggctgtcctgccagtgctctcaaatttaggagacccctaagcctaaatagtggtttggttcacatttcattaaaacagcaatgccacctagtggacacaaacccattctatgactgttgaatctaggtaccaatgaagagccacaatagtataatatactgtctttcctgcaccgtccaaaacattgacactcatttcactaaaatattaaatccttgacagtatcactgggcaggaaggcatctgtggtatagtgtggtgactaagaactctgcttctggagtcaaagtgcctgcatttaaaacccaattgtgccttttcccttaaacaatttacttaacttctctgagtctcagttgttaacccaggccaataatagtctttatctgtgtgtgtggattaagtgagttaatatttatgagttcttagtacagtacctatcatatgtaagcaccattattattaataatataactgttattttaattgactattagtatcactggttattgcagataatataattaccttttatcgagcacctacactgtgatgagcaagtcctatttaaattctcataacaatcccattatgcctgttatgtatttgtatattttactgatggaaaaatcgaggcttagaagttatataacttgtaaaaagcaaagaacacttataagcccatatctgagtaacatcaaaacccattcttttaaccgttatactgtatttcctcccaccaatggcagctcctcacaagttgattgccattctcaccacaacacaggtttggtgtttgctgcctacctgacctccttctaggcactacaaactggagctttcagagtatgcacgctgtcattttgacttgatttgattaatgggcatctaaaccaatctggttggtggcaagctgccatagaaaaaaaccctatgcatataaaacagaaaatcagattttgccacatcctgactgggtgaatttgagattatgtcacaccaaaaaaaaaaaaatttaacatcacccttggctaccagaagtcctgatctgcttcctctggattctaagagaataatgaaatgtatgcaactaggtcattatgcttctgatattgggtcatcttaaaagcagatcgcttttaaaaaccagtttttagaccagtccatatagactaagatctcatgagtttgaaatttttgataaaaacacacatgtaagaaccataacacaactatatgagcaactgcatgcagatcccaaaaagtcagtttttgaatattagcagagtcaggaatactctcccaaaaaaacaaacttgtcttgctgaaagttcaccaacgaaactacaaaattcctaggttaagggctctaatgataatgtttgatatatggagaaaaatgtagaaaatcatttcatgcattttagtcattttgagcctcacaccagttccttcaggtgagcagtgaagaaaccatttcattgtacagataaagaaattgagagtctgagacagtgagtgatattcctaggacagagagttagttaagtgataaagcttaaattctaaggttaaggttaagtcactgtcctagactgccaggcatttttcttcaaatacctatttttgaaatgtgccatacacttgagaagagcagaacgaggtttctgccctcaccatctaggagataccacgaaaataaatagtcacgacaattcaccacatcctaagtatacgttctgggcgggatgctaccacactcttctggaggtgagggagacggcaagtattgatcaacctgagccacatctcttatcaggaatgttttattcccctagttttgagaatagaaataaaatgtgggtaagcaaacagaaaaccatgaaacatttcaggagttacatccttgggtttttctaaaaccataggaaaaagaagccatgaaatgaaagaatggcaacaagtaagccgaaaattaatatttagacagcagtattaactgggtttagctggaattttacttcaaactggcgtgatggatgtgttacatctttagggataacattttgcagtggttggtggcagggagaggaagctagctagctaaaagatgttccgcaaacatgcagaaaaggaaagtagaacatcttgtctttgctccaccactaacaagctgagatgagttggggaattctgcaggactaatactcttaatgaaagctcatttaagctggaagtgattggcaatgtatctacaacgtctcagacaacaagacaattgaaacagccaaacaacatgcttttttatatttaaaaaaatccatcaaattagctacaatgctaagggtgtacattgccttttacaaacatcaccatggtttgctcttctattcagtaactttctctccagataaagacaatgaaatgtgaattaactgatcccttcttatattgtctttaacacagacttattttcatattgctttcgtgttctatttatagaacctggaatgttaagcatcataaataaatataaatctcttttttaaaaattcacctattacagaaactgagtattaatagttaaaggagattacaaagaggtattggcctaaaagcgatctagtccctgtaatgtactacttcattctattaaggctacataaaaatacagaagattttactagtagtgttttattttgcagaattctattaaaagtggtggtgcttcaattgtggcttattaagaaccccaagcagatgctttggtcttaaagcagcatctttaatggcatatgcttttaaggataaatattttatactgtttaaatctattatgcacatctaactacccatgcagaaatggtgcagagaatagaacttaactcttgctatatatttcctgtgtcctgtgatagaacctgtatcaaatacaggtaggcattccatttagaggtaactgtccgatacatcattaaaacagatagaagtagaccaaacttgcaagaaaaattacttgaacaatatgggaaaaggaaaattcagtgtttagctctttcttccttgccttgagaggagacatcttgtgaactttcattgtcatctaacccctctctcacccccaccccaaccacacaccctttgcaggcaatttagggaaagtacattgagattgggggtcctaactctgcatactagccatgtgaatgtattcaaaattagtccagctgtctgagattctgtctcaccatctgaaaaataagacaattggatcaaatgacttttaaagactatggttctctcatcttccagggagctttggtcatgtgcattaatattccccccttgttatagccacgtcacacagataagagtagggtagaagagaggaggggacttggaagcaactaagcaattctgaatgatgctgaataacttgtccatggcagtagccagcacacttccctcctggagagcaggacgatactcggggctttcactaagtgaaatgacccagccaaacatgcagttaacaaccactgtcaaatcagaaccgtgcactagcctcttctctccgtccatcctcctgaaaacaaaacaaaacaataaaaacaagaaatcagattaaaatgaatgtcaaggacaaccaggagcagctcaaggaaagggtagtagccaatcccaaatcactccaagttcatgtacaatccaattaaagagtgagctgctgtacagatgccgctttagggcaaacgcacctgtcctccctagttcactacaacctgatcacttccaagctcctcttgaagaaaaagcaaatatgttcataaaatgaagataggttcttttttttttttttcgacggagtctgcctgtcacccaggctggagtgcagtggtgcgatcttggctcactgcaacctccacctaccaggttcaagtgattctcctgcctcagcatctcaagtagctgggattacaggcctggctaacttttgtgtttttagtagagacagggtttcaccatgttgactaggctggtcttgaactcctgacctcaggtaacacacccgcctcagcctcccaaaagtgctgatattacaggcatgagccaccatgcccggcagaagatattcttgactactgagggaccaagctacctaagtcacctgggtcattggagagggtcttacttgactcttctgaaattttagcaccaccttgttctgtgccaaccacagaatatctcccaaagcctgcttatttccaaaatcttgctttctatctcaaaaaggaattctcccagtttggggccaatttgtcatattcctaggacctctaccatggttacatctatagtattaaccagtctatgactatgaattattgtagaggatacctggagccacggactgtacagttaatccctagggttatttgaatccatatctttctaggtatcctctaataaccccgcaaagatggtctacaatcacctagtaacatgtatagtgcttccccacaactgcaataaatggtagaatgtatacaaagcactttgtaaccagccagtttccaaacaaatatatgatttacatcacaaacaacacacacatatatgctcaattcaagtactcatagacatacatatctacttacagtacatgtgtgcatatcagtcactacaggcttgtgcctctgtcaatacagttttcccaatgtgctagcaattcattagactacattcatctaaagcaccgtttttattttgagttgaaactatgcaaaatttatcttcctcagtgtatttctcctggagatactagttaggtattacattttgccttagaattcagaacctcataagaagattctaaaatctaccaccaccaccaacaacaacaaaatcttattgagaagctactggaaagccaactccatttcaaaagccatagtaattataaaatattctacagtaagcaaaaggaaaggagatttcaggaggttctgcctgtgacttggaggagcagggaatgtttctacttatgaagtgacctcagaatcagtccctaatgacagtttccacattaaatagtatttcaagacattatactgcagagaagccatacgtttaaggcattgcaagctttgacattggcttttagagctctgaattacttttccactggctggggtgaatgtattagccacattttcaagcacccatttttggaagagctggtaagagttaaaataccacatgggctatggaacccagaagcgccaattgatcacaaggttgatggggattagcatactttggtgtgattagcgtggtatgcaaccaatttaacaggtgctctctgctaaccaatacaggatttatttctgtgatgtttgcaaatgtggggaaacctgttagaaattgtcccaactggaaaacaatttttgttttattttatttattttttaaggtaagctttctcttgaaaacataatcttaatactgaggagaatgaatttgctatttaaatttgaggcatgtttatgaggcctactggggaactgctatttggttttcagcaagatttgttctggaacaatttgacacaataaggaaccatcaaaaaccactattttaaagctttagtcaattaaatgcattatttaaattaccatgtactttttaaaatttagggtgttagaaaatataaaaatgaccttcaaagattacttctaaattagttcttcctaaaggtcagaaatgcattgactaaacatccaaaagggtggtgaggtgggggagagattgcatctgtttaaattaacaatcaatccatatgtcaacaaaattcaaatggtgaaaatcaatcctagtgatggccctgagcaattttcataatgagatttcatcatctgtgacccattggttgtcctttggtggcgtgtggaggtgcagtttttaagaagactaaaggaagattttccatggcctctggattttgctgttttggtttgtcctatctaagactcttcaagtgtttgtaagcctgtaaactatactctcaccttctgtaactctgcaaggcttctcccccatgcgtcacaacaaagaaaattctcatgtcagccaggcgcagtggctcacacctgtaatcccagcactttgggagcccaaggcaggtggatcacatgaggtcaggagttcgaggccagcctggccaacatggagaaaccctgtctccactaaaaatacaaaaattatccaggtgtggtgacacgtgcctgtaatcccagcttcttgggaggctgaggcacgagaattgcttgaacctgggaggcagaggttgcagtgagccaagattgcaccactgcacttcagcctgggtgacagagtgggactctgtctcaaaaaaaaaaaaaaggaaagaaaattctcatgtagcctctccagactcaagttgtcaagcttcacacagaccttagaaaacatcgctgatgccaaatcctcttgcagatggaggatcaaaccccaaaaaactgagttaaataggttaagcgacttccccaaaagcacaaactaaaagactgaaagggaccatgttggcttccttggtcttactatataacccccttaaaactcatcaactgcaggacatttaagtaaattaatctttctgactgttctgtgaaggagatcttttactgtaaaacttcacttttaaatgtaatcttttaacaatagattctttctcgtcaactgatttcaagaaaggaaactgtaatttccaaaaaattagacacacactgttgcaatacagcaaaatgcttctgatccaaaacagctttctgttgttaaataaagaaagcaccctcttagatagttaacttgtttttcctgcttgtaattttttccctgctttggatatactctgtttaaacacaaatgctatgtaggttctttcagctttactccctgctttcttaccttttattagaaaatgctatcttacttgaagccaggcgcggtggctcactttgggaggccgaggcgggcagatcatctgaggccaggagtttgagaccagactggccaacatggtgaaacttcatctctactaaaagatacaaaaattagccaagtgtggtggctcgtgcctgtagtcccagctagttgcacgactgaggaaggagaatcccttaagccagggaagcagaggttgcagtgagccaagatggcaccactgcactccagctgggcgacagatcaagactccaactcaaaagaaaaaaaatgctatcttatttgagcttcctaaaatttgagaaaatgttaatcactttattaatctattcattcaatctttgcccagctattactattacttgcattaatctgattttttaattttttttccatttcatagtttattgaattgtgttttattatatttttattatttttaaaagttagcatagtatcttacattttgtcaacatattttttctgaagaactctaggagcaaattggtcttagaatattcaggtctgcatgaagtaaaaatcagttatgccattcgctgatatgtcagttggcaatagaatttgcatgtaaaggagattgaaagctatcctgattaattgagggggaagtaatgagtggttggaccatgaactgagccaacaaataagttataaattattgatgcccccaatttctgcttaaaaaaacttgaggaaacgaaatgctaaatctcctactcttcctccgaatctacagatcactaatagattactgttttaagcttaaatatatcaatggttttattctgacagcagaattctatttatgctaaaaataatgatctctaaatagggattagaaaaatcagaaaggtctttaaatgacattgtcttttctgacattgccatcagtgacaaaccactagacttgttctgtctaatgacagaaaacaaaactggctgtctgttttgaaaaaggaaaattgtgtgtgcatttggttaaatgtttcacctttcaaccaagtgttttaatatgttttagttactgcctaagagcacagattctaagaaatcttgatattatgaaaacctaatgtaggcacttaaaacatgccttgggcaagtccatagagatatcctgccactaattcacagtgaatctcctaagaattccattttcgcactagtagtataaactaaacagagaattcagtggtactctagatccttaaggcaagtgacaaattaaaaattcattaatcactttgaggctgagatacggtatttttaggaagaatacttccaactttaaaaaaaaaaaaagtcccttgtggagaaaaatgaatagagggtatagttcaccaagaagaaaccattctttctcaggaggaaaaaaagagggaggaggtgggagctgagaattacgaagttcaggagcaacaccctctagcgctatatatagctctgaggctcagctttcttgccttggtgcatgcagttgggcctccggtgctcttggtaataacaccgaaagcagcagtttttaaagatatactcaactttccccactcccaggatgtggcattctaatgaaactacccgtgcaatccgtgtctgagacattgtagcctttggagagcgccatttgctgaaatgtctatctagtgagaggtaaaataagccgctttggtggaaaaaaaacccgctgagtggttgaaatcagagctgcagaaggtcacttgctattttagtaactgcaagctggtcctcattttataacatcacagttataaacaagacattgtcaccttgcttgtcagtttacttctttttcaccaaaataagcagatgtagccctttttctttctacatagaattaggtaatttggatgacttgtttccaaactttgcttaactgtgtggatcaatatgtaagagaagttatttttcatatatttctttaaacattgcttcaaaatattattcttacacctttttacatcgtctgatataattgaccttttaaaactctatttacttgtataaaccttatcacgcacatctcaatcatgctgtaaatccttacattggactttctttcttacttctttgatttattaatagatcacaatgaagagtattgaggatggggtaggatatgtagaagtcctttacagtctcaggggagagagagagagagagagagagagagagagagagagtaaggagactcagctaatttctaggattatttagatacagtccatttggaaatggaggaaggaggttaggtccagccccagggttctataattattgcacacactattgagaattaccatcaattttattctagttttcccttcaaaaatttaatttctctcttcttattgcacacatcaaaagtaaagattacccttaagacttctagggaggtttgacaattttaacaatattttaaaatattttttcatcaaagtgatgcagaagtatatttaccaatatcaattattttaaaactttctgagacttctttttatttgattcacacattgtcatttctatcccataaagttgctcaatatataaagttataaattctgttaattgaatataaatcttggattccaataagccttccacaaagaatagtatcagggtcaaagttgaaaacaaaacagcaacttttggggggaaaaagttttatgtgtttatacatgtgagaatatagaagggaaaggaagagaaagagagaaagtgatagcaagtgattgttcatgaaattaacaaatagaaaatgaggaatgtggatttaatattaacctgcaatacacacccaatttttccttgcctgcatcaatgttcactttttgccttatcatgattaaaaggaatgactggacagactgagcatataaaattgtttttctctttcctctatatcattatattaactatcaaagcagcccacatactcttagtaaattgaacaaacctctgtctcactgaacacatgtagggaatcttaactactgagaagatgtagctgcattttcattacaagttttctttcacacccacttaagaaatctccagcctcatccgtggtctcaggaagagcagagtgtagagtttgtgtgcatcacctttggaggtggtagaatttcccatcagttagttatctgggcaatattcctgttggacttactattccagcacagagcatactgacttcttcttcgacatgtaccatctgcagcccaagctagtcaaagaagccaacaaaaactgagctgaaaacagctgcaatccaagttagggtaacggatgaaggatgtgagattgcccagaaagattccatatcctctgctcttttacctcagtcccttttgtctggactttctcatgtggttggtccctagagaggactacatttactattaccttttctacttttccaagcaaggactcttgaaagttcctttggctcccaacagaaactttgcatactgtattcattgtctctcctttggcctttctttttaaatccctctcctcttttcacaactgcagactctcagtctaagcaaaccatctccttggacattcaagcatctttctaattgacagaatgagccctccagtcttgctcccatgagaccaagtctagctgtaccgcgtcttgtaacaagctgagctttgagagggtcaagtcggtttttgcacatggctcacctctgcactgcagaatagtgagagaaagtggtggaggaatgtgtctgcaattgctgctactgtgcttttgccttcattgccattcgtaataagtcttatttataaaagagatttgacttgtatttcccaccacaaggatatggaaaataattttgcatgcttaccatttgacttcaaagccattctgagtgcttaggctttaagatcatcaaacaaaggatcaatcttaactcttataaatcctttgagaaataaagcagacaactgaaggaaggaagaatggatagacagatggacatcttcaacattatcttcactaactcagcgttggttgagcacctactatatttaatattttgtctcggtgccacatctgctggtcccatgtattctccttcaaaattgtcttgactgtagctcctccactccatctctgtcattatgacctagttcagaccttcctcatagctggtgtgaattttcacaacagcctgattaatttcatgtactcactaatgccatctcatctttgccatgactaaagtcacctttctaaaacaaaaaccaaggccgggcatggtggctcacgcctgtaatcccaacactttgggaagccaaggtgggcagatcgcctgaggtcaagagttcgagaacagcctggccaacatgaagaaaccccgtctctactgaaaatacaaaaattagccaggcgtggtggtacccacttgtagtcccagctagttgggaggctgaggcaggagaatcacttcaatccgagaagtggaggttgcagtgagctgcaatcatgccactgcactccagcctgggcaacagaatgagactctgtctcaaaaataaataaataagacaaaaaacagaccatactttacagctcctactttacaacttcggttggttaccagttatctctgaattggtaaaattcagagataaaatccaaaaatcctacaagatgaaattccttgacctgtttactcagacatccctacttcagtcacaaaatctgtccaccctagtcttatttctcctcatctcctccatgcaccctgtgttgcaaatatacaagacttcaagccaggaaagatggactcggtttcaaaacattgcttactagctccatagaaactggtctagactcacttggtcttttctttttttgagacggagtcacgctctgtcaccaggctgcagtgcagtggcccgatctcagctcactgcaacttccgactccctgcttcaagggattctcctgtctcagcctcttgagtagctggaattacaggcacccgccaccatgcccagctaatttatttatttatttatttatttattgtatttttagtagagatggggtttcaccatgttggccgggatggtctcgatctcctgacctcgtgatctgcttgccttggcctcccaaagggctgggattacaggcgtgagccactgcacccagccatcacttgctctttcgaaacctcacttctatcctcagtaaaggggagactggtcctaaagaagtaaaggttgtaaagatataagatgtaatgtcagaaattacctagcctacagctagctttctatctgtgccttcataacatcattccctctacctgggatacatctttctcttctccatgtgacaaactgtgctcatccttcaagacccaggcaactcctctatggttattttcctgcccctacccccagactaagttagccactttcttctttgggctcccacaataactgtgggcatttattgcatcatgacatgaaattatattattgtaagatactttaaaacacaggcaagggtaggggatggtggctcacgcctgtaatcccagcactttgggagactgaagcaggtggatcacttaaggtcaggagtttgggaccagcctggccaaggtgaggaaaccctgtctctactaaaaatacaaaaattatccaggtgtggtggtgggcacctgtaatcacagctactcgggaggctgaggcatgagaatcacttgaacctgggaggtggaggttgcagtgagccaagatcgtgccactgccatccagccggggcaacacagtgagactcggtctcaaaaaaaaaaaaaaaaaaaaaaaagaaaagaaaagaaaagccaaaatctttgtttttttaatctgtaccttgacctgatatagggtaccttctcaaaaatatttggtgaatgaatatatgaaggcattatgctgggctctgctgtccagttcttaaggacctcataatcttaaagggtgtgggacaaacagagggattcaaataaccacagtatgagtctcactggaacaagggctcaattgaggcagaatcaaagtgtgatggcagccagcccttcttcctgaggacatggttggcagggaaactttcaccaggcatgaccatccgggttgagtcctgaagcatgcatgtggatttaatttcctatttccttaaccttcccacgtatttattgtacctacccttcctcataaaccatagactcctaaattttgatatcagaaggccagagaatccttaagctttggccaacagttccaggcagatatcataaaagaacagataaagtttttcacaatacaattgtgagtggcaatgatagtcttgtttataaaccctgaagcctgtaaattaccaacaaatcagcatgtctttgaaaatgaaaacaaactacaccaagaagataatagtttgaaaactataaagctataaaatcttttgttaacattatatacctactggaaagcaaatatgtttttttagattctaagtaattagactgccccggtgaaattgaaaaatgatgagccatgacataccaatctattttaatatgatggatagagtaatttttaccctttttataccataggagaatgttcaattaaactttgaatataggattttttaaagaaaggattttgtaatatcataagcagtgcaagtctagaaatgctcagtgctgaatccaatagagtagagctatcatcagaagttagcatttggtagcatcttctacatgtattattttattttgattgaaaaactcttgaaatatcttctttctgcaggatggattgcagaattaagtatctccactgaattgtatctccattggagtcatcatattgctcccctgatgacaaactatgtagactgtcctaataaggataaccggggctaccatttattcagtgtttccaacgtgccaggcaatggtctgtaggagatttttgtttagaaaatttattagaagcttaagtttacaattttttgttctctacatcactaaaatttaatttactttgtaccctatataccagaagcttagtgagatagaaaggagacagccaaatgctgctttgagggctgtcctggagaaatggggttggccatttagaaagaacagaacttacatttgaaatggcgcaacctgaaatacaagaaaattttattttcaactagtgttcaactagcaggtgggattacaagggaccacctcctagctctagccaccttcaggggactcacagcaggcttgttttgttttgttttgttttgcttcgttttgttttgtttttgagatggagtctcgctctgtcgcccagactggagtgcattggtgtgacctccacctcccaggttcaagcgattctcctgcctcagcctcctgagtagctgggattacaggcgtgtgccaccacacctggctaattttttgtggtttttttttagtagagatggggtttcaccatgctagccaggatggtcttgatctcccacagcaggctttttttaaggagagctcttatgtctggttctattgctcaactttcatgtctccaaacccaaaatgattggtatttaagatacaatgtgaaatacaactcgattgggataaactgcccaaaattgtgtttgctactaatttttgtgaatataatcatttaatcatttttaaactttttaaaagataaaggttattatataaaaaattaaaaaggagaatataatggtccctatgacccaattccaatcattatcaactcataagccaatattgtattgtgtacaccacctctcctattatgtaagatatttacattgccccaaagtcaaatctacaaaaatagtattatcagaaaatttaatttgtttccttgtctctgcattctgttccctatttcctctatacatagcctttcttttagtttattgtttaatgcttcctttaaaaaaataagcaaataaatttatattttaatgccccctttctgagataaacaatagggttctagtgattttcaaaacattttaaagtatttggagtacaagtgttaagactgttagttgactttcaagccaaaaagcaagaaatataataattttatatcttttttataaataaatacctttgaatggtttccaacttgtaaaacccctaagttgtgatcaaaagacctgggggaaagcaataaattttgattaaaatactgaaaattgaaaaaatgcaataaagagtttgtctgaagattttaagatagatagcaatgttaaagacactttaatacaataggagtatctccaaaaggcattcttatagtaaacacattaaaagctaatgagcagagtaattttattcacaaacctttgaattgatatcttttctcacagaccgaattgcacagaacatcattaagtcccatttggagacatgtcaatacaccatggaagagctgcaccagctggcgtggcagacccacacctatgaagaaattaaagcatatcaaagcaaggtactctgggaaaccatgagaaagtttttctgtgattaccctattgctgtgttgctcaagctcagcactattggcatgttgcactgggcaattcttttctgtaagggcatcctgcaaattgttcgatacttaccagcatccctggccctacccactagatgtgccatcgccctcacacacacttgtgacaaccagaaatgtctccagatactgccaactgtttccaaggaggcaaaactaccctgattgaaaaaccactgccctatttgagtgactacagagaccgtgccttcatcaaatgattttaggacatctcttgctgacttcttgggtggaggcaaggagcaggagcaatgtaataatcacagcagttgtaatcgtcacaaacttacacagcaaatatatggaacaaggctttctaaagttttttcttgccctgcatgttaaaaagaatccaaaaaacaggacaactcatcccatattttcattattacactgtgtcatttctttgggtttgttgaagaagtttttaagaggaatttattgttgtttttcagtatttacattacattactttgggatagagatccccaattacaaaatccaccagtagatggaactttaataaaatatataaatgtgtgtatatctaaataaatgtttacaatatgctgatttttctccaccagaacaactaaatctcagtacttttatataaatagggaaacaaaggcattgtgtcgctatggtcaataaaaattagaattaacacacatagatttctgtttctcatttcaaaaaataaactgaggactaaaaaatatttgggtgattctactgaacttaggtgaatgatttgatttgatgtaatgcctttttcctcggaattcttttttcctttttttttttttttttttttttttttgagacggagtctcactctgtcacccatgctggagtgcagtggcgcgatctcggctcactgcaagctccacctcccaggttcacgccattctcctgcctcagcctcccgagtagctgggactacaggcgcccccccaccacgcccagctaattttttgtatttttagtagagacagggtttcaccatgttagccaggatggtctcgatctccctgaccttgtgatccgcctgcctcagcctcccaaagtgctgggatttcaggcgtgagccaccgcgcctggcctcggaattctttttaaaccagaaaacactctccataggtctgggaaaaagacacaacataaaaatactacaaatttagtgcccatcagatacccatgaaaatgatgtcatggaagcctgtgaatgaaatcactatccctcaatgcaaagctttgttttttatattaatagtatgtgaagatagatttgttattttctttacaaactcagatttcgtttaggtgagaaggaggaaaaggaggaaaaagagtaaagaaaataacaaagctatccttacttactataaacaatgttgctattattttagcctcagtactttgatcattttggcctattgaggtccaaacaggtcaaaatattaacttagggaaaaaaaataaaagtagtgccctccttttttaaaggaatcatataaattccctcctttggccccaagtgacagataagcaccagtaaggcaaacctgagtgttctgttgactctccgtaagtcgtttgccctatttacattctgtgtcttctctcctcaagtccagggaagcactgtggcaacaatgtgccatccagatcactcacgccatccaatacgtggtggagtttgcaaagcggataacaggcttcatggagctctgtcaaaatgatcaaattctacttctgaagtcaggtaagcaagaagattcatgggaggcctatttcagataaggatgtggtcagcccttagcactgtgttggttctagaaaatcctccttccgatatgcagctcgtttctaccacccacattgtcagccaactcccaaaggaaactctcagtaataaaaatgccctgatactcattcagttcccctttgaagtcaaatacaattttgcttattgaaagtggagctattaattgcggaggttgaaatacccagcttgacaggcagtgcaagtaattagcgtgtcaaggtggctgaattgctgagccggcgctaaaacgtactccttgccttctgtgaaaggaaaaaaaaaaaatgcaggctagctgagttctgcctctgtggtcatttccaatcattttaatgaggatagcctgcagccagtatacaccaggagaaactccacggtactctaatctttccctacccttccctaacacactgtctgacacacacaattgctacaatcgctgcggaagtagctcaagaaactctgcatatgactgactttgcggatgttattaccaaacaggaaaaagaaattatttgtctttcttgggcccctttgaaaatagaaaataagaaccatgatggtgtttatgcgaattttcatggtcctaggccataataataataataacatactcataagtaaaataacatacatatgtgtttatgtttccctatgacatctcaagtaatcttgtgagatccatattattatttccatcttacagaggaggaggaaaagattcagagaagtgaagagctacattcaatattacaaaaccagtacacggcaaagttggcatttgaacttgggccaaatataactgttattctaagatcccttctttaccaaatgactcaagttgatgaaaaccttgactgaagtgtcaacttgatgtaccagtcatctaaaccactgcaaaatttaactaaaacaacaagaattatttctttcgctctcaaagctacaatttgggcagggctcagtgggagtgaccttatctctgctccatgtggtattcactgagtcagttcagctgagggcaaaggaatccactttcaaattggctcattcacacagctgatgagttgtgctagttgacagcctggaactgggctaggggcctcagttcctctccatgtgagaccctccaaagactgcttggacttgctcaaggctccaaaagctagcaccccaagagaacactagggtgttctctaggttccaaaagctagcaccccaagagaacaaggcagaaatgcatagatttttctaacttagcttcagaaaacacatattgttatttccattatataccatcagtcatgaagccccacccagattcaaagataggagacatggattctactacttaataggggagtggtaaggtcctagaaaacatatgggatggaagatattttttctgaccctctttgaaaagtgaaatctgccacacttgatatgtgaccttgagctaaactctctagatagcagtttcctcatttgtaaaataaagagatggactagaaacaatgaattccaaatttagaattgcatcaacaacatcaaaggagattattgacagttcagagacatgggcaccatgagtcccatggaatccaaatctcctggaggggaacccagttcattgtatctctaactaagactcagatataaccaatccatgggctgacatttgggaacaactgaaccatataatctttaacatctctacctggtgtaaaaatgttgactctagtcaaaaaggtagggtacttaatattttcaagcctcatgtaactcctccataaaatagggctaataaactcacctgaaatagttattgtaaggagcaaagataaaaaatgaatgtaagaggccaaagaaagttccttccattgtgtagatactcaataaatggtacccatctactgtttgtgtcagaaaagcattccttcaattaatatttgcaaatcctccccatgtataagcctctatgctaggtgacgtatcaaagacaagcagagagaaatcagcaaacatatgtacagcaaaggaaataaaacagagacataaagataaagtgatggcataagacaggtaccaaagttgtaggctaatcaccagtatgatgctctcatgcaaatctgtggctgctgagtctggctgttaacttcaactgcactatggggcaaaagcccatttctccaaaacatgggaagctatgcagcagtatttcctcaggatgttaataatgctcaaagggaaaaacagtggtagtaaacaaattcattcaataaatatttgcttagcacctactatgtgccagaaacttttcttggtcctggagatgcaagagtgaatacagtaatcatggctgcctatcactgcagacaaaatttctgccctcatttcctcaattgtgaattcaggaatcaaaactagctttaatattagtggaaaaatagagaaaaatgtattttcaaaaagtaatgtccagcttagccacctgtaaaatatattttctccttaattcctcatataagtatcaagaaaactttatttctaatatattaagttggtgcaaatatattaggtttttgccaatactttcaatggcaaaaactgcaattatttttgcaccaacctaatagttattttaggggaaggaacttaagggatttctgtatgtgtgtgcctgtgtgtgtgtgtatgtgtctctctgtgtgttttaaagttcttgaaagtctcttacctatatgcagtaataatttctttattattggatatatatgtgtatttttattttatttttatttttattttttactcataggttgcttggaagtggttttagtgagaatgtgccgtgccttcaacccattaaacaacactgttctgtttgaaggaaaatatggaggaatgcaaatgttcaaagccttaggtaagtttccctttgatgaggacacaattttattagccaccatcagtttctccacttagattgaaattggtaaatgaaatgccttgattctttgatgtgaaccagtatctcattattcgataagcgatggaccaggtgagcttctaattcaggcaagcctctcctgatcttgtaactgtggcctccaatacaaaagaaagagagaactgaggaccctcctgagaacaaccctattgagacatcgttcattcagaaataaatggaggcccagcgtggtggctcatgcgtataatcctagaactttgggaggccaaggggcgcagatcacttgagccccagagttcaagaccagcatgggcaacatggccaaaccccatctctacaaaaagtacaaaaattagctgggcatcaccaggtgtggtggctcatgcctgtaatcccagcactttgggaggctgaggcaggtggatctcttgaggtcaggagttctagaccagcctggccaacatggtgaaagccagtctcttgcaaaaatacaaaaattagccacgcatggtggctgacgcctgtaatcccagctactcaggaggctgaggcaagagaatcgcttgaatgtgggaggtggaggttgcagtgagctgagatagttccactgcactccagcttgggcaacagagcaagactccatctcaaataaataaaataaataaataaaattagctgggcatggtgacacacacctgtagtcccagctacttgggaggctgaggcaggaagattgcttgaccctgggagattgaggctacagtgagtcatcttcacaccactgcactacagcctgggtgacaaagcgagaccctgttaaaaaaaaaaaaggaaagaaataagaaataaccggaggctgatgctaaaagagtaaaagagctgggctgaattatagatcattctttgtgaaatcagcttttttttttcaactttattgcatattgcatagacccctggtcatccatggtggtgacctcttgcgtttcttatgtcaatttatcatcatgagttaagatacttaattaaatgaggagctcctctacttgtttctcacccacagaagttaattcacaaagttctgggagcacagagttcatgccaacctgtccacagtgatcccagaccattcctgtgggaaggcactaacagagtcagtctttgtttggaagtgttatatatcatcacatccagtcatcagtgcatggcatggtaggaagaacattagcaaagatgggctgatgccaggaaaggttttaacgattgatagtgccatttgttccatatcctgcccatggacaccaaagaaggccactgccctttcacctcttgtgctgttagttgatatggcagccaacaacaagtccatcggggctggcaatgtttcccttctacagttgatacacatccatgtcatctccaaggctagattttcaagaaaggaggaaaagccttggcaagcaacctcagtatatttccagcttcatcaaataaacattcaccagggatcagtgtagagatgcaacattattttgccaaaatacgcaacagctaagcaactgacctgtgagtcattcattagaaggtaataataaataaactctagctcctcagtgaaatttccaaggaaattgcgaaactgaagtgcatctcatctctgttccattagatatttctaacgtctcagtttaaaagtccagaataccctacattgctagcttcaagtgttacgaagactgacaatcctcagcccctgtatgtaatgttttaggttttctatgaatactatctctattgtaaaggatccccaaatcacttattttatattctttaatgtgaaatcatttcaaatttataaggatgtaatcatattatggattgccagacagatgtgacaccactcacacaccaagtctacttgcttgccattggtaggtaatgttaacttggattgcctggccaagatgttgcccaattttctcattctttgattagtatcaaatcactttttataattagaaacttaaaaaaatatcttttctagaagtctagtatgcacctccttggatagcttattgattatgagatttttcttactcttgccccatttcaagttcaagtatttttattccatttttcttcttcctttataggttctgatgacctagtgaatgaagcatttgactttgcaaagaatttgtgttccttgcagctgaccgaggaggagatcgctttgttctcatctgctgttctgatatctccaggtagggcagtctcagttctcttacctttttaaaaaacttgttttactatttttaacactgatgacacctgcctaagccaaagtgttcaggagaaactttaacagagctatattttctttaccaagtttttgatatttttggacagtgaaaagggaagtagcctcaagtttattaaaatgaccaattttggcccgaaagcaagagtagagcataggttaggggttattccagattcagatacgcagaatcattccttagcaaataaaggaagacaaatagtggcctgagttacagccaagttctattttgactttaagaataaagtacatagaaaataaatgtccagttggatgagacacagtagaaatgtacctaaatgaaagctccagaatggggacctacataagtaaaaggaacactttctactctttaaacacctcttgtgttggcatctttgcccaaattcatgttgaggtgctcacttcagacaaatgctggtgcctattttcttagcaatacatttgaccttgaacaatgcaggggtcagagcattaactccctgcatgcagtcaaaaatctgcatgtaacttctgactccgaaaaatttcactaccaatagcttactgttgaccggaagcctcgctgatcacataaacagtcgattgacacatactttgcatgttaaatgtattgtatactgtattcttacaataaagtaagctagagaaaagaaaatggtactaagaaaattataagcaagaggaaacagatttcctgttcattaagtggaagtggatcatcataaaggtcttcatcatggtcgtcttcatgctgagtaggctgaggagaaggaggaagaggagggtttggtctcgcagtcccagggtggcagaaacagaaggaaaatcttcatataacttgacctacacagttcaaacctatgttgtagaagggtcacctgtatcaggagtttttaaaaggaggtgaggacagcagaggggaaaatgactcatactgaagactgcccagtagaagaggaaaaacttcagacatggaggtggacattctggtgccagctctgtgaccaagtatctgtgtgatattaaacatttgacccctcagagccctagtttcctcatctataaaataagagggatggactccataataactaagacctctactagctctaaaatgcactgaaatgccaagttcttaaagaattcaaggtgtggcaatatttatggatcaactagaactgtagtgagtaaaatatttttttaaagtatatactaggcctggcatggtggctcacgcctgtaatcccaacacttcgggaggccgaggccagcggatcacctgaggtcaggagtttgagagcagcctggctaacatggtgaaaccccatctctaccaaaaatacaaaaactagctggatatggtggcagatgcctgtaattccagctccttgggaagctgaggcaggagaatcacttgaacccaggaggcagaggttgcagtgagccgagattgtgccatttcactccagcctgggcaacaagaccgaaactctgtctcaaaaaaaaaaaaaaaaagtatatgccaacttaaaatataataataaataatataatcataataatataacaacaataatatagtaataaatacatgagtctctaaccagaatgagaattcagttacttcctcagctgttgtttggttacattttgggttaagggataacagcatcactgacaggtctctacagaaagaaaagcaaattcctgcctaatttttaaggtcaagagtctcatttcttctgttacccgtttatctgtagagaccagatgtcttttcttatatatgctctactatatttttcaatgaaactggaagaaattaatcttacctgtgatgtaaggtaacacattataattttagcatgtcatcataactgtattttccaataacaccaatgtctacagtttttatgttaggctttattattcctaatatgattcttgatgatcttatcaggatatttttaatttgctactgttttttatttaaccactttatcaaaaatggaaattagttatcacatagagtgtttttactaacagtttcttttatggctctgtctaaaatcaagctgttcctctaggcctttttttttttaaaccctagaaagtttcccaggcttggaagcacaaagatagatggaagaagtgacaagaatacttttctctgttagcagccacatgccaaataattttccttctaccattttctcattgcatttgattatttccattgagaatagttcaatagaaaactaaacctaagctggtgaatctatggatgagggagatggttttcctctagttcttgcttgctccaaggaagcgttagaaagagtcacttttctctttgggtatatttgtggcaagtcagtaaattttaagcagcaaatatttaagacatgaaatattaaatgtattaaatatgaatgatctatgaaaatgatcacctcagaagaaaagctagcctcttccttctgaactagaaatcagctgagctgtttggcctttttctagaaaaaaaacatactatcatcattaaattctgagaagtttggaagcatgcaatttgttttactctacctagtggggactcttccagtgctgctagcagactcacactgacaggcttcacaaactccaaatacctcatttgccaccctggcttagtgccatattcaaaaagatttccagcctatgtaggctccatctcctgccagacagccccctattctttctccagggtcctgacataagagccactgtgtattaggcttcaaacagcttagggaagggagagggaggggaacttaatgtattctgattgacaattgtcactgaaagcttttgtactcacttacgtaaggttttgcttaactgttggctagacttgtcttcatcctgtctaggattacagaattgagtttctcacctgacctgaactgtgttcaggaagatcatgttcgagttcttttccatgagtatttgttcggcatttgaagatttggggtgtctcttccataaaggtccaacctaaggcattgatgctgggctgaattttgtcaccgtggtgtataaatcttctaggaaggaaggaaggagagagtgaaggagaggggatggagggaaggaaataagtgtgggagggagggaggaagggagaaaaagagagaggaagaaaggagggaaggaagaaaagaagggagagagggtctgagggagggagaaacagatgaagagagggaagaaggagaggagggattatcctattcaccatttaagaattcaatataggaaaatagaacttagaagtgaatttttgaaactgatttatgtttatgctatataaattctaacatagcttcagctttatatctgatgaaagaataagctgagaaaaggaaaagggatcctgaacaccaaaaatattcctgtgattttcttcacttctataattcttcttcacaaatcgctaacttctactttgaaagaaaacctaagcatatgtccaaagcaaagagtgagagatgtaaattgtcacagacaataagaaacaaagcagtagattatctgaaccattgtgtcctttcctccaaagtgatttcctgcatcataatattgcgcattcctggcatcatggtattgcctatgaaatacttatgttttatgtaaataatgacatgtcttcagaagcaacttagaactaaataatatgaaatgggtctgaagcttggcacttatgtatgtgggtgaagcaaaacaaagttgatgttccctccacttacccactctttctttcatcagaccgagcctggcttatagaaccaaggaaagtccagaagcttcaggaaaaaatttattttgcacttcaacatgtgattcagaagaatcacctggatgatgagaccttggcaaaggtaggtccacagatcacagagccaccaccaccaaaagagagcacagtgagcaaaaaggactgcttataaatcaagggaaatttctcagcagcaacaatttctgaaagttaccaaagactgcataaattgtgaggtatgcaatttaaaagagaggctagtgaattgtaatagattgcaagaagggctttcttatagagggatgatattgacagatctgaatccaagcttcaggaggacaaatcaatgaaaccaagggtgtttcatcagaagaacaagcactcaaagcaaggaaacaggtcttcaaaattcatatgtgaagaaagagagggctttgtgccagttcaggagccaggtctgggacaaagttaaaagtaggcagatttttattcaaaaaaagaaagaacaatcaaatgatgagaattgttgtatggggggtggactactgtgtaaagcagtgagctctgtgtcataggacatgttctagtagatactacctagtcacttctcaggtatgttataaatgacattcctactcagagtgcaagattagactgatgacttgtaaatttcccttcaacgctgatctcttcgtgcaagacttgccctgaggttctttcaaaatggggaagtttccctggagcaaaatccatgcaacatgtcatcaatttcttgattcagcttaattaagaatgatctttaataagagtactgaaaaaaagtgtttaccaaagtaaaataatcacaaaaggaaaaagtaattctcaatgattgatattcagcattattttatatcttaaagtatctttgatttctcaagaactgaaatttttgggcagccagaattatcgtagattttaaagtatctttgatttcttaagaaccagaatattttagagggtaagaaattaagaaattgagcttattcttggttaaagatcataggaatcctactctttatatttttatcattaaaaccttcccactctgcccttgaagttctttgttttaaaaagggggatggtaaagactctatttggagacaccatcagattttactttgcacatacagagtactgctataaaaaacctccatgagttaaatatgctgcttcattatggtaacattttgttaaaattaacgcatcactagcaagaacatttccacattatagagcaatagttctctttcacgtaacttttcatttattaggtggtcaaggacaaatcacctactctctgcacctgtattctcctagtcaatagcgaacttcaacatgctttcagattcactgggcagaaaagacaataatgtaaatatatgcatgtgtctctatagttgcttggtagcgtatatgcataaatacatcttgttaattaatgtggagggatgttgtctgcatttgggatctcctgaagacttttgtccccatatttaccatcctaaaattagtcttgaaaaaacacaaagttggatgaaaattctcgctattctgcttgcttgggaggattgtccgcttgtatgaaaaccatggtctcatcatctataaaatgaagattacaatttcttctcctgtgcagatgtgttgtgaggttcaaatgagattctaacacgttgtgaaatggtgattattactcccctaggagggtaaaatgtttatgcttgcaccactttctacctcccactgtcctggttatgatttgaggtatgtgaggtaggaagaaggcagaaattgaagaacgaaagatatttgaaggcaagaaagaaaattatgtcaactgtagatcagattaacttccctttctccatctttacttggaaaagtacataattcagttcttttcttatagacaagtaatgttgcaaaactgagaaagcattagaagaggattacttcttggataaaattggctagaaccaggtgacaaagcattgcttctataggccacaggcagatgttgggtttttgtgtggcccctttcttgtaatagttatcattttaataagatgttatctgaactaatgcaaactgaccatgaaattgaatgagaactgaattttcatttatcgcagctctgatctctgtggcttcagattaagtcgctccatttgtctaagtctcacatttgtccattatcaaatgctggagggttaggaatatggactgagccccgttagctcctgactgctttaacactccggacaaatgtgccatcactgtctaggatgccctctcatcaaattccccaaaaggaatattttatttaaatgtgagagaaactgtttcatcccatcacagattcttcttatctttgcagaaaggctccttatgccattgtagtcatggagctcttctgccttccacaatacctctaaaacagtgagggccattctgaatatttgttattcatagaccccttggggactccagtgaatgttgtgaaacctgtctctaaaaaaatgcacatgtacccgaaatgttgtgttgaattccaggggctccggtgaaatcgccagtaggtagaggatacctctgctttctgtgtcgtgtgcaaaagattatttctaccgctgacctgttcaactctgaataggtgttaacagacatcaggttagaggtacagggctcatacacagtcactgaacttcatcttgcaagggcaatctccaacacactttctacatgcctacttcctgaaattaaagttcaggtagcagtgccttctactttgggccaaactttaaccttagaaggtttgaaaatttggggattatgtatcctaacattaactagaagatttcaattcccatgtgttaacctgtgttgtggtttggggagaggagagagttggttaggggaaaaaaaaaccctattaaaacatctagtttcttctccttatcagcataattatgatacatagcgtatttataataaaccatcaaagccacttgctagatgagtgtccctggacatgtgactttaactctctgtgcctccatttcctcatttgtaccatatgactaaagatataccaatatatggctaactaaatgagataaaatataagtaagctgcccagtccataataggtaatatgtaagtgctgttgctgtgttgtagctgttgttgttgacagaaaaaaaaattatttcggcagagacatttttatctaagagatggcgtatttgagctagtcactgatagatgaaaaccatttcaaaagatggaagttgggaggttgaagaagtgcaggatggcattccaagtgatgggggcaatggcatggaggtaggaaagcataaggtatattcaggctataaataatagttagatttggctggatcctggatttgagaagccaggaaatgagataacactggtcactttcactaaagctcatgaaaaaaaaaatacatacatatatatatatataaaataaatatacatatatatttttaagccccatatgactagaggaggcagcccatctgttctctgggcttcacttttcttgtctgggaaatgagtaggttggactgcatggtctttaaggtctctttagtattatcttgtttgactccgtaaagagaaaaacaaaggttcctcctgacatcttgtgttgccttccaacgtccagtccagtgtgattgttttaagtactctttggatattttactgttataaaaagtgaagaaaaagactgattttgccaagtcttatggatccaaattagtactcattgcactatggtcatttagttgaggacgatactccagcttcaaagctgcaaagcatacagtgtgtgcaaagcccgggttcagaggtcagcgtgcccgtcagtcttccaggaggagctccatgacttgtgctttggatgctgccatgactcactttaggaggtttacttcctcagtgaagacagctgtggggattaggaacctgtgatgctctttccccactcagttgagaacagcaggaccactgccgaggttagagagagggtgagagatagggcagcaaatgtttgaactataaagactgttgctcttccattctagggctttctctattaaagtcactgagtctgccattcttgttgccctgaccagaggtgcagagggtagaggataaggaaggccggtccagctggggccaagttgtggcagtgtgctcacggccaagaccaaagcttggatctgtagtgtcttgctcacatcttgtcctcagatgcatgggtctagcccattcccaaatgcagcctacaggtcaggcccatagctggagccttgcttaatgttggccttccccagtctagcccctccttttgtgcctcctggttaattagagtcatgaaatattgttagatagcatatttatttttcccagcactcctgaaaatagatacaacactcctggaggtgtgttcttgcccaaagctgtattgagaagtttgaaaatagctaactctataacaacacatatatccaacaggaagccatagagaactgctgatatccctcagaggcaaagcccactcagctcaccatatgcaggcttagagaggatgttgctttttattttctcacaactaacactcagcgagtaccatgccttcaattcacttctgaaaacatgttcaagtgcttgtgcctcaccatgtgctttacatgcaagctttccaggaatcatgggccacaccacacctctgggtggttttaggcccatagctctatgctgataaatcctttctaattctcctaggatgtagaggagtctatagttactttgctgaagttcacaatctccctctctctttcttcgtatttctggctggccagaaagttatatcccgtcccccgcggggctctctcttttcccgttattcttcctaagctcctgctaaccatgtagatgtcctaaccacacacctgcatccacaaggaattagtgtagtctaaggttatgtcacgttaatgaaaatgcaatgggaatctaagggtagccatggaaagagaatatcctgacttagaagaatgactgaagcctgtgctgactttgaactttgaagttcatctcctcagatcgtttggttgattcactgtcattgccacgtgggccacagaggagacagatcctctctcacacagctgagtcctagagtaaacactaggcatttccccggatcccccacagaccgctaagaagccagacttctcaaaaagacataatccatacaggctacgacatagagagagtagattgatctaactccggatgatcaagtgtaaaaagtccagctttccccatcacacacccatcccattccaataaggctcaggaagacgagaaagggaggcgttcctttcatttcctgacttctgacctactataccgtggccagcactactttgggcatctatggtacaacattctccttcttaaggctttagacttatatatacttatttcaaatagttaggatttacaacagaatgggaaatatctcattaattctttttatgattatatgttgaaataataatattttaggtactttgagttatataaaatagattataaaattaattgcacctgttctttcttttaactgtgtgtaatgtggctgctacaaagttttaggttacatctgtagtccacattatatttttattggacatggctgatctagaatctctgaggttcagacgagagggagattcacctcccctgcctactccacacacattctcttgcttccgtcattctgtctgagcaaaatcttcttatccaggtgaggaacctgagcattaccttcagctttcaggtgagacactatctagagtatgcagccttcactttgcaggatataatgataatgtgctgtattaatacaacatcatagccacagctttcatattgcaaaagaaacattcacgtggaaatagggcgaagtaggaagagtttctaaaattcatttttatcatttttgttcactcaataaatacttactacaggtcaaatatgcaagataaataaacatagatgagatacaagttcacatgctgtggaggaaaaaatcaagtgcctcactgactacaatgaaaagaaacacatgatcagaatcacaatgacggataaaaagaatggcgaaagttgaaaaggattgagcatttactatgggccaggcactgtgctgatagattctaaatagattgacatttaattctcaaaactatactctcattagttgaaacttcaagtgattacatatcttgcctaacgttaagcagcttctaagtgggagagccagaatttgaacccagttaagccaactccagcacctgaactcttaatgtaaggcagctactcctaaatgtttgagaggcccagaaaatgtctctttccagctcagacctctgcaacttcccagggagaattgcagtaagttgggccaggaaatgtacatgccaacagattcactaacttcttaattcctatgcttgtttctagcataaagataacaaaactgtatcatcaacatgagagagaagcatgtctttctattataacaataatgaattactaaaaaaaaatttaaaaagcttaaaagatagaaggcttaaacaacaatgctaataagtgaaattgtacttgaaagaaatcatttctggtcacattggtagtgcattatcattcagatttaggaaaaacagtcatgttgatttgtagatggagtctatggaccaaacactgattgagagatcaaaggaaactacaaaaggtcatttatggttatttttattgctttcttattgagatcaaaatagacttcactatgattaataatgggatgggccaggcgctatggctcatgcctgtaatcccagcatttgggaggccgaggtgggtggattacctaaggtcagttcaagaccggcctggccaacacagtgaaaccccatctttatcaaaaatacaaaaattgtcccggcatggtggcaagtgcctgtaatcccagctactcaggaggctaaggcaggagaatcgcttgaacccaggaagcggagatggcagtgagctgagatcacaccactgaactccagcctgggagacagaacaagactctgtctcaaaaaaaaaaaacaaaaacaaacaaacaaaaaaaaaaacaaaaaaaccaaccaaacaaacaaaaactgggtgttatattagaattcctagcaggtgggactagagatttgggttcactttcatcttaaatagcacagtctgactaatcagcacttgaggagccactacccagatgatgtgactcgtggtcttagtctccctattttcatttctatttggtcaggactttgatttatactttaaaatgtctatactttttaaaagtataacatacatagggaaaagttcccaagtcataagtatgtacttcactgaattatcacaaagttagcatacccgtgtgaccactgctgaggtaaaactggcatccccaaagcttccctcaggcttcctcccaacagtaaatatactttaaactaatgcaagaataggcaaaattatagaaaacagttcaacagatcccccaagtttttaaatttcaaatctagactgaagaaacacagctctctcctgggatagttttctgcttgaacctgcatttattatgaataggtactacgtgccaggtgcaaggagacaattgtgaataacacatggcaggtttcgttgaggaactccactgagaagctagattatttcaatgtattttaactgtttatggtttgctggcatatactataggtaaaacatccagaaattccaagagttgtccatcagattaatggtctgtaaattagaagaaaggttttgatattactcctcattcatcaaattgcaagttgatgtattcattaagactctttggcctgtaatcccagcactttgggaggccgaggcaggcggatcagatcatgaggtcaagaggtcaagaccagactggccaacatggtgaaatcccatctctactaaaaatacaaaaaaattaacttggcatggtggtgcgcatctgtagtcccagctactcgggaagctgaggcaggagaattgcttgaacccgggaggtggaagttgcagtgagccgaaatcataccactgcatttcagcctgtcaacagagcgagactgtgtctctaaacaaataaataaataagtactctttggttacaagtaagaggaaccacctccaaccaggttaagcaaaagtataaaaaataaaaataaaacaaataatgaagcaatatctcatagaactcaaggttaaaaatgcagccatcaatcaggaaagtactggaactacgaattgggaagccttccgaattcttcatcttacacacttatgtccctgtaggtatctacttcattcttctccctctctgagtaccagttttctgtgcttccctggtccacatgatgaaatatggctagctcttggctccttaggttactggtagtttctgctacaattaaaaagcaacttgctgactctcagtctggtttcctattccagccccagctgagtcaaatgtccacttccattttggtcagccatgcccagggtagaaagtacaggcactgccacacggatgctaaggatggggtcaggattgtgggggcagggcttatgacccagaaagatgtctcaagtttaatgttataattcgaatccaactaggtttgactcaacagaaaccaaaaacaaaaaaagaaaaaaagaaaaggaaatcaaatggacatgtgaaattgatgtgttcagcttcactttatgtgccctgttttcattcgtgctcctgaagcttcttccaatttgatcaaaccattgctggcttcctgctttaggctggagggcatcttgatggcctggaagcccacatgaacaagatcactagttttaccctctgcatgttccatttttctaacatcaaatgtaccagttataaaattgtgaattttctcataaaaccgcccaccggagagaagcataggattattatctcttctcaaacagctgctttttcttcttgtagacccctgtaggtataagctaaagctcccttctcataagaaatgcttgtcataagaaagaaatgagtgtgaaaatgccttttgatagatcctctgtctacttctgctatggggattatttaaacatgaaggaatttcacgatgatttaaaattgactaccccctccatctccaagtgcttctggatcacttccccagctgtttaaaaagttgttgagctattaactgctgtggaggctgctctgagctccctttgaaatgggggtcccctggctgcagtacataatattaatgagcaataagtgattgcctgctgctctctacaccaggcccttctgggctctgacaagtgctgctgccgcctccacatggcctcctggcccaccatgcctccagagtgatggatgcccctatcggcacttctgtttccacagccgactgggtgtcttgcagtcagcctattccaagagcatggacgctgggagagctcttcgccttctctgtgctgtttgctgaagcgatctgagtgctctttaacagaaagcaattctcaccatccagcccattctatagatgagcaacaggaactagatccaaatcgcataaaagaaggcagaactgggtcctgaaccagactcttaaatcccagtttttttcccaggaaaagaggaagagtccatattaacattccaaaaccagacacgtaattaaatatttccagggcaaatgagcaactataaaatggtttcagtcaccctcttatacatttcatgtcacacaccaccctgtcactaaaggagcagaaaaaaatgcttcaagaattgttgtacatatgattctacattgtgagtcacagttagtaaaataagcaacttacttgaattgctataagaaaatgaaaaatcaatatgattttgctttttcatttcaataaatgtcaatggctgactttgccatgcattaacttttggttaatgactccacttttggagcttggttgagagctaagctggcttcctgccttccatgtccttcgactgaaaagcatggccttgactctttctctcctgaaaggaagagagatatctcagactgtgggagtggaagcatgacagctaccacatagatcaccactgtgtgtcaagcaccactgtaaaaaaatttttgttgcctcacttaatcctcacaacctccctctgaggcagggactgttataatcgtcatctgacagataagaatgctgagaggttgttccccttcctgtgtccatgtgttcaccggggcctgttgtggggtggggggaggggggagggatagcatttggagatatacctaatgttaaatgatgagttactgggtgcagcacaccaacatggcacatgtatacatatgtaactaacctgcacgttgtgcacatgtaccctaaaacttaaagtataataaaaaaaaaaagaaaaagaaaactgagaggttaagtgacttgtccgagatcacatagctgtaaaggacagaaataggattcaaacccaagcagcccaactccaaagtccatgttctttatcaatagactaatcctctctatgtagtatttgtgtgtcacagggaactcaggaatttcattacttgacccccaccaaactaatagctctgagcacatggaacctttcctctctagatgtgagaacttccatgtctgcctcccgaaaagcagctaattctacacttagttcagaggactgtttcaaattcaatgtataatttacttttttaagaattttcttaagagacaaagtcttgctatgttggccaggctggtctcaaactcctggcttcaagcgatcctcttgcctcagcctctacagtagttgggattacagatctgagccactgtgcctggctcaacttttcaattctgaaaaccagttgtaaatttataaaatttgaacctctgaagcagtgtttttcaaaatcgatcccatgaacccactgcatcagtgtctgcagggaatgtttgtttcaaacatggagtctgagcttcacccaaactcactgaaactgaatcctctaggagtaggtcccagtaatctgcatttttaagaagcaccccagccactcttattgacaagattgacaataattatagagttgcatctggaagtttcaagagctctgcacatcatcaattcaactgcagatgattgtagaaagcgttcaaagccactctgcattcaacagctatttcagggagaattacaatgtgcaagaactgttcctaaattgttgtagtctccttctgtgtgagccagctggttaagagagtttgaataatttcccaagcgactccagttaagtggacacttgaacactctgtacctatgaaaatatagaaaagacacagttttccaccctggacccaaagtgagtctttcagaatgggactctgaatcatctttcttttttgcttaaaaccctctcagagaacataacgtgaactatgagggcttacataatctggccatgcacacctctctggcattacctcacccactgctgcagcgactctgaactgccttcagttcttccagagtgcaaagcgctacagcatctttgcacatgatcctagggcatgttatgtaccctctgccccagcacctaattaggtctctcactcttccatcagagctcagcttcaatgtcactttctcaggacagccatcccaggcctgccacaagtcagggcatcttcttacctcccatttttcctcccgctattcttctttggcactcaccacagtttttcagtctgcttttgactgtgtggtaaacttatttcatcagtttcatcaagtagactacaaacaagagtcataatgttttgtgcattctggtgtttagccaagtgcctgctacatactaggcatgcaattccttgtggtgcatcaagaatgaaaaaaaattaataatgttggaggtaaagttttgattctcagtctaaaatttagcatccattctatcgacaaagattccgcatttttcatttctatctctgtctttaaatagcagtggagatggttaagattggaaagtctgaactctaaacttctttacacgttctagatccctttactgaatatgtcaacagctctaatcctgatgctaattttaaattgcttgtagtatggttatatagtcattacttgttaaaaggaaagttaatgaaagagtggaagtttctgattttgaaaaaccacaaggcaactaattatctatttcctcttttatttcaaaggctgaaatggattcttgttattgaatagggtagggaacatgatgagcctaactggtgatgagataggttttgtttaactgtatttttcatcaatttcaagtgtgtctttagtcagccatatgagctatcatgcctatcttttataagagtgttcctctatacaagaacatatctctcacaataatttaatcacagtgacttttgtttaagctaattttgacacaaaaatgatggattcgaaatgtgcctaaactataagtatgttaaaagctggaattgttcatctcctaagacccatacggcatttaaattattataaaacactgtcttctgggtatcttaactcaaaaaattacatcttacatgatacatatatcaaaacctaacaattgtaagtggatatccttccactcatttttagaacaccttcctaaggaagctaagtgccagtgacctcccaaattctctatgtgtttcatattatgcattacagtggaaacggattagagagccactctacaagtgggttagtgagcttgatagccaagcagtccagatcattatagattgcacctcatacagtttggttgtatatccctaaatattgtcaccttccaaagctaaaaatctaatattcatgtcacaaaaatctatgggaaattatgggtaataacagtgttcactaacaattacacttcacatctccagtgttgttaacacttttgtaggaattacctccctcagtccacacaacaacccaatgaagtaggtactgttagtaagcccattttatgaatgagaaaactgagacatagacaaagtcacagctacaccattactaagctcttttggaactcaggtagcccaactacagagcacccacttgtaactattaaactagaaaacctctcatatatacttatttaagagcgatgaatcagggatcttggtcctgcttgctttatttttcctttaggagatggtgtccgggggggcgggggtgggtacgttttattttgttttgttgtaagagaaaagctgaaagtgcgccttctttctttctgaacatctttttccaaagccttttaccttcatctggggccagaaaggacactggttccacagacagagcactaatgagcttccctctctatctccctctctgtctctccgttctgcagttaatagccaagataccaaccatcacggcagtttgcaacttgcacggggagaagctgcaggtatttaagcaatctcatccagagatagtgaatacactgtttcctccgttatacaaggagctctttaatcctgactgtgccaccggctgcaaatgaaggggacaagagaactgtctcatagtcatggaatgcatcaccattaagacaaaagcaatgtgttcatgaagacttaagaaaaatgtcactactgcaacattaggaatgtcctgcacttaatagaattatttttcaccgctacagtttgaagaatgtaaatatgcacctgagtggggctcttttatttgtttgtttgtttttgaaatgaccataaatatacaaatataggacactgggtgttatcctttttttaattttattcgggtatgttttgggagacaactgtttatagaattttattgtagatatatacaagaaaagagcggtactttacatgattacttttcctgttgattgttcaaatataatttaagaaaattccacttaataggcttacctatttctatgtttttaggtagttgatgcatgtgtaaatttgtagctgtcttggaaagtactgtgcatgtatgtaataagtatataatatgtgagaatattatatatgactattacttatacatgcacatgcactgtggcttaaataccatacctactagcaatggaggttcagtcaggctctcttctatgatttaccttctgtgttatatgttacctttatgttagacaatcaggattttgttttcccagccagagttttcatctatagtcaatggcaggacggtaccaactcagagttaagtctacaaaggaataaacataatgtgtggcctctatatacaaactctatttctgtcaatgacatcaaagccttgtcaagatggttcatattgggaaggagacagtattttaagccattttcctgtttcaagaattaggccacagataacattgcaaggtccaagacttttttgaccaaacagtagatattttctatttttcaccagaacacataaaaacactttttttcttttggatttctggttgtgaaacaagcttgatttcagtgcttattgtgtcttcaactgaaaaatacaatctgtggattatgactaccagcaatttttttctaggaaagttaaaagaataaatcagaacccagggcaacaatgccatttcatgtaaacattttctctctcaccatgttttggcaagaaaaggtagaaagagaagacccagagtgaagaagtaattctttatattcctttctttaatgtatttgttaggaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaacaagctaagagagaagtttgtgtataagacaatgaaaattatggtctcctgtaagtatatcccagccaccaactcctaaagaactgcccttttctccatattaaacacacacacacttacacacacacacatacaaacccctgctttgtaaagtttccatcagtggaaactttgatttctttttttaatctcttatgctctcctgaagttcatggttgagcaccatctccaagataccacagaactcttgattgatgatcaaaacagtagtgtcatcttttccttttagaaaacggaacattttctcacctcatgattgatgaattctaaaccaatggggaaaaacaaaaaggctttaaaataatgaatctgtttctcaactactgttatattcaattaatttaactacattgaaccaaattacctttggttctaagaagacagctgtagactgcttattatgctgctacagggact

SEQ ID NO: 15271 - DNA, 38566 bp, Human
  misc_feature (1)...(38566): n = A,T,C or G
gctggcttcacccagtcccgcgccgtgcgcccgcactcctcagcccttgggtggtcgatgggactgggcgccgtggagcagggggcggcgctcatcggagaggctcgggccgcacaggagcccgtgaagcgggtgggaggctcaggcatggcgggctgcaggtcccgagccctgcccggcgggaaggcagctaaggcccggtgagaaatcaagcgcagcgccggtgggccggcactgctgggggacccagtacaccctccgcagccactggcctggatgctaagcccctcattgcccggggccggcagggccggccggctgctccgagtgtggggccgccaagcccacgcccacccggaactccagctggcccgcaagcgccgcacgcagccccggttcccgctcgcgcctctccctccacacctccctgcaagctgagggagcaggctccggccttggccagcccagaaaggggctcccacagtgcagcggtgggctgaagggctcctcaagtgccgccaaagtgggagcccaggcagaggaggcgccaggagcgagccagggctgtgaggactgccagcacgctgtcacctctcaatgccaggctactttttttattttttgtagagacagggtcttgctatgttgcccaggctggtcctcctgcctcagcctcctgcatatgacttatttgtctttgcaaagtataactaccaccacttgactgacttttaggagtgctgtgctgtgctaagcacttcataatttatctcagtcaatcctgtgctatgtctgagataagtaattgtgcctaatttgcaaagaagaaatgattctctcaaaggaaagtgattgttaaccaaaaactggagagtgatgagtccagaatgtaaactcatgcttttctcattgcaatttcactacatcatgctgttccctctgtatgacatgttgatgttgtgctcctcctggaaaactcctatctggctcaactataattactcctgttaattctttcctaactgaggcagaagtaatcactcttggttactgtcctgattctttgtatgtacatatttcaaagcactttttaccctcctgcaactgtttatctaattctttgttttgtttttgtttttgtttttggagacagagtcttgccctgttgcccaggctggagtgcagtggtgcagtcttggctcactgaaacctccacccgccacgttcaagtaattgtcttgcctcagcctcccaagtatctcggattacaggtgcccaccaccacacctggctaatttttgtattttagtagagacggggtttcactatgttggtcaggctggtctcgaactcctgaccttgtgatccccctgcttcggcctcccaaagtgttgagattacaggcgtgagtcactgtgcccagcctgtttatctaattcgtataggagaatcagagttcctgtagggctggtacctagtccctttcttttagttgtgttgctgaacattacagcatagtatacatttgtaagttcacaagaaatgtttgttatttgaaaaagagtaaatggtgaaaactttttcacaaaccagatagaatggaatccagattctacgtgcatgaaatataaaatcagggcaaacacaagcctgcgtgttcattaggctgcgtctatgtatttcctatgagtgatactcccccagataaactttggatatttccacttatttgatggactctgagtgtgtgtgtgtgaatgtatgtgtgtgttaatgtaaaccaagctacaaattagtagatagaaccatgttattttttatttgaaacatcataaatagccaagcttacgcagaaaggggataagttgtatcctttactcccagccccctctgaagagttcggtacagcaaacatgtaccaggctagctggttgacatagtgatgcacgaggcacagttctcacattcaagagtggtgagtgacaggagcccttggaaacatgcttgagagtcatgcccagatattcaagtccacatcaataagggtgagcagacggcttggaaaggtgggagcacgatcacaaactgcagcttggccagtccaagctgggcacacctgccgcatgcaggcctcactggaattcaataatgataagcaaggcaatccttccagtgaacgcaagtaagcatatacataaataggaatcgtgtgactgtatatggtgcctacatgtggtaagcattccatagtattgctgttgcattgagatatttccattgtgccattctgagtggtagatgtgtagaaaacttggggggcagtggcattgcaaggggtggcttaatcactgcctatcttaaataaagatctttcttttttaagactgtgattatctctaaatgaaagggaacgcttctcagctacccttcatcacactcagcattgcaaaatttgttgttgttgttgttaggaattgggagccgtgaataatgccaagtgcctacctaagagccagtctggagatgtttatttttggcagaagttcaggctggatattctaaagagtcctttccctgaaaaacatctacgtcctccatacaacatgttttttttttcttttgtgcatttctgagctcaccggaaatcagagaaatatcaaaaggggcaattacaaaataaagaaaataaatttttattgtaataacttgaattaaaatcagggccctaagtactaagtattagtcacataaactattattcagtaggtattattcacataaaagtatctatcaatcactaggtattattcacagaaaagtatcattcactaggtattattcacataaaatatcattcactaggtattattcacaggaaagcttggtttctctgagggccatatgccagcagcaatccagaggcagcagggccatgggcaggggagggggaccccacaaaggcgctgaagtggctctagctcagacgtgctccctggctcccagcagaagaaaattcaattcctctctgcagaaaagtatttttaaccgcttagtgtctttagacattctattaagacaagtatttttgccattaaaatgattgaatctatagtcaaaattgtttgtacagagaaatcagcaggcccgggtggctttacaagtaaaacatattaaaaaaaacaagacatccagaaatacaattagtgagagatgtttgaaaccactatggagaataaaaaaaaaaaaaaactatactgaaagataatgataaagacaaaagaaatgaaaagattctgtaatatgttcatggatggaaagaatcaatattaccaagtttgcgacagtacaatcaatagtataggctagactcaatccaattccagtcaaacccccatagattcttttctttcttctgccacttttgacaaacatgacaaaaatatgattctaaagttaacatggaataacaaacatataatagacaggactctgctgagactctgagagcagttcttggcggatatcaacacaggctgtaaagcaatgttagttaaggcacgggcagtaggatccacaaactgaacagaggaacgaaatcacaagtcgagaaatagaccctcacagatagagaaaactgaaataagacagcagtggtgacattgcctgtaactgaggaaaagatcaggtttccaaaagatcaggtggggacagttggtcatccatgtgaggaaaagctggatccctactattaccatacactaaagtaaattcctgatgggttaaagacttaaatggaaaacaaaaccctctttacatgttttagaaaaacaattttataaacttaatagtgaagaaggatttttcatatgacctaaaagtattaaccataaaagactgttcactatatgaaatatttgagtacatgaaaatgctttaggccgggtgcagtggctcacgcctgtaatcccagcactttgggaggccgagattagtggatcacctgaggtcaggagttccagaccagcctgggcaacatggcaaaaccacgtctctactaaagatacaaaaattagctgggcgtggtggtgggcgcctgtagtcccagttactcgggaggctgaggcaggagaatcgcttgaacctgggaggcggaggttgcagtgagccaagatcgcgccactgcgctccagcctggtgacgagagcaagactctatctcaaaaaaaaaaaaaaaaaaggaaaagaaaatagaaaggagatgaaaaggaaagccataaactgggagaggatacatacatacactacatttgaccaaaaaatccctacctagcaaagaaaacaaaaaacaatgggcaaaagacatgaagaattatttcagagaagaaagcccaaattacaaataaccacaaaaagtaatttaccctcattagcttctcaggaaatacgtcctgagatctcaatgacgtattattttatcaacagtagactggaaaaaactaagatctgataactcaaattgtcacaacagctttggaaaccagtatggcagcatttcatgagtttgaatacttgtctcgtccttaacccaccaatttcatacccagttgtaaatacttacatgggtgcacaggagacaaacatgaaaattccatttatcattgttcacaacagaaaaaagttctcaacaacccaaatgtccactgatgcaaaacaaatgcataaatattttgtgctatttcacatgatggaatatgatttagcagaacatggataaactgttacagaaaataaaatatcttaaaaatcaaatattgaatgaaaagagcaatttgctgaagacagcatacagcctggaaaaatatttagtgtaacttaaaaacaaacaaagctaaacaacataatgttagagatacagataatgttgggctagcttttaaaaaataaacatttttaaaagagataatgataagcattacctctgggggaaagacaaagtaataatatgaagaagacacacaggtagcttcaaggtattttgagaggatgagttcacaggtgtttattttattattgtgcttcataataggtaacatatagcttacttatgttcttttgcctatatcaaatattataaaatacttttaaagaattattattaagacattatttctttagccaaacaaatgactttgaatcaagcatattaagtagcttctgtaacaccttatttccaaatagcaacagcaaatgaggccgcaccagataaagaagccaggagacttgtgtcaaaacccacttcacacacggattggctctgtgaatgtaggtgagtcatgcaacttctctgaaccccagtttgccatctataacatgaagattaaaataaaattctgtcctgtcaactttataagcctgttacaaagaggtaatataatagtgatttgaaaattgtttagtgtgaaggtgctattatgttagtaagtaaatgtcatcgcccacgtgttgtaaaattttgatatgcagcgttgtagacatagaacagcaaatgggagcaacttctacaaagagtggcagctggaaacattttctcccaaaaaggcgctgactgatgaccgtggagcattgaggagggactccggaaagaaaaaccaaattatcttggtttcaatgcaaatgtggggtctttaggattttgaaaccgttactgtgactaataataacagtggcagcatatataataaaatgagtcctgaagtgaggtttagagccacagcttgaactcaactttatcactgattagctttgtgaccagggaaactcaatctttgagcacctcttactccacatctgtaaagtgcggctgattttatgagctctgatgttttctccaatgctgatactatataattccaaggctctgtagaaatttgtttgacaatgagctgaaatgtgcagtaaaaaaaaaaagacgatcctcacaaacaacgtcttgaatgtttggcttttacaatctcctaagtggttttacatgtcaccttctttcagacgatcccaaaattccagcacattacagaacgtactatttgatcatccttataatgccgtgtttcttttcaaaaccaatactgaatactgaattcatccatcagtctgtgcttggatacttgagcgacatgaaactatttcagaagagagccgagtcccattgtgagtggttcttactagtagaaattatcttatgagaactctatctaatgttataaccatctggaggcacttggccatctgctccccatagattttcatctgccctttcaaaccagccctatggccaggcactgttcctgctattttccacacgtcatttgtcccagctcactcaagcagtctggacccggagttcaggctcacccatcacgttttgtgtagtaggacttatttccaaatcggtgtacacttttaaaaattagtagactttattttatagagcagttttagatttgcagaaaaattaagcataaaatacagagggttcttatgtattcttctcctacccttccaggttctcctaacatcttgcattagcggaggacatttgttaaaactgatgaacatattgttacatgattcttagctaaaatctgtagtttacattagggctaactcttggttacatgtagatgttatgggttttgacaaatgtataatgacatacaaccgtcattatagcatcatgctgaataatttcacagccctaaaaacctcgtgttccacccatccatcctttccttccacctcacaaatcctagacaatcactgatttttttttttttagacggagtttcactcttgttgcccaggctggagtgcaatagcacgatctcagctcaccacaacctctgcctcctgagttcaagcgattctcctgcctcagcctcccgagtagctgtgattacaggcatgcatcaccacatccagctgatttttttgtatttttagtagagacagggtttctccgtgttggtcaggctagtctcgaactcccgacctcaggtgatctgcctgcctcagcctcccaaagtgctgggattacaggcatgagccaccgcgcctggccactgattttttttttactatttccatacttttggtttttccagaatgtcatagttggattgacgcagcatgcagccttttcagattggcttctttctctttttttttctttttcttttttttttttttttttttttttgagacagagtctcactctgtcacccaggctggagtgcaatggtgcgatctcgactcactgcaatctctgcctcccaggttcaagtgtttcccctgcctcagcctcctgggtacctgggattacaggtgcatgccaccatgcccagctaatttttgtatttttagtagagacggggtttcaccatgttagccaggatggtctctatctcctgaccttgtgatccgcccacctctgcctccgaaagtgctgggattacaggtgtgagtgccgggcttagattggcttctttctcttagcaatatgcctttaagattcccccatgtcttttaatggcttgatagcttgtttctttttattgctaaataatattccattacaaccttgtcctacagtttgtttatttattctcctattggataacatcttaggtgctttctagttttggcaattatgagtaaagcatatacaatctacattcaggcttttatgtgtgcatagtttttcagccctttcggataaataccaagacatgcattttccatgttatatagtaagagtttatttagttttgtaaggacaaaacaatgaatgagagctcctgttgcttcacatcctctctagcatttggtggtgtcagcattttggattttagccattctaataggtatgtagtggtgtcttattgttgctttagtttgcatttctctaataacatgatgttgagcatctttccatatgcttatttgctacctgtatatcttggatgaggtatctgttcagatctttggctcattttgtaattgggttgtttgttttcttattgttgagttttaaaagttctttgtttgtaatcccagcactttgggaggccaaggcgggaggatcacgaggtcaggggatcgagaccatcctggctaacacagtgaaatcccgtctctactaaaaatacaaaaaaattagcccagcatggtggcacatgcctgtagtcccagctactcaggaggctgaggcaggagaatcacttgaactggggaggtggaggttgtagtgagctgagatcgcaccaccgcactccagcctgggcgacagagggagactctgtctcaaaaaaaaaaaaaaaaatagagttcttagtgtattttggattcaaatcctttatcaagtgtgtgtttttgcatgtctgtggcatgtctgttcattctcttaacagagttttttgcagagcagaagtttttgattttaatgaagtctgacataatttttttctttcatggaccatacttttggtgttgtatctgaacagtcatcgtcatacccgaggccacctggattttctcctattatcttctaggagtttcatagttttacattttacatttagacttttgattcatcttcagttaattatttgtgaaatatgtaagaaatatgtaaactctgtctaattcatttcttacgcatgcagatattccagagccatttcctgaaaagactatccattctccactgaaacgtctttgcgcccttttcaaagattgcttgatgggatctgtgcgggtgtgggctgtctactccgttccgctgctcgatttgtctatttcaaagattgcttgatgggatctgtgcgggtgtgggctgtctactctgttccgctggtcgatttttctattctttcaccaataccacattgtcttgattactatagctttacgataagtcttgaagttaggtaatgtcaactcttcaacttggttcttttcctttaatattgtgtctagtcatctggatcttttgcctttccttgtaaatttagaagatgggtcttgttaaggagcacaaaatgctctgggcatatctcaaaacggctccctttgggaagcaagaggggatttttctcttttctcaccatgagaaccgcagggcttctggaggtaaaactcacaaaagtgtgcccccaccccagaccaggcccccttctggcatttttaatgctcaagcttatctacaagagccttcagaaatttgtcaattgcagtctaagttttcctaccccagtactggctccagtggcgattgctgctcctgggctgtgtttgaattaagctataattctctgggtttgtctgtctgcctctccaattttaaggcggtggcatgtccagtgacctcaattctctgacggatccaagaaaagttgctggtgtccagttcattcagctttgttcctgttgttaggatgtgagggatgatgtcaagctctttatgtgctggactgcaaatcagaagttcagagtacacttttgcaaatgagaggcatttctcaatgaaataataaagcttattttaaaaaataaaataactttttctttaaagtatgcttaggtatgaacttagtaccattcatattgcttcttttaatttgcattcattgttgttttactttagtgattattagaacaatgtattgttattaaataaaatatcatgtggtatttttttaaaatagtccatataatttcaccattcatcaataatcattgttaatattttcatgtatttcattctagtacaatctaattttccttccttccctctctccctccttctcttactcatttctttcttttcacctacctatatattcaaaatgcttgttatggcacatatgtgtatatatatgtgtacgtgtgtatatgcacaagtgtacaatttaactttattctaatatgtaataaccacatttaatgtataattatatatacatattatgcatataaactaagctaattctatctatctatctatctatctatctatctatctatctatctataattttaatctagtcctagatttgagtcgaagtcttccttctcattcacactgattatctggcagtcagtgctcttgggattgaaatttcaggccagcatggcatcccaaattctctgcgtttcctctaaagattccaactgtgcaaataattgctgaaagtaaaatgcttcaaaatgtaaaaataatgatgtaatacagaaaagtgactaattctaccattttattaaataaatggtatttcattgagaatcaattctataattttacttttacccaaatagctccaaaatatatatttgcatatatatatagaaaatatatatgcatctattatatataataatatatatttatataatttataatatatattttaatatattttatataatttatataatatataatatataattagatgcatatattatatatgtataatagatgcatatatattatatatatataatagatgcatctatttttatatataataggtgcatctatattaatagattcatatatataaaatagatgcatctataacttagatgcatgtacatatgcaaatatatgcatctatttatttttgaaacagcatcttgctctgttgcccaagctggagtgcagtggtgcgatgatgataactctctgtagccttgacctcctgggctcaagcagctctcttgcctcagcttcctgagtagctgagactacaggtgagtgccaccacacccagctaattttttgcttttgtagagacaaggtctcactatgttgctcaggctggtctttaactgggctccagcgatgctcctgcttcagcctgctgaaatactgggattacaggcgtgagccactgcacccagccttgcatttgttttactagaatacttatgatttagtgaaatgtgacctctatgactgctatagtagctgttgaatgtgagcccactccactcaacacaaggattcagtggataagaaactccatctctaccaataaatcccttcacaggtgttgatggtgttatagcttgaatttctgctgcctcaaaaaatggggtaaataggaaagctaaatatcaccaattttgttacagtgtatgagctgaaataacatcttccttttttttgattttcaatacggaagaaaagtaagaatcatttctaaagtgcccagaaacacctgagcctcggtccaggtcctcaataactccgatgagagaatccatttccagccccttccctgcagtaggcacagcacagaaacccgactccttccgtctgcaggaaataagagatcataggaacaccttttaaaattgtggctggcgcctactctacggaggatcctcaacctccagactgaagtaaatgacagaagcttttccaaagaagtctgaattatttcaaaattatagaagataaattgtgagcatggcggggagggagcatgtcagtgtgcctatcacctaaactggaggtaacgggctaacggagagcccatttgccgggaaggccaggcgatgccatgtgaaccaccaacgctcaagtctgtggttaaaacccaacgagttgacttctcacttgtgcaaagtcctctgtgtgtctgggcaactttgtagttgactgacccccgggtaatcccaagtgagatttctccccatgaatccaagtgatcgtcacaacaggaggcaacatttcttgacctttttattttttttagatggagtttcactcttgttgcccaggctggagtgcaatggtgtcatctcaggtcaccgcaacctccgccttctgggtccaagtgattctcctgcttcagcctcccgagtagctgggattacaggcgcacgccaccatgcccggctaattatgtatttttagtagagatggggtttctccacgttggtcaggatggtcttgaactcgcgacctctgctgatccgcccgtgtcggcctcccaaagtgctgggattacggcataagctaccgtacctggcctatttctacacattttataccaacaagtaaatacatgttcctgcctattaagctatatttaagctacattatttttcaccacaattcattcatcagaaatagtagcatggctctgcctaattgcagcagaatcggggggtgggagaagcccagatggagaggaggctgaaatatgaatgagccttagaagtctccgctactgtacattagctccagcccagccttaatttccccacttctgatttttgccaagcaaagctcccctgccagctctcaattcaatcttacgtagttacaattcatagtaccaacggtacgtggaaaaattccattcagtatactctcaaacgtgactcttcatccataagataaaattaaaattcagctgagtgattggagatccctccggcagcaggcaccgtggcaggggagtggagagtattgctgatggggtcagagcaagcctgccagccagccctgctccttattgagggagtgtccacagacaagccacctaacccgtcagagtctcggcttcttcattcataaaacagggaaaataccatcagctcttgcatgttattgggaattttaaacgagatcatctttatataaattagtatagcaccaggctcacaataaaagcatgataaacattgctattacatcatcacaatccagatctaaagcaatcctatgacaagtttgggtgatggcagtttacgaatagggtggtcctgggatattgtcttagtgccatataaaattgaaaagaagaaggaagaagaagaagaggaaggagaagaggaagaagaagaaggggaagaaggagaagaggaagaagaaggaggaggaggaggagaaagaggaggaggaggaggaaggaaggaaggagagaaggaaggaaggagagaaggaaggaaggaaggaggcttttattcacatttaaagaaacggcaacacagaagacatttgttttagcagtctgaaggttaaagttctactttatttattctattactgatagagttaggagaacacaaaggcaggccaagagaggtgctgggctccccacatgtgagcaccttccacggtggaacaatcccacctctggagccgaccacgcatgtggagtgggggttgggcacacagggaggctgcagttgccacagcccaattcaatgtgtcctttgatgcaacaactaagatacggataatgtttcactaacaaaagtgtcagaatcctcctttttgaccacctacagccattatttgaatctttcaatggtccaaattttacattattaaaaattagtgaatgtgtttccactcttacagaactagcctgagaccaattacaaagtttgccttgtgtcttttccagctacagtttccggtgtcctttccttcttctttccttcttgccacaggtcctcatgctgtcctctggctcctcagagccatgccagccaaacctgtcctcacagggtaataactgggtcatggctttgaacctagacatagaatttatgtctttcacaaagattaactcaaagtgaatcataggcctaattttaaaatgcaaacctgtaaaacttccagaagaaaacatacaataatttatatgaccttgattttggtgatgaatttttggatacaacatcaaaaatacaattcatgaaacaaaaaaaagtaagttagactgcattaaaattaaaaactcctactttgcacaagacactgttaagagatgctggtgaggttgcagagaaaatggaacgcttatatacagctggtgggaatgtaaattagttcagccactgtggaaagaagtttagcaatttctcaaaaaacttaaaacagaactaccattcgactcagcgatcccattcctgagtatatacccaaaggaatacacaatcattctaccataaagacacatgcatgcatgtgttcattgcagcactattcacaatagcaaagacatggcatcaacctagatgcccatccatggtagactggataagaaaatatggcacatatacaccatggaatagtattcaaccataaaaagaataaaatcatgtcctttgcagcaacatggatgaagctggaggcagttatcctaagcaaactaacgcaggaacagaaaaccaaatactgcatgttctcacttataagtgggagctaaacattgagtacacagggacacaaagaagggaacattagacaccagggtctacttgagactggggggcgggaggagggggaggatcaaaaatctacctacggcacaccatgcttattacctgggtgattaaataatctgtacacccaagccctgcaacatgcaatttacctgtataacaaacctgcacctgtacccctgaaactaaaatagaagttaaaaaataaaatcaaattagaattggaaacaaaaagacactgctggaggatgaaaagacaagccaaagactggaagaaaattttgcagaacacatatctgataaagggcttgaatccaatatatataaagaatgtataaaactaaataagaggacaaacaaccccattaaaaaaatgggcaaaggtctgaacagacacttcaccagcaaatgagcataagaaagatgctcaacatcatatgttcttatggaaatacacatttaaaaagaatgagataccactgtagacctattaaaatggctaaattttttttttttttttttgagatggagtttcgctgttgtcgcccaggctggagtgcaggcgcgcaatctcagctcactacaacctctgcctcctgggttcaagggattctcctgcctcagtctccagagtagctaggattacaggtgcctaccaccacacgtggctactttttgtatttttagtagagacggggtttcaccatgttcgccagcctggtctcgaactcccgacctcaggcgatccgccctccacagcctcccaaagtgctgggattacaagcatgaaccaccgcgcctggccttttttttttttaaagctcattttaaaatgtattctcttggcactgttttgtatgccttagagtagatacaaattttgtccaaagagacatggcagcccttctcctgaaccacaaaaagctacaactggttttcttccttcatggatatttgttcattagcaatccatcagaagaacgaaaagagcagctgatttatctctaataggatactttgtacacctaaaatatgccaagcactcctcaaaatgtactttctacgactcgtttaaccctcacagtgacttaggtaactattgtcatcaccatccccgtcttatgggaactgcgtcacggaatgggtcagtaagttgcccaagatgacccagtcagtaaatggtagagggaagattccaattcagaacgtcaagctcctggccccatgccttcactcctcccacagcggctgattctacagcaagtggactggcaggaagcagttccaggactgtctcgggtgctttgttccttttctccaccatgagaatgtcgcctctgccactcctgtcttgcagaatgtcttcccaacattcacctgcttccccgtgcttctcagagtgtggctcctgaaccagcagcagcagaggcgcctgggaaattgttggagacaccaattctccatcccaaatctacccagtcagaaactccagggatggagcccagtagtaacaaaccctccaggtgattccgatggaaaagaacgtctgacaaccattggcacgcccaaggacaactcgcttcattgttctgagcctgggtttctgttaggagagcgtgtggaaccaagtatctcaacatttcttccattgtgagcagctggttctgtggccagagtcagatacccacaggggcacgtgaagccaaaaatggtggatactgtgtggcactgcccagatccccctcagaactgaggccagaatctctcctgctgtagtgactgacaatggcttctagctgggtttctcttcaggaatggtcctcagcagataggatcaagccaaggtcacgcctccttcccttgccaggagtgggcaatagggtagacctcctgttttagtttgggacaactcgcttggatccctccagttccagagcaccctttggggttggctggggctctgtccccaagtccctctcttgcagcacaacgtctttgcaggcattggtccccactgcatgtccccaaatctcctgcatgcaagtctccatcttacagtgtgtctggggaacctgacctggggataaagtttaaaatgatttttactataactgatacagtgggctgggatgaggtcggggacaggattggactaaccttaaactggaatccatgaaacataagctttgtgcaaatgatcttctatagcaatgacgaataactcagatttggctacaacagatttaaatattttaactcatattttggatatttgcacagaacatagttaaattatgtaatgaagtgtttctttctcctctcatctcccctctttctctgaaccctccctctcttccctaccctcaataggctgactttgttggagcaaggtgccctcatccctgtcacatttcacgaagaattgaagctgtgctttatgttgggctgtgactgccactgagctcttttttctttgcccccagcattgcacactgacctatcggggtgggctcctcaggccccggctagacactgtccaggccagtctcagggctggaacactgcagtactgaaggcttggctgcagcaggaggtccacttaacactgaagccacaagtacctcattcttagccaagccctgccatagctgactcagggaactttctgaatttgttttcctacaagtagtgaatttcactggttttaaatttatttcctaagtgctcaggggctcctcagagggcctctgtttccaggtaaatgcatgaagctgaatcttccttccagccctccccagcagcctgccttcctctcatttctatggcaggcttccatgtaaagtttgtccaaaaacagttttggcaaacaagaaatccacttgagagaacagctatggttccttggagttttgtgggtttgagagatgacaaatggatgtttgtattagcctctctagaaaccacttccattttaatcagaaccttggctttctataacctctttcctcgcgccacccctggccccagaggcattttgagatgaagtctttcccggtctggtgaacctcactccacagctctctgctcagccttgagcagtatcagtgccagagtgccagtctagcctggcaggcacaggtgatttgagcactagcaaagctggaacacttcgcctcttaaagaattttatatttgataatttaaaaatgcattgaagaggaaaaagctaaaacacaggaaaaactaaaactttattggattttgttattctttgtaggctgttgttaaacgtgtgtgtgtgggggggtgtgtgtgtatgtgtgtaaaatttaaaaaatctatttaattccatacagcatagaggcagggagtggccaaaggagcaccatgagggtttcagtgcctctacaagtttgaatgcagccctagctaccatcaatgcacttcatcacacgctacctccatgtcaaaaataattttaacttgcagggcccagcttattacatcacaagcatccacagtcacgaagtttagtgtacatagataggatggtataatatgcccaagcctctagagctgtgccgtgcaacacgatagccgctagacacgggaggccattcattcgatagccgctagacacgggaggccatttaaatttaaatttcattaaagcaaattcagttccttggttgcagtagtcgctttacaagtgttcaactgccacatgaggctagtgacgctggacagcacaattaaataatatttccataactgcagaaagttctactggacaatgccgctctagcagtaattaaagcaatattgtctgagataagataaaatgttgagagttggtgctaatgtctagtctatggagtgccaaatgaatttctagaagcctctaaatcaaaggccatatacatttgcccaagaggtggtttcatcttacggaatcgcctagctgatagttagcttcctacaggctggctgagggtatgtctaattttatacccccactattctctggaacatgtaaacacctgcctcaatacataaaacaaatagaatacacaggaattcaatgtatgttgttttccccctggctctcagagctatggactctgcaaaatagccaagatcttattgttttggttgcattaatatctgatgctgcagatttttgaatacattcttgtatgcaataatcagcaacctttattcagcatttatagggagccaaacactgtgttaagtgcagggagtaggtagaacaatgagctcagggttagtggggacacacacaagcctctggccataatgcaatgtggcaagttctacacagaggcacagaccaggcaacaatgcagcaagaggggcgtcatcctgagaaagcttgcaacagcttcatggaggaggtgactgataactcagttaaaagacacaagcaggtggatatggttattaaggggcaggcagaagcaatgacaaatgctgtgccccagagattgaagcagtttgacacttttgagagacagaaggagatttaacttggctgggcggggcataagaagcaagtgaagtggggagtgagtgaatgaatgaatcaaagaatggtgcacgtctattccagtaacatcccacatcctggccagaggcccttgagaagcccagcgacccttccgtgggcagagttgggaacgacatgattctgcttgcactacaattatttgtgatatttctttctgtcctcattgaactttcttaatagagattactacttatcaggaacaggaatgctttttccttactgttttcctcttggaacctagctctgtacccaacccatgataggtatcaaatatgtgtaaaaataaattgaaaatgaaaatgcaggctagcaaatagggtaattcaataaatattgaaatgctttgttttcacttctgcatttgaccaagaacatggctgagacccacagggactctgcctccaggagagagacctgtgtgactgcagaccctgcaggaccaccggcaaccctggagcaccaaagcattgcatggggccaggctggggcggggcacgcagtgttaaatgggagagctggagaaaattccacgaggaaaaacaaatggaaaagtatgacccctgcaacaacaaaagcccctcctctgcatcgctgacaaacctcacgcgagttggacaagcatttttttaatagaaaagaagctggctttattctaacatgagcaatattgagagtcttctctaatgttctgtttctgatggaccaaaactgatgtgctggggagcggatccctgccgcccgtgctctagcaggtgagatctgggtaggatgtggaggtggtggcagttttccagcctggccacgtgggaggctggaagcaaggggagcgtggagcagctgaaatcgccttagcaggctcttgacggtagagagtgaatgcccccccattctctatgttctgaataagaatttgaattatttagctcaatatcatcttctattttgcagcaaaatctagtcaaagctagttttcaattggatttctttcttctttgttggaatgaaaattcacagtgtcatttcattctgctcaggtcactggctctgccaaaaaccagagtctcactccggaaatcagcctttcctttcttctccttcgagtgtgaatcatgacctcatccttcacaacctcggcagacatttcttgtatgttagtgatggagaacagctgaatggggctcaaatgagacccaaaatgagaaaggaaagcagactagcgggtatgacctaatctctaaaaccaaaatagagaaataatttaggatacaattaattactgataggcagactgtcagaaaaaggaccttgatacacacacacccacacacacatatatatattatatatataatattaatatatattatatatacacacaagtgtgtgtatacatgtgtatgtgtctatgtgtacatgtgtctatgtgtgtgctagacactcttctaggcataatcagttgcattatttgttttcaaaatggccttgaggcatgtatgattataatggcagtcagtacagcgcagtgctgggatcagcacacttttctgggaaagcaccaggtagtaaatattttaggctttgtgaaccacaggatcgccccttcgattactcaactctgttgttatagagcaaaagcaccatatgtgatgtgtcaatgaatggttatggctgtgttccaataaaactttatttacaaagacagcaggccagatttagttcggaagccattattagctgattcctcaggtggtggggaaaggtgtagattcaggagcagatgctatggatttgattttctagcctacttcttactcgcttctcctctaatttttaacctctatgtgcctcagtcttctcctctgtaaaataagaataagaatagccaaaattatatggaaaaagagaattaagttggagaactcacattgcctaatttcaaaagtgtaagtgcctatacactgttagtatcacaaagggactttgtagtctatttccagctagagatgggtggactgagattcagcaacgtgaatacaaatctggtgaaacctcttctactgtggctctggaatctgaattatgccacaggacagacctccataaaggtgttcaagtgcactgatagggaaattccaaaccatctgcaaagccctggacaacactgtggcaggcctcccctgtcatacctaccggaactgggtcctgggtagcgctgtgacagggctcccctgtcatatacccaccggaactggtcgttgcatagtcaaaaaagttcattaaaagggaaacgagattacagtagccataaaggaaagagtaaatagaaaaatcaataaaaacatgtgaattctttgaaaagattaataaaatcgacaaacctttagtgacacttaccaggaaaaagagagagagaacaatcaaattaataaaatccagaatggaagagaggacatcagcattgaccttatggaaataaaaaagattataatggaatactatgaacaattataaaacattatagtggaatactatgaattgtgcatgccacaaattactcagatgaaatggacacattcccagaaaaacccaaactactgacactgactgaagaagaaatggatatgcttgaattgtgaattttaagacttcaacagagaaaatcccaggcccagaggggttcactgtgaattctacaaaacattcaaagaatgaatactgattcttcagaaactcttccaaaacatacaacagaagagcacacttccccactcatgctgtaaagctagtgtcaccctaacactaaaaccaaagacatagcaagaaaaaaaatcacacagtgataacccttatagcctaaaaaaatccttgacaaattattagcaaccttaattgcatcacatattaaaagatcagacactgtgaccaagtggaatgtattacggtgatggaaggtcggtttaacatccaagagcttatcagtgtaatgcatcctattcacagaatacagcacaaatcatggccatcatctcaatagatggaagaaagtaatctacaaaatctaaaaccttttcatgataaaaatgcttaacaaactatacatacgaggaaacttcctcaacttgattaaaattttagcaaactggacataggaggaaactttcacgtcttggttagaagcatctacgaaaaatccacaactaacatcatatttactggagtgaaactaatgctttctccctaatatcaagaacgagacaataatgcctactctagccacttctattcaacatcacactagatgttatagccagggctattataaaagaaaaagaaaaagggaacagttaaaacgatctccattttcagatgacatgatcatatatataaacaaatcctaaggaatccacagaaaaaccactacagctaacaaaccacttcagcatgaggcagcatacaaggtcaatatacaaaaataattttatttatatacactatcaataaataatacgaaaatgaaagttaaggacaaaatgcattttaatagcataaaaataaaatgtctaggcatgcatttaacaaaagaagtacaaaatttatatgctaaagatatgaaacaaattaaaaatctaaataaatggaaagatattctacattcatggatcaggagacttaatatttttaagatggctactctccacaaatggatctttatcaaaatctcagctgtcttttattgcagaagtagcctagctgatccaaaaattcatgtagaaatgcaagggactcaaaatagccaaaataatatttaaaaaaagaataattcatttggaggactcatgttgcccagtttcaaactttagtgcaaatctccagcagtcaacattgtgtggagctggcatgatgacaggcatatagagcaatgaaataacattgacagtccagatacaaaccctcatatttatggtcaattgagttttgacaagggttccagtgctgggacaactggaattcacatggaaaagatggatttggactcccatgtatcacatcactcacaaaaattaactcaaagtgggtcatgcagctagatgtaactgctaaatctataaaactcctagatgaaatcacaggactaaatctttgtgcccttggattaggcagtggttccttagacacaacttcaagattataatcaacaaaagaaaaaataagatatactggacatcatcaaaaataaatacttctgtatttcacaaaataccatcaagaaagtgaaaagataacccatagtatggcataaaatatttgcaaatcatgtatctaacaaggactagtatccagaatatgtaaagaactcacaactttgtaataaaaagaaaataccccaattaaaaatggagaaaataagtaaataaatatttctccaaagaagatgtactaatggctgataaacacataaagatgttctcaacatcattaatccttggggaaatgcaaatcaaaaccacaataagataccacttcacacccactaaggtgggcttagaatcaaaaagacggaatcatcgatgttagccaggatgtggtgacattggaggcttcagacattgctggtgggaatgtaaaatggtgtagctgctttcaaaaacatcattcttcaaaatatgaaacatagtgttcccatatgacccagaaattctgctcctgggtactacacactcaacagaaagataaacgtgtctacacaaaaactcatacatgaatatttatagcagcattattcatgatggccaaaaagtgagaaaacccacatttccatcgatgaatgggtaaataaaatgtgtataattatacaagggcaattcctttttattatatggcaataaaaaggaatgaagtacaggctttagaacatggttcctccttgaaaacaaggtgaaagtgaaagaaacaggtcacaaaacaccccatgttgtatgattgcatttacgtaaaatgttcagaagaggcaaatctacacataggtatgaggtttctttgggggagtgatgaagatgatagaaaattagattaatgatcacactactctgagaatatactaaaaatcaccgaatcgtcattttaaatggaagtttgggtatatatgaattatgtatcaataaatctgcttgttaaacagtgcacactatcaagatgacttaccactgatgatgttacctcatcaactagcctgtttctcctctgtaaattaccttttcactcctatccatgctctactccctaagcaagggatagagggttaagctccacatccttgagagaggagaaatggtgtaacttacccggaatcctgtacagcggatttctctcttctctctcattattttgttcattcaatcattttgtatcagtatgaactcatggatatttattttttactttaagatgtaatccaatgctagattattcattctgtcactcaagttattccagctttggttattgggaattctttcaggttggggcttatgtaattataagtaaattacttctttacaataattgttaaattgacctgaacagatctgaaaacaaacacagccaatttcaaatgttttgattcagctgaatagaagagacctttcctgtgtgcaccaaaaagtggcctttgagcattttctgagtggcgagatcagtgcacggcaagagtaaggccatcttgaagtgactgtcggacccctgctcaccaattagttcctcagaaacaatgcctgtgacatagacaaccccttcaaacaaacaatgcctggggcatagacgacccctataaacaaacagtgcctggggcatagatgacccctataaagatgcttattcaacctccccactggtcagcagttttgcaagagggtctggtgcatcagtcttataaaagcttgctatagaaagaacgttttctgggccaggtgcggtggctcatgcctgtagtcctagcactttgggaggccgaggtaggtggatcacgaggtcaaaagattgagaccatcctggtcaacatggtgaaaccccgtctctactaaaaatacaagaattacctgggtgtggtggtgggcgcctatagcctcagctactcgggaggctggtgcaaatcacttgaacccgggaggcggaggttgcagtgagctgagatcgcgtcactgcagtctagcctggtgacagagcgagactccatatcaaaaaagaaagaaaagaaagataggaagaaagaaagaaagaaagatgaaagaaagaaagaaagaaagaaagaaagaaagaaagaaagaaagaaagaaagaaagaaagaaagaaagaaagaaagaaagaaagaaaagaaagaaagaaagaaaaagcaagcaagctttctggagggcagctgtgggataagtccctattcaacgctcctttctgagagtctggatttgtcagcctctttcctcggcctctctgcacccccaggctttgggggtgggcttgcatgggtctgcccactggaacacagggtgtttcctggtatgtgtggggagtgctggcagtgaatctgaacatcagttaagagtctcaactcaatttagttactcataaaactaagtctaacgtgcagataagagatatcaatgcccgcagatgcaattgtctgctttttccactcattttgttaatgcccaggcagagacttccatgccttcagacactcctgcctgcaccctatactcccctctctacaggccatgaaaataggcagttacaggcctggaaatcaatcgtaatgattactgttggataaattggataatgagtaggacaatgaatttcactggtttgtttctgagagttttgagtatttttgatatttgcatttttgaatcctgcctgtgtagcaaccggtatgcttagggtgactttaaaagggagctcttgaactgaaattcattccaaaataatacttttttgtaaatgtttgttctgtattttctaatagagaccataccctcttccttcaataaacagtttaatggcttatttgtgaataaaaatatgagttgctaagggctcattttccccaaaagtatgtggcacccacagaaatacctgcccaggaggcacctcttagcagaggggagtcatctgagctcactttctgaaggggtctgttttgttgttttttatatagatatgttccatgggaggtggttttcgtttgatggtgtaatggccacactgaggagccactggaagcccattcctgcgatgcccagcggggctggggtggcccagatctccacgcccaggtggagacgctgtaacttttcaggggctctgcacacctgggcctcccacatgatccacttacctccagttagtggggctgactcctaactttgctatagggtgctcaggctgagactggattccagtatcttttggaaactcgggggctccaaggtgaagacagggcaaaagtgggactgagaagggagtgcgtgtaagcttcaggccgggcccagccctccggaggctgcggttcgaggttccgctcgcgggggcccggcgctctctggtgggcgcaggtggacgccggggcgacttggcgccgctgggctccgttccccaggctttctgctcacccgtttccccgctctctttccaagtccctaaccagctgacccgtttatgagacactgtcaccgagtcagggctgattcaaatgctgaccgaagtttgtccctaggaggcttcctgtgtcacagtcacaaaatggtacaagcttcagctgcacagaacctgggggtgccccgcgggccccgcggggagcgggcttaggtttggctggcagcgaacaccggcccgggaggcctccgcggggagctggggtcttggagtgagcgtgaccatcgccgcttcccgatgtgtgtgtgccttccgtgtgtgtgtgtgtgtgtgtttcctgtgtctttcatgtgtgtgttctatgtgtgtatttcatgtgtgtgttttgtgtgcgtgttccatgtgtatgtgtgtgtgcatctgtgttttatgtattttgtgcgttgcgtgcgtgtttcatgtatctctgtgtgttttatgtgtgtagttcatgtgtgtgtttgcgtgtttcatatgtatgtgcgtttcatgtgtgtattttgtgtgctgtgtgcttgtttcatgtgtgtttgcgtgtttcatatgtatgtgcgtttcatgtgtgtattttgtgtgctgtgtgcttgtttcatgtgtgttttgtgtgtattttatgtgttgtgtgcatgttttttgtgtgtgttttgtgtgtttcatgtgtgtgaatgtgttttatgtgtgtttcgtgtgtgaatgtgtgttttatatgtgcatgtgtcgtgtgtgtgttgtgatgtgatgtgggggggtgggtagactatttttattatcactaagccttcagcattcaaatgtttatgtttgtttgttttaaaaatacaacacagccttaacactacattgcgggatcaaggttggggatactgttccccagttcatcagggaagaggtgaaggagctgagtgagcaggggtaggggtgtggggagggcagcaacagcgcagaggaagccgccgagggccgaagcagccctaagccggaccccagcagaacacagcgcgcgtgggcaccgtggacctggccccggggctcgggctgggcggtcagcgcaggagcaagggcccagcgccgtcctggagcatctggtggacaggcgaacctgctgtccggggaccagatatttacaagtgttatatttgaaaaggaaagcatatttgaatggaagccgtttatttgatttaaagttcccagatattatatatacataggatttgtttaaacttaccataaattaagtgcgctctgcccatctgctgtgagtttaaaatggaacaaagagaggtataaaagtgccatctagtggggaaatggagaattgggttcaaaatatttaccagcaggtttgtcttgtctttcttttccacttgtaaaacacgtggattatgttataaagggaataataataatatcctacttgcacagtgctggtgagaaggaaagcccactgcatggtgcagagcacatagcaagatcccaaaagacgtgaatatggcgatagtcttatctgtattctctttcctgttcttgttcatcaagatgatattattattattaactatagtaatcactgcttgttggacccactggattttatgtctatgttattcatttaacaagctgttcacttaactccagaatgttgattttaactcttttcggatagaattaaatgataatgacatgagtgacgttcttatatgatcatgccctctgtggggctgttaactaggctgctcaagaaactcctaattatgtccacagccactattcctagacgctgtgctggcagctgctggggttcagaggaagcaggaagtagaagcacaggtcctcactccaaggatggcagcctgccattgctgtcagcagtgagcacagaccgacagcaatacaatgaaaagtgcctttaagtgataactgtggcatctcagaaacatgtttctttcttatatgttagtggcagcaaagagaaacacaggcctgacagaggaactgctattccatgaactctaccatccaacttcccttctcatttaaattggcccctgaaggactgaggcacaggagacctacatttcctgggctcagcgtccaccctcacaggccgtgtgagcggggagaggtcacagccccgcctggagcttcatttctatggaatgattgctgaagtctctttcacctctaacagcttatgggtccccaataattaatgtgccaaataacatcttccattggtctcgttacttcctcaccattagcaatttggtcaatgcaaaaaaaccgaaggagcagatttcactggataccagagaaactttgaacttatgttattctgatcttcaagggtagcagagagatctctcttcacatgaggtgtttttttaatttttattttgttggttgttgttgttttgagatggggtctcaatatgttgcctaggctggtctcaaactcctggccccagccatcctcctgcttcagcctgttgagtagctgggactacagtcatgcacctggcaacatgagttttaataccccgagaaggaggagggagaggcctggaacctcagatacaaatgcataatactcagaattcagctaaattagaatgagcaaactgagaatctaagcctttaatttagccatatgctgaaacaacaccggaagccgaccatcctggctaacacggtgaaaccccgtttctactaaaaatacaaaaaaataattagctgggcatggtggagtgcacctgtaatcctagctacctgagaagctgaggcaggagaatcgcttgaacccgggaggtggaagttgcagtgagcctagattgtgccaccgcactccagcctgggtgacagagtgagactctgtctcaaaaaaaaaattatctgtatactatttttacagacaccagcacagccataaacatgatgataaatccatctactgattgtcagttaaaatgttaaaggctgcccatcacatcacaaattactcatttataaaacggaatctgaataaagaaaaactaactttcaaatctgaaaaatagacctctcttgatttttcttgccaaatcacaaacacgatgaaatatatatatatatatagctgaaaaattatttttaatgcctttattttttctatttatttattttatttttattttagattctgggcgtgcgcatgcaggttcattgcattgtgtaacactgaggtttgaccttctgctgatcccactgcccaggcagagaacataacacgcaataggtagcttttcagcctttggcccctcccttcctcttcccttttagaatccccagtgctgggctggaagctgctggagatgagacgacgttcccgtcttgatgtccatgagtacccaacgttcagctcccacttagaagtgagaacatgcggcatttcgttttctgtttctgcgaaacagcttatttatttatttatttatttatttatttatttatttatttatttttgagacagaatctcactctgttgccaggctggagtgcagtggtgcgatctcggctcactgctacctctgcctcctgggttcaagcgattctcctgtctcagcctcccaagtagctgcgactacaggcacacaccaccacgccccgctaattttttgtattttagtagagacggggtttcaccatattggccaggatggtcttgatctcttgacctcatgatccacccgtctcggcctcccaaagtgctgagattacaggcgtgagccaccatgcccagcccacagttttatttttaatgaagcgattaccggagaaatacattcagattcacccaaatcaaatattaatttgctcaagtatataaatatttctgagaaagtcactttttgtcttgattctttctttactgctttctcgttctaatagtgaagataattatttccgttggtggcagcagaaacttatcgaaaaaccctctaaaccgcaaaacccatacttctgtgttgtgtttgatagtgttttccgtgggatgacaaaggttttctagtctgtattgtttgtaaaggtgccttcccaaccaagctcatgggagtcattctgactgccgttttgacagtgtctgagcatggaaggaacccacgcagtcaccacagcctgtgaaaatctctacctgtgcacagcatttgaaagttaccggtggttacaaagcgtgctcatgtttcctggggagtgctgggtgcagcagaaaagctgcatccgtacatataagatacattttgacacctctctgggtagatgaggtaagacaaacacatacacgaacaagtctctccatcagtaggtccaccatacactgttacatttgtaagacagttgccggataccccaaggcaaaagagagggaactagtttgttgagcactatgtgtgcccgttactgtgggaggcattttgaatatagtcttttctctgaaagttagaattaaatggaaaatgacagtaagctatgtactgtgtgccgcatatagtacataccgtatacagcagtttgggttcttaaccaatattactagtttacttacaagaaagggataagaaatgtgggagaggcccacgtggagaaggaggcagccgaggaacgaggaagaggcaaggcagggtccttcctaaggcctcgaagggagccgagttctgccaacaccgagattccagcattacagcctccagagccacggggagaaatctgggctattcagccaccctggtgggttgtggtaatttgttacagaatccagaggaaagtaacacagcatctgaagatgaggaaacccagggaccagacaggcagtgaagctggagtgcgtaagcattacaggtatcagaaatggtcgttttcattttctttctttttttttttttttttgagacggagtcttgctctgtcgcccaggctctgactcccgggttcacaccattctcctgcctcagcctcccgagtagctgggactacaggcacccgccaccacgcctggctaattttttgtatttttagtagagatggggtttcaccatgttagccagggtggtctcgatctcctgaccttgtgatccgcccgcctcagcctcccaaagtgctgggattacaggcgtgagccaccgtgcccggcctgttttcattttcattctctctctctctttctctcaaacacacacacacacacacacacacggacacacacagacacacacacacacacggacattcctcattgaagaattgctctaaacagttatttttagtttgtgggattgccttggaaaaggaagaaatgttctcctgaaagaagcttggcctgctgtggttaatgaacacgcgtgcatacaacaggcgggaagcaggcgggagagttggggtggggctcacagggcgcactgggaagccgtgatgctgtggccaccacctctgcctggacaaagggaagccctcccaggtgacaggtggcctcacagacatcttgtggaaaggacattcaaagagaggattgccctgaccacatggggccggcagagcgtccgtgcagtcgggaaattccctacacctgagctctgggatgctgcgggctgggatgttgaaaatcctctcacacgagcaaagggaaagatgcattctattttttcctttttttttttttttttttttttttgagatggagtctcactctgttgcccaggctggagtgcagtggcccaggctggagtgcagtggcacgatctcggctcactgcaacctcggcctcccgggttcaagcgattcccgtgctcagcctcttgagcagctgggactacaggtgccaccaccacgcctggttaattttgtgtgttttagtagagacggcgtttcactatgttggccaggatggtctcgatctcctgacctcgtgatccgcccgcctcggcttcccaaagtgctgggattacaggcgtgaaccaccgcgcccggcctgggaaagacccattctgagtgagacctgtgaagggagcggaaaatcacagaacaaagcgaggatgaagggagaagtggacccgaacaggcgagatggagacatgccccttagcaaatggggaacgtttcctctgatgctttcatgaggcaggaccacaggtaaggccataaatgagtcatgtataatgtaaatgtattatttctgaaggctttcttaaatatataattctcagtccaaagtttagtttccctctttagagtgtagggcagtggccagccactggtgcaccgggtgccacaggtgagaaccgctgcgtccttcacaagcgtggcttcgttgccggctgtccaagagcaccgctcatgtcagaaagtgaggcagctctggagcgggtcacagacagactttctctgaggctttaggatcaaaactattcaagaacatttccaacttttaaaattggaaaacacaaaactgtgtcccatagaacactatggtaaaatgcatgcctaataaaagtcaattacatttcattgactcagggttgtgatcaataacccgagtcctggcacacaggacgttccactgcaggtggtaggaaatgcatggcttaaaatgaaaggggccattgctgtggaagagggaagcccagagttggtgcagacctcagcccctctacctgggcatcagtgacctccggcggcttctcatgataagtgccaccacttccagggccaacacttcctcattcacatggaagggaaagagaaagcatttattccgacacaacatccaaattctcaacctttgctcaggttgctgactctgagccagtcactctggtggggtgaaggcgtgtgcccactgccttggcctgcactgccaggaactgattcccagggcaacgaggatgcgattccatcagggaatgtgtaggaatcaggatccacccctggaactggagatgaggccacttgtaccccaaatttatgtccataacacacagggagaaggctggacagccagtatgtctgccacactgagccactaccaagcttgaacaacataagctctggaacgtttgcttcgtcctttggcaagaactcttaccatgtttacatgactgcaaggagcatactctatgtttgtctacgtcataaccaccaaattagcatttaagtaaacaatgaagcggtgaacaatttggtgatcttatacaccacattaacatcacgtcatttatattaatttgtcatagtaagagaactgcaaaataatctacagtgagctacctttttccacctgtcagattgtcaaaaattcctaattgtggtgttatggtagctggaacgtggccctctcttacattgctggtgggagaaaaaatggctacagatttttgaagagaaatttggcaatattcaaaattacaaatgcatctgctgttttcgttttgttttgtcttcagcaattctacatctggactttatcctacaaatgttcctgcgtgtgtatgaaagagggaaagattgaaaacaacccaagtgtccgtccacggggactctggttaaatgaagtgtggaatccctgcagtgaacaccagccttccataatggacagaggcagcccttctctacgcatcagaaataacccaagatagaggaagctctctcggtacccatcagaaatatccccagacagagagagccctctgcgtgtcaatcagaagtgtgcccagacagaacgtaagtgagaaaggtgctacgcagtgtgtagaatgtgcactcttctggtacagaagaggagatctcctcattgtatattttatatcttatagaactttcattaatgaatcataggaatataccagctcttcaaaaattaagacattatacaaagtgaaatactaaaaacagaaatatgtgtttttctcaaataatatgcttctcaggaaagactttacagaaacatctcttcttatccgaaattacatccaaaccctttttttgtgtgaagtgttgcttccagtctactaaggtaataagcaagtaacaagatagtattgtttgatactcttgaacgcactctgattttcaattccaattttgtttgaacctgtcagcattttggatctggccccgtcatgtcctaccgtcattttattcttttgggaacctgtcagcatttttgatctggccccgttatgttctactgtcattttgctcttttgggttttttgtttgttgttgtttttgttttgcctttgtcaggacaaattcctttgtatcccagtctttgaacttggtgaaaaatgtccttcttcctttcttatctcatagaatctggtgcagccactcatttcagcttgaacctatatattttgtgtgattattttattttgttgctcatgttaactagagtataatcttcatgaagccaggatatatgtttgctcaccactgtatcttcaaagctcagcatgatgctctcacataattgtgctcaataaatattttccatggccagacgcagtgactcacacctgtaatcccagcactttgagaggccgaggtgggcagatcacgaggtcaggagttcaagaccagcctggccaacatagtgaaaccccgtctctactaaaaatacaaaaattagccgggcatggtggcatgtgcctgtaatctcagctacttgggagactgaggcaggacaatcgcttgaatccaggaggtagagtttacagtgagccgagatcacaccactgcactccagcttgggcaacagagtgagacttcatctcaaaaaaaaaaaaaaaatcacacttgatgaattgtatagttgttggcacagattgaaagctatgtggtgacaattcaaattctaggttattgaactagatcacaacaataatgagataaatatttgcacgaaacagaaaatcccagtgcttagaatacaggcagctgcttgctgaagactttactgtaactatccatttgcgccctaattgttttttctctgtagtatggatgcagtctatggtgatttttgtcaaataaatatacgatctagctctttgggagcccatagtcacagcagcagcttgtcttagggaggtttgagcatgctccctatctccatcagcctcccctcccaagatattttaaataaatatacaatccatcacaaatcatttttcaggaaagtgtatcttcaagattgcccctaaggtatcacttccaggtaaattgctgcttgtaatcctcttccacacagaaattctgttatcttcacattcactcttagctcgtgtctactcgaactgattttttttaatatatattttaaaatggaaatgacaagaattcctgactattctgaaaatctgccattaaatgcaatcaatttctttctttacaaaagaaatgtgttcacataggcagagtgtagattcctgcaaaatggtgaagactgtctttgttctcctttcttccagttttcatctttcatcgaacaaatctatttatggtggcttcttttaccagttcttctgcctgatccccactgccactacttggttattttctgctatatctgcctatatagtaatcttcagaaatattgccttatggtaattcttggactccatagaagcgtgatcaaaaacaaagagactgaatgctcaaacaaactacaacgatcatagaacgggagttttggacataacaacttgtgacagtttgttttcttctagcattttcttacaaacaccaagccccttcagcgtgttactgtggaggaagcatgctggcacagtgaactcaacaccctctcccagcaaatcctgggtccttcagggactccaatggcccctgggaacccattcacactgcttgagttttctccagaatccagtccacgtactcgaccacgttggtgtaaacacctggccgctccctttgagcacagccttcgccccagctcgtgatgcctaccagatgccagacctcattgtgtttgcaggacagagggcctcccgaatctccctagaacgaggggagacaagaaaaggtgcacagatcaactcagacgcttcccatcttcagcacatcttgctcaggctgattttgcctaaaatgttgtcttggccccttaatatactgcagagaacctgggtgcttgcgttcatccagtcaatctccttgcttttgatttcagtctaagtcaaacaaatacactgtgttccctgctcattggcagaagactgctttttaaaatgcattaagcggcccggcgcggtggctcacgcctgtaatcccagcactttgggaggcccaggcaggcagatcatgaggtcaggagatcgagaccatcctggccaacatggtgaaaccccgtctctactaaaactaaaaaaaaaaaagacgctagctgggcttggtagctggcgcctgtagtcccagctatttgggaggctgaggcaggagaatggcgtgaacctgggaggcagagcttgcagtgagctgagatcgagccactgcactccagcctgggcaacagagcgagactctgtctcaaaaaaaaacaaacaaaaaaaacaaaacaaacaaaaaaaccccaacgcattaagcattccaatttgcatatattccattggctaagaacactctgttaccttgcaagcgtccttccctccttccctgtagccggcacagatcatcttatgggttattttatgtcctctgtatctcttctggcactcttcgttggtcactaagggtatcttggctttctggagagtattttgtattttgtctgaaaaaaatttttttggttcgtttgtagaataaccatacacaatacacataaacatatatgcatacatataaatatatatatatatatatttttaatttgagacggagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcccaggtaatttttgtatttttagtagagacagggtttcaccatgttggccaggccagtcttgaactcctgacctcaagtgatccacccatcttggcctcccaaagtgctgggattacaggcgtgagccaccagtggtgctgggccacatatatttaaaataaaaatcatggacgggtgtgggggctcacgcctgtaattccagcactttggaaggccgaggcaggtggatcacgaggtcaggagattgagaccatcctggctaacatgatgaaaccccgtctctactaaaaatacaaaaaattagcttggggtggtggttgggtacctataatcccagctactcgggaggctgaggcaggagaatcacttgaacccgggaggtggaggtaacagtgagccgagatcgtgccactgcactccagcctgggcgacagagcgagagtccatctcaaaacaacaacaacacaaaactcatgtctatataaaaatctagaaggaaaaaatgttagatttacttcacagaccttttataattacaagtatgaagaagacattattcccactattgcgtgtaccattttgttaatgttaattaagttcaaaaattaattatgactctaactggaatgacttcccaagaaagtaattggatagcaggctagaacatttactgaaaagtgctaggcttcacattaaacttcattaaatataattagtctttaaagagatttagtcacatttaaaatttccaatcaaacatatgaggcaccagcctcacttgggtgatttttgcctctccatctttattaatccgcttcctgcaactgagtagtgtgactcgagttgtgcttcagctacatgacttgacagggcagaaaaggttccgctcttcatttctaggatggagcacat

SEQ ID NO: 15272 - DNA, 38566 bp, Human; identical to SEQ ID NO: 15271
  misc_feature (1)...(38566): n = A,T,C or G

SEQ ID NO: 15273 - DNA, 86273 bp, Human
gaatcgcttgaacctgggaggtgtagggtgcagtgagccgagatcgcaccactgcactccggcctgggcgacagagcaagactctgcctcaagagaaaaaaaaaaaaaaacctaaatgttccaaaactcaaaacgctccaaaatctaactttttaagcactgacatgactctcaaaggaaatgctcattggagtatttcagattttggattttcagattaggatgctaaagtggtaagtatatatacgtaaaacactttcatattctgcttttcttcatttaatacggtggttgcctttctgtcagtcatcgtacattagcatcagtttgctgtgtgatattccattgcagagataaatcttgtgatatttttaaccagtcctccattgctggatggtgcaatgaacatctgttaatacatatcttttgctcatgtgtctgattattttaagggtaagatttcagcctgtggaaagggagtaagtgtaagtttgagcagaggaaaggagacctaaaagaataaggcgagtctgggaacagttcactaggttattttagggcattggacccccgtaggcgagaaatgcttgcagacatcttacgatgacgcttaaatggaagagcagtttgagaagatttagtatcatttaattttttattttttattttttttgagacggagtctcgctctgtagtccaggctggaatctcggctcactgcaacctccgcctcgcgggttcaagcgattctcctgcttaagcttcccgagtaactgggactacaggcgcaaaccaccacgcccggctactttttttgtatttttggtagagacgagatttcaccaagttggccaggttggtcctgaattcctgactttatttatttattttctgagacggagtctcgctctgccgcccaggctggagtgcagtggcgcgatctcggctcactgcaagctccgcctcccaggttcacgccagtctcctgcctcagcatccggagtagctgggactacaggcgcccgccaccacgcccggctaattttttttttgtgtgtgtgtacttttagtagagacggggttttaccgtattagccaggatggtctcatctcctgaccttgtgatccgcccgcctcagcctcccaaagtgctgcgattacaggcgtgagccaccgcacctggcctagaactcctgactttaaatgatccatccgttttggcctcccaaactgctgggattacaggcgtgggccaccgcgcccagtcaatctcatttaatcttaatgccaggtactgttctaacacttttctatgtataatttatttcacttgcaggtactattattattcccatctataggccagaaagctgaggtacgaagtttaattaccagagttacttatcttcgttaaaatccaagcagtctgggctacaaacaattatacctactttgcagtcaaggaaccaagctgagatgttgagctgaaaacccaggtctcagacttcaaagctttctacacaagagtcgacggtggcagtaaaaattaatgggggcttgatctatccctcccacccccaagaaaagtaaaaagcaggagctgggaccagagaaaacctccacggagtccttatcccctaaatataagaggcatttaacgtttagcattgctgacctgcaatcaggcttcaactgtgagtagccaggctctaaagcttgataactgaattccaaaaagcgcgcgagcctccaggcgaaacagcttcccgccttccagccggttggagccggctcagcaacagcctctccaagccagggtagtgacgtcagcccaggaattgggcccgccccgggatctcgctgctttctgcacgctcggaataaccagagtcgcgaaattagccccgcccactgccccggaagttaatgcggaagccacacacctcctcctcggccggcaggggcgcagccattttaattcatatctgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggtgaggaaggagagtggtggggcctcgtggcgacctcttctccacgtctgttcctccgactgctccagacatgttcggctgaggaaggaattgggtctagtgaacccgggggacagggtatatagaagagtggtgggaatggggagcaagatctaagatttaatttttttttttttacttctctctcttaggcatgaatacgagtaaatacttgatttagacaatagcggtaggctgcttcgtcctatttagattcatgggactactccagatgggatgctttcctttgatatcgttttggtattagagtggataggaattattttaacgtgcacccgacgttttagaaaaacttgacagtgtttcttttaccccgccaaatatactgtacccagaaataggttactagtttgagaaatatttgagacaaagctaatctggagaattaagacttaatgagagcgagtgaagaaagaagcaagttatgctgaggttttgggaattttgtggctttctttcgttttcttttcttttagccacatttcgttttcatttttccagctacataaacattgcaggtataagttgaaaatgagaagtctgttttggccactgtaaataaaagcatctgttttaatagtaaatatgagtgacaactaaatattttaaaattcacacttttaggttagatcagtgtgatttgtttcttttgctctttgtattcagaattttgtaggatagtatttaccttttagtgtgaaagaggaagctaaatagttatgaaaaatgccattaaatgtgtttttcgatctaagtcctggtgtgtttagataaatacagtttctaaaatggaggctaggtagcctgcagtctcaatttcctgaaatttcccattgccatagcaacgacatgcacttaggttttcgtttttcaggttccctagcttataacgtggaagatgttattggaggttggcagagatgaggcaaaataggagcgttctattgcatagtctgtaagactgtagatttcattatgtcggcagtttgattaaattgttttgtgtttgcccgaggactggtttcagtccagaaatcttcgcactatttacattttacatagtgttagcatgcccaagcatgcaaagtcttaaaattactgtatcaaaactgtttaccccttttctgatctagtatttgttatctgaaagtgaaggactaatgaactgaggtttcattgaaagttttcgaaattcattgttaattcttagaatttatctaaaattacaaagacacggaaatgttaccatgacctcttgaatgttttagaactgtggtgtttcagtgggacagatggtggtgaaaatttatagaaaaataatttctcccaaaggttttattgtgcaaagtttagaacatagagaaaagttgaaagaaaagtgcagtgaacacctgtaggacaactcttcgcctggaatcaacagctgaaagccttgccatatttgctttatctccccatgctgatagattgagaacagagtctttgtcactcacactagagtgctgtgacgccatcacagctcaccatagcttcgacctccctgcgctctgtgatcctgccacctcagcctcctccgtagctgggagtacaggcgcgcgccaccatgcccagctaatttttttttttttttttttttttttttttgagatggagccttgctctgtcgcccagactggagtgcagtggcgcgatttcgccttactgcagcctccgcctcccggttcaagcgattctcctgcctcagccaccccagtagctgggattacaggcgcccaccaccatgccccgctaatttttgtattttaagtagagacggggattttgccacgttgcccaggctggtctcgaactcctgacctcaagtgatccgcctacctctgccttccaaagtgctggatttacaggcgtgagccaccgtacctggcctaatttttgtattttttttgtagagacaggaattcaccatgttgcccagcctggtctggaactcctgggctcaagcgattcacccacctcagtgtccccaagtgttgggattacagacaggcacgagccaccacgcctggtccacgcatgtttatttgaaagtattttgacacattgcagccccaagtatttcagcattctcttataaataagagcaaaatgttgttacataaccaccataccatttccccacccaagaaaatagtatttctaaaatctagttctttaaatttccccatttgtcccaagaatgtgattttttttttaaccagaatcaatctagatttacatattgaatcatttacttctgtctcttaagtagtctcaccattcttctcccctggggctgttgtctattcgaagtgtcaaggacacttaacactgcttttctgggtgtatttgttttttgttgtttgtttgcttgcttgcttttggtttgggggttgatgatgtcatttaacttgtcccttcatctgtatttcctgaaaactttacagttaggtctatactcagccttgatatttgggttaagtatttttggatagaatacttaacattatatcattacattagcaggtacttctgctgggttctgttaggatggttaagtttgatcacttggtttagggtgatctcattgttaagggtcatgttcccctttgcagttaataatctgtgagttgataaccgttttctttaaaatcaccttatacctagttatcaattgataaatcttgactaaatcagctcttacattggaagtagcaaatggtggttttgttttgtttttaaaacccacaattctgttggtctgtgtctgtttactggctcatactttctgcaaaaaagactttttttcttcctaaagattaagtatcgctatggattcatggatttctcttagtgtgttagtatcagtgatagccatttttcttttgcacactcaacttgtccaaacctttttggtggttcttatatcttttccttaagtctgaaaggcaatttagacatctgattatcaacaaggaagtcatcttcatatagccttttctttaactttttaataatacatttcaaacatgtaagaaaaacagtataatatatgaagtacctgtcatagagcttcaatttatggctaatcttgtttcctccatgacttcatttgcttctctcacccccattacttcgaagcaaatcctagatactgtattcagcttcaactaaaataaccattaaataacaccttaaggatggaaaatatgaatgagctgtaccttgcttgatatttaagacaatattgaaaatctggaggaaaagagagtatccaaaataacctgaaatcatggatgagaaaaataaactcaatgagactaaagaataataagaaaaaaattaaaaccattgaatcatggatttgctttggaaaaatgccaagggatggggtggacaaagagtcctacaagatgcaggtgtagatttagccttttagtagcattgaagttcaagtttgtagaataaacctgatactatcttaaatttattactaaaatatatggatagtcatttttctcttggtgctaagatttgtgatttgtgccccctaacagagggaaattattgcagacaagcaaaatcactgctaaaggtttattgctgtgatttttttttcaactctagtagggaagttcaattttgcatgtagagagctattggaattaccttatagtgttcaaggatctcttctgaagctccttgcttattgtttttgccagtttaatggtgaaaaaactatttgcatataggtttacccccctaacaaacatatgatttctgtgtggaattatggctgtattatttatttcatggttttgtttttttgtgtttgttttttgtttttttgagatggagtcttgctctgttgcccaggctggagtgcagtggcacggtctcggctcactgcaacctccgcctcccaggttcaagcaattctcctgcctcagcctcttgagtagctgggattacaagcacacgccacaatgcccggctaatttttttgtatttttagtagaaatggtgtttcaccatgttgaccaggctggtcttgaactcctgacctcaagtgatctgcctgcctcagcctcccaaagtgctgggattacaggcgtgagccactgcgcccagcctgtggtgtttgttttttttaatgcctgattcaacttttgatctcattcttaggtctatttaaccttgtgcactactcttaaggcatttaatatgctgttatttagacattttccattgggttttgaacttctttagttgaagagatgatgttattcatctttatgtcttaaagacctaagaaataatattttgatgcttaaaggtattcagtaaatgaatggattaagtttgcatcttttaaaaaaaattatttatttactatttaggtagagacgaggtctcactgtgtttcccaggctggtcttgaactcctggacttaagtgatcctcctgcctcagccttccaaactgttggattacaggtgtgagtccagccatatttcaccttttaaataatgtataacttatcctagaatttggaaggcctaaaatacaagccaaatgatcctcagcttggaaaagctacatgattctaagaagcgcaaattaattgctggtagttcttaacaaaggagcatttaggctcataaatacgtgtttttagtgaaaaataattttgggaagatttagaaaataatgaagagtatgtgtcctattatatacttattattaataaggaaagaaaaagttgaaacacccacagcattgaaacctgaaacctggtttatttcgttaggtaaacattagtacttaagctgtttagaagtaacagtatcgccaattttagtcaaggtgcatatatgtgtaggggttagaagaggcagagaaagagccaactatgtgtgttggacaatgtgtttttttggatttattttttccaaaatctttctgtaacagcccttcctagttttctgcctcctatttttagtgatgcttgtttggtgtaacagttttgggcaggcaaattgatttgatctttattgttgatatttcttaggaaactggagcattatcaaatattctgtttggggacagttgttcctaagagaagttgctctgtgcttaaagaatgagaattgggtttttcttagagatacagcagaaaggtactgtgttaggtgatactgcattccttcaacattatttcagggaatgtaggcatttacatcccagatagaccttcagaagggcaaaatctgtatttgggtgtttttacctattggacaattacccataccaattcatgattttaagcttttttttttaaatcttcgatttggtgatggtgattttaagcttttctaccatgtctctgaatctttctctttagataggacctacctgtgaatttgagtctttttgttttgttttgttggacagttggtaatggtgtgagaattgggctaaaaaagggatttgagttggcagttgtttaaactatctttagattaatggacaacttaggatacatagtaaatattgaataaaatcagaagggcaaagcttctgtgtgtcctaattaatgtttttctaatgtttgacttagtttatttagtgtattaaatctggattattcatatttgaaagaagtctcatcttttaagttccaaacggttaagattttaatttatattttgtagctatttgtttcctaggggatgaatatgcaagtttactaagcagataatggtaaatataattatttgaactaatatgttaagccaagatcttttttttttttttaatttttttatttttattttttcgagacagagtcttgcactttcgcccaggctggagcacagtggcgcaatcacggctcgctgcaagctccgcttcctgggttcacgctattctcctacctcagcctccctagtagcggggactataggtgcccgccaccacgccctcacgcccagctaattttttatatttttaatagagatggggtttcactgtgttagccaggatggtcttgatctcctgacctcatgatccgcccgccttggccttccaaagcgctgggattacaggtgtgagccaccatgcccggcccaagatctttttttttttaagtttttgagttgtttgtatgtttagatttttaatctatggatgatttggagggattagttttgtattgtaggatacatgttcagtttcattcacaacaaacatgaagtagggtttggttgcattggtaaaggaacacagaactaagctgacatctggtcctaatatccggtctcattgtgacacctgtcacatatagttctttattatctgggcatatgaatggaatcagttaggttactcctctatgaaagtctcagcacggcaccgtggctcacgcctgtctgtaatcccagcacttcgggaggctgaggctggcggatcacttggtcaggagtttgagaccagcctggctagcatggtgaaactccgtctctactaaaaatacaaaaattagctgagtgtggtggtgcatacctgtaatcccagctacttgggaggctgaggcgggataatcacttgaacccgggagtcggaggttgcagtgagccaaggtacagccactgcactccagcctaggtgacagagtgagacttcatctcaaaaaaaaaaaaaaaaaaaaaaagtcttacggagtgctactccggtctacttttaattttgaaaaaaagttaaccacagagagagacttaagacttcaaatatatagtatattcagttttcttaatattttagcaaaaaattcacttggaatgacaggtttgttgccaccttatttttaatgaaacgtgacatttggaaaacatttgtggaacagatagatgaggtggtacatatttcttaaagtggagcccatggcccatttatgtcataattaggtgcgttataaaagtatagatacgtagactctgatttcaaacctaactgttcagtggggctgagaatcttcgtttgaaacaggtaccacagtggtttttatgtcaataaaagcttgcagaccacagagttagatgatagctggttgttttaaaatatattcttgataaataagtggatgaaaaaatggcagatatttgaggatggtattttactgatttttcctgcccacctgctccccacccccatatatttagttattaccctgaatagcgagaaatactcattataaaaccagggttgaggctcaactctgctttttctgttggtcatagtaaaaagcttacatcgtcttaaatctttcaatctaccatctttctccccctctattcatacttttgtgttatcactttaactgatccctactttaatttaatttcaatatggctcctaatataacacccttctaatttatcatgaaagtagctatttggagaaagagaattatcttttttttttttttttgtctgttttacctgcatggtcgaaatggaagaaattagattattattattattgttattattactattttttttagagatgagatcttgctctgttgcccaggctgcagtgcattggcgtggtcatagctcaccacagcctcaacgtcctggcctcaaggactcctcccacctcagcctcccaaagtgctgagattacagttgtgacccactgtgcccagccttaaattatattatttcagtcattaacatgatagtgtctgtcacctcttcacatcccaccttcccattaacaacctcctaataaaagttatgagctcatatagaaagaaagtggttaggagtttcaataaagcataactcatagggctttccagaggctacatcacctatccacaattgtatgtaaaggctgttaaaaatggtctttcctcccttttccaactacgtaactgtgaggctaaaattttttcatatttttcatctaaaacaatatattgtaacagattgaaagaagcagataatgtcttccattcagccagacatttaaaagatcatgaaaatgtaaaatggtgccattcttttgacttttttttttattttggaaaatttccttcagtaaaatatttatattcatatttaaggaatttattatttttaagtgaattaaatactttaattttttgttttaatttcttatgtgagtaatgatagaatccctctgggctcctcaattattattgttatttttttttttggaggcggagtctcactcttgctcaggctggagtgcagtggtgcgatcccagctcactgcaacctccacctcccgggttcaagcgattctcctgcctcagcttcccaagtagctaggactacaggcatgtgcccacacccagctaattttttgtatttttagtagagacagggtttcaccaaattggccaggctggtctcgaactcctgaccttgtgatccgcccgcctcggcctcccaaagtgctgagattacaggcgtgagtcaccgcgcccggcccaagctcctcagtttttaagaatgtgaagcaatcctttacaaaatgtttgagaatagttggaatagtacatcatgtctgtgaagccaagattgtaagttctatttctctgagttagttagcttcacataacagacggttaaacatggaaagtggcaaggcatcccacagaataggatacaatttttgtaaatcatgtctgataagggatttgtaactccaacatgtaaaaattcattaatgaaaaaacccagccaggtgcggtggtgcacgcctgtagtcccagctatttgggaggctgaggcaggaggattgatcgaacccaggagttcaagtccaacctgagcaacatagcaaaactatacctctaaaaagtaataataatatgtccagtttttattttatttatttttattttttcaagacatagtctcgctctgtcgcccaggctggagtgcagcggcacaatcttggctcagtggaacctctgcccctccccgccggctcaagggatcctcccaccttagcctcctgagtaggtgggattacaggtgcctgtcaccatgcctggctaattttttgtatttttagtagagacaaggtttcaccatgttggccaggctggtctcaaactcctgataagtccagtttttaaatgggcaaaatatttgaacagacatttctccaaagaagatgtacaaatggccaataagaaaatgaaaagacgctctactttgatagccatcagagaaatgtaaatcaaaaccacaatgagatatcacttcagacccacaaggatggctgtaataaaaaagataatatcaaatgttggtaaggatatggagaaattagaaccccttatactggaaatgtaaaatagtacagcccctttaaagtctggtagtttttcagaaggtaaaacataagagttaccacattacttagccattccatttctaggtatatatccaagaaaaaggaaaacacacaaaatgaactccacaaagaaatcttacacactaatgttcatagtaacattattcataatagccaaaactggaaacaatccaaagtccatcggctgatacataaacaaatgtaggatatgcacataatggaatattgtcaaaagtaaagtacttagtatatgcaaaaacatgaactttgaaaacacgctaactgaaagccaaaacaacgccagtcatggtggctcacggtggtaatcccaacactttgagaggccgaggcaggtggattgcttgagcccaggagttcaagaccagcctggacaatatggcaaaaccccatctctataaattataaaatttagctgggcatggtggcacatgcctgtagtccattatcgggaggtctaggtgggaggattgattgagcccaggaggttgaggctgcagtgggccatgattgtgccactgcattcgagcctgggtgacagagtgagatcctgtctcaaagaaaaaagaaaactagaaacaaaaagaacacatattgtatgattacattaaatatgggcacatccctagagacaaaatagattagtagttgcccagggcttagggattggagggaaatgggagtgactgctaacaggtacagatttctctttggggtgataaaatgttttaaatgtgtgatggttctgtaaacttgaatatattcataaataaaaactattgagttatacacttcagatgggtgaattgtatgtatgtgaatcatgtctcaagccagtactaaaaaagaaattataaaagcttaaatacataatatgcttattctactttcaaaccttttttttttttttgagacagggtctggccctgttgcccaggctggaatgcagtggtgtgatcttggttcactgcaaccaacacctcctgggctcaagccatcctcccacctcatcctcccaagtagctgggattacagatacctgccaccacacccagctaatttttgcgttttttgtagagatggggtttcgcaatgttgccaggctggtctccaactcctgagctcaagtgatccacctgcctcagcctcccaaagtgctgggattataggcgtgagccactgtgcctggcccccctaccttctttcttttagccagttgtacatggttgtgttattcacagagaagataaaattaagtcattggtaatatgtatgtcttgataactagtccagtttttgctctactcctttgatttggggtccctgcctgttccccattaacatcgcctgaaaaatgatattaggattatagattattatttcagaagcaaaactggattttgatagtttttgatagtaataagtttttgggatgcataagcatgggacagctgttcttgctacactaagcagtttgttacagaagggcattggaaacttgccctgttttcttttttcttttcttttctttttttttttttttttttagtttgagacagagtctccatctgttgcccaggctggactgcagtggtatgatcttggctcactgcaacctccgcctcccgggttcaagcaattctccggtctcagcctcccaagtagctgggattacaggggcctgccaccacgccccgctaatttttgttttgttgttgttgttgttgttgttgtttgtttgttttgttttcaagacggagtctggctctgtcgcccaggctgcagtgcaatggcatgatctcggctcactgcaacctttgcctcctggattcaagcaattctcctgcctcagcctcccacgtagctgggattacaggcgtgtaccaccatgcccagctaatttttgtatttttagtagagacagggttttaccatgttggccaggctggtcttgaactcctgacctcaggtgatccacctgcctcggcctcccaaagtgctgtgattacaggcgtaagccaccatgcctggccaatttttgtatttttagtagagatggggtttcaccattttggccagactggtcttgaactcctgacctcgagtgatctgcccgtctcggccttccaaagtactgggagccactctgcccagcctgttttcttaaaatgacctgttctggcaacagattcaggtaataatacaacttcattccttatggaggcccagtctctcttttgggtactacaaaactgttcagtttttctttgcccagtagcattatggtaaccaggccagaaaacaaaaatgcttcactctcagcgttggctacccaagtggttcatagctgttatgttaaaaggctttttattgtgagaattaaatgtgaccataaccagcaggatatgctcttgagcattctggttaacttccattgttaattaatgcggttgattgagaatcacatgtatagattgtgttacgaacatttgactactgaggagctaggccagaaaaaaacatttagtgatgcaactgatacttctgctaattccccaggtatctggatagcattttagggattctgtgaaattggatgggggaaaagactttcactaatcgctaactgaaattgagcattcccttttattattaatgtaggccagaatttacagaggtaatagtgttagcagcagcactcatcactcatgtagtgaattggcccctaaagcttgttatttgatgtattaagtatatattactataaaaaacctctggagcaaggagcggtggtacacgcctgtagtcccagctacgtgggaggctgagacaggaggatcactggagcccaggatctctagatcagcaatgtagagagagcctgtctctttaaaaaaaaaaaaaaaaaacacagcaacagtacacacacacatgctttttccttggaaatccctcagaatttatgtatttaagaatattattctgagaaaaggctcataggtttcactagactgcagaaagattctgtggcaccaaaggagcaaccaactagagagcatagttttttttttttttgagatggagtctcctctgtcacccaggttggagtgctgtggcgtaatctcggctcactgcaacctctgcttcccaggttcaagcgtttctcccacctcagcctcctgagtgtgtgagactacaggcacataccaccacgcctgctaatttttgtatttttagtagagacggggtgtcactgtgttggtcaggctggtcttgaactcctgacctgaagtgatccacctgccttggcctcccaaaatgctgggattacaggcgtgagccactgcacccgatgagccatggttttcaactaggactgctatacgttagaattacttgaaaagtttttaaaaaatattgatagtatgtacattcctagagattcaggtttagttgattgagggcgaggcttggacatcttttaaaatctccttcccttaggtgattctaatgcagagccaggattgagaatcactaaagggctggctcatttgatgtattaaggagacatgtatacgtcttattgtgattatgcttggttggatatcagattctatgctcttcagtttgtctcttttacagattatatggtataccttacctgatttggtaggttaatttgagcaagtgggtcttgagctccagaatatctatgaacactaaagtaatttaaatagctctctaaatgcaaaattgaccttgtatcaagagtaaaaacaattatagcagtaaaccttggcagtgattctgcttgtctacaatcctttccctctttcagagggcaaaaatcacaaatcttaataccaagagaaaaacgaccatatgttttagtaacaaatttgagattatatcaggtttattcttcagtgatactgaaaggctaaaagaaatcgacaactcataccttgtaggattctttgtctatcccatcccctggcatttttccaaagcaaatccatgattcagagtggttttgggtgtttgttatcactgattacctaaagcagttcaagtatagatgaactgttttttggttcccatatcagttttatttcttagttaatcgttatcattttatagtcggtatctcaagactgaaattctagtttacgtaaaatttcttttttttttttgagactaagtctcactctgttgcccaggctggaggctcactgcagcctctgcctcctggtctcaagcgattctcttgcctcagcctcccaagtatctgtgactacaggcacgcaccaccatgcctggctaatttttgtatttttaatagagatggggttttactatgttggccaggctggtctcgaactcctgacctcgtgatctgcccacctcgggctcccaaagtgctgggattacaggtgtgagccaccaagcctggcctctttctttctttttttttagagacagtgtctcactgtcacccaggctggagtgcagtggtgcagccttagctcactgcaaccttgaactcctgggctcaagagatcttcctgcctcagtgtcccaggtagctaggactgcaggtgcctgccaccacgcctggctaagttgtttttgttttgttttggtagagacagagtctcactgtgttgcccaggctggtcttgaacttctggcctcaagcagtccgcctgcctagtagctagggctgcaggcacacaccaccatgcctggctaatttttatattttttgtagagaccagtgtctcactatgttgctcagctgctcttgaacttctggcctcaagcggtcctcatgccttggcctctcaaagtgctgggattacaggcatgagctaccatgcctggcctaaaatttcttttaatttttttttttttcaagaagtaaacccattgaaagaattctttattttgttatgtatcccaagggccactacaatgtctgacacatactaggcactgagtgaatatttctcagacgaataagaaaaattcaaacaaaccagaagggtatatggcagagtaagtgtatgtgttgtttgcatgtctccctgctcaccatcactttttattttccatgtggctacctgccatgcctttttttttttttttaagtgactacaaattccataatttatttaattggtccttttttatatgtatttatttaattttaacaaatagagacagggttttgttctcttactcggggtagagtgcagtggtgtgattatagctcaccgcatccttgaactcctggggtcaagcgatctttccaccttagcctcttgagtagctgggactataggcatgcaccaccacatctggctatacatagttatttaatttattttcagtcttatgtaactatagtctagtagctgactcattatatatctttgtgtacatgtgcagtagggtgttaatagaagtggaattcagaatcggacatttatattaaacgttgatcagtttctttttttctttttttttgagatggagtcttgctctattacccaggctggagtggagtgcagtggtgtgatcttggcttactgcaacctctgctgcctgggttcaagcagttctcctgtctcagcctcccgagtagctgggactacaggtgtgcaccaccactcccagctaatttttgtatttttagtagagacgggggtttcaccatattggttgggctggtctcgaactcctgacctcaggtgatccactcgcctcagcctcccaaagtgctgggattacaggcctgagccatcgcccctggccacattgatcagtttctacttgcccttgctaacaatatgagaatatctttttctgcttaccctcaccagtgcaatttaattataaaatgttggatctttgttttctggtttatatttgcatttcttttttttgtttgtttttgagacggagtcttgctctgtcatgcaggctggagtgcagtggcgccatctctgctcactgcaagctctgcctcccaggttcacgctattctcttgcctcagcctcctgagtagctgggactacaggtgcccaccaccacgcccagctaattttttgtgttttttagtggagatggggtttcaccctgttagccaggatggtttctgttctcctgacctagtgagctgcctgctttggcctcccaaagtgctgggattattacaggcatgagccaccgtgcccggccaatatttgcatttcttttgagtctttaaaaagttaattataaactgttcatatgctttgcccttttttttatttttaaatttttattaaaaaatgtttttttgacacagagtcttgccctgtcacccagtttggagtgcagtggtgcgatcatggctcaacctcctgggctcaggtgatcctgccacctcagcttcccaagtaggtgggaccataggtgcatgccaccatgccccactaattctttgtattttttgtagagacggggtttcgccatattgctgaggttagtctcagactcctgggctcaagcaatcctcctgcccacccaccaaccccaaagtgctgagattgcaggttgagcctctgcatccggctgcattttctttttgaaccactggtggtttattgattgtactttaataaatttagtatttttgtcatgtgttggaggttttttttacgtttgtctttttttattttggtacttttctcatgcgcaaattttaacttaccatgtaagtttactctttaaaggcttttttttttttaaagacagggtctggctctgtcacccaggcccgagtgcagtggcggcaatctcagttccctgcaacttctccctcccgggctcaagcgatcccaccgcagcttcccaagtacgtgagactacaggtgtgtggcacacacctggctaatttttgtatttgggtagagacgggattctgccgtgttgcccaggctggtccagaagaacgcctgagctcaaggaatcctcccgtctcggcctcccaaaaggcttctgaagagcttttccaatgcagaaatacatttcaccgtattctgctctagttctgtcttgtgttttgtttttaacatttaaatctttgatctctcttaagtttatttgggcagaaagagtaaagtaggaattcaactttattttgataaaattgacttcacagttattctaacagatgattatatagttattctgaaaccatttattgaacaattcaccattctgatttgaacatgccacctttattatttgctgattttccatttgctgttctttctgagcctgtagtttcatatatgggaagagccaatagtcccttataaactttacagctttagttccttgagcaagctattcataaagttcttatatgttaggaaagcatcctaattttaattttgaattacagtagtcaacatgtctttttttctaaataagtaaatgcttaccagtggtgcaagctaatttattccaaagaaaagagtttatttctcctaggtaattaaaaaaatctgaacagatactttttttaaacttttccaaactggtgttttgactgaattgttccatgaaatactaaaaaaaaagggggagtggtgggggagaaaagtgataggggcagtgcttccctctttatgctcggatattatcaatatatattgccatttatagatgtcaggatgtcctagaaaaaaggcaaaacaaaacttcatataaattaacttttttttttgagacgtagtctctgtcacccaggctggagtgcagtggtgctatctcggctaactgtaagctccgcctcctgggttcacgccattctcctgctttagcctcccgagtagctgggactacaggcgcccaccaccatgcccggctaattttttgtgtttttagtagagatggggtttcaccatgttagccaggatggtcccaatctcctgaccttgtaatctgcctgtctcagcctcccaaagtgctgtgtggctttgtcacccaggctggagtgcagtggcgcaatctcactcacagtaacctctgcctcctggattcaagcaattcttgtgcctcagccttccaggtagcagggattacaggcacacaccaccacgcccagctaatttttctgtttttagtagagactgggtttcaacatgttagcctggctggtcttgaactcctggccgcaagtaatctgcctgcctcggcctcccaaagtgctgggattgtagatgtgagccaccacacctggcctgtataaattaacatttatctggcttatttgaccatccctttttgtggtacacagtagtattctgaacaacaatttgagaattaatacttttatttttgcttcaagtgctggctactattttaggcatttttttcaaaaattaaatttctataataaaagtaaaactaccttaccaaaggatttggggaatattgaaagaaaaggggaaaaaaaatcagcctctaattctactgcttatcttccaaggatgaccagtctaagcatttgaatatattttaaaaatctctttaattgcagatttcttttatagttttcattgtattgtacatacaattgtgaattgtgtttttaaaatttctttacatcgaaataagatttccatgtcatttcatgcattttctttgtggcgcaggatgaatgctttaacagcagtgtttctcaaagttggtccaggaaccccaagggttcctaaggactttcagaggatctgtgacttcaacctctctcataataaatctaagacattatttgccctttttcactcctaatctctcacgggcatacagtggaatttttcagcatctgtatgatctgatagggcagcagattgaatacagaagcagatgtgaaaattcagctgccttttaaaaagtcaaacattgaatggatttataaatacgtaaaaagcgacattcttattactgaattttaagttattttttataaagaaaaaacatgtaaaaagttttatttgtaaatcaatcaatatttaaatttgttttaatttctaatatggtaaatattgataaaacccacataaaagctctttgtggttcttaaattttaagagcgtagaggggtcctgagaccataaagtttgagagctgctgttttatagtatttaatacaaaagtaagtttatttgaataaaaaatacttgatcacttggttttattatctttatgcaagttacttctgattacaaatacaatcgtccctcagtatctgtgggggattgttgccaggacacccccttagataccagagtccatgtgtgctcgtgtctcttatataaaaataatgtatttgcatatagcttacatatgtcctcccaaatacttaactcatctagattataataacgtcatataatacagatgccatgtaaatagttgttatactgtgttgtttaggaaataatgataaataaaaaggctgtacgtgtttagtgctgtcttttttttttctctctgagtattttcaatccacccttggttgagtataaggatgcggagcccacagataaggaaggacgattgtacacatcggttctaggaaacacacttctcttttataagaggatatttttatgctttgtaatgtgacattgcatctgaggactttattgttcatgaattaagttaggcatgagatttttaaaacagtaactttagttcactgttgttttttttccccaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggtattggagtgctttagccttttatttacttgtcatgtgtcaatttattgcctcctgtgtcatttatttagaactcatttttctttttattcctacttacaaactaatatgaatgggagtatatgaaaatacagaaatgttaacttagtttttcatagagtattttgagtgtctggtgaaatgaaacattttaagagaagaattacttcacattttaattttgtgaaaatgcatggtttatcaatgtaagcacttcaataatttaacgatttttctgtaagatagtttatattatgcaagaataagctaatgtgattcaaacctatttaatcctatttaatcataattttacccaatgatactttgatatttttttcttgctttttatatcttgaaatttgaacccaggcatgtatattttaaagagtaaggaccccattcatgattatggttaggaggaaaatgttaatttttgaagactggaattagtaaaaatgataataaaagttttaatgtgtcaataacaattggcaccaagtagtcattttcaggttattaatataaattaatgatatggaaggggtaagatgtaaataactgatatccacattaagctgaaaattatacgcatttctttttgtaacttatgcagtactcttatttttaatattaattttgtgatatagattttcagcataatcaagtacactgcagcctcaacataacattttctgctgtacctgaaatttgataatatttaggtctgttttggacctattcaaagggctttggtcatcagcagtactgaatatacttcagcacaacacagtgtcatctgtgatatgtcctcagaatggacccaaccaatagcagatttaaatagaggctacagtgtactcattgtatttgtgctatagtttagattgtattacttggtggggagggaaattactggataatagcaggaacactgtgtgtgttttatttttgtgtgtgtggttgtgtatgtggtatgtatgtttgtgtgtttgtatgtatgagagagattgtgccttatgtggagtctggtagttttggcccatgaccataccttaaagtttcatcacctatcctctgggaccatttctttccttaatatatttaaatcaccaaagtagcttggcacaaaacaggtgaggcctgtctgaaatatgctgaagcccgtgctgctttgtattaactcattaaaacaaggaacctggatcacctgcacctgatctgcattctagtctggctttagaaacacattagacttaaattcaaacgcaccagaaatgaaaataattgatatataattgtttttgtatagtgaagtagaactttctgagtttttgaaatttccttgtttctcaattattcaggcattattcatgcattttattatagcgtaagttaaactgaaataggcagttagatactccattctgtaactctgaacacaatgggtttgtttctccaatttcctagctgtaagttacaaactgcatcctaaaaaaaagtttcaggaagaccagatgttattccaaggggctgaaagttgtctacataacaggctcaattcatataatgaaatgaagagctgctagcagttgcctgatttatttagttggtaatatttgcagttacttcacacacacaaacatacacacgcgcacaaataggtatatataacatgtattaagaacaaatggtaaataatatatatgtatattttttaaaatttatatttttggtttaggaattaaggttttaaattgaatgctggttttagaaatgcatatcctgagctgtgtttttctctttcctggtttgctgtttattttttattttcacattctatatttttgtttagcctgtgagaggctaaagttttctttgatcatatcactcaatgtggccattaatatttctggagaagacacaaacctatttataatactttttaaaaatccgaagtgataataagaatgtttttacattgaaagtaatacttaagtgtttacataacattctgtatgcactcaagaaaataaagttttgttaatacatttgttgtaactcagtacttcatggtgggaaaattgtaatgttcatttctttatattctgctaagccaacttgtgtgactccaaatacctttttttaatagaaaatacatacatctttagtaacggaagataatttgcttccccagagaaactccttgcaaatcctatttaagtacaaaatgtcaaaggaaaaaagtattaaactttttaaaaaaatttgaaacatcagttggaaatgagagcatattaattacttttaaaaaaggttaatgatgctgctatatgagccagtgcatcagatttgctcataactgagagttgagcagtatctatttagctatgtaaaatttggatttaaaatgtcattctgaatttgtcacatgctttcatttttttgctgtagtgtggaaattgttggaggtaaaattatcttgctctagtgaatggcatttaggacaaacttctgtgtattcttaatatataatttcaaaaactaggccaaattactttggtgttatatataatacataggagataacattttgcctccactccctgaaatacattgttctactctttattccaaaactgctaggtcacatgatttaacagtattattataagatgagcaagtcattaattgtatgactattcttaaagtgatagttatcaagtataaagtttaaatatcactatgatatgaaagtacttttgtgacttcttagtttcaaataaaggaaacatttaaatatgtctccagctatttaatcggataaggatatcttaaatgcagtttagtatatttttggatttaataaatgagaggttttaaacacttgagttaagtggaatgccccagtcagagcctcagtgctctttaaagaactactttttacaatgatcaaaaaggtcactaaataatcacaaaattgagaaaacctacagaattttgacatattcttttaaattgttctgccccacccagcctgtggtttctgtagcttttcatgtaattaggtgatgagtgacaacatgtaagctacaatatcttattgttagagaagtaatttgttttgaatcgggccacattcataaggaatttttttactgaagcatgttttttattggtggctgaaggagaaatgaagaaggtaatgctgctggtaatagcaacgatgtatcttgctgtctgtgaaagctgtatttctttaataaaagcatatagagaattgattgttttatttaaaatttttacaaaagatgaattcttttctctatacttggtttttccttccttataaataatgggttgtgtagcatacatttcagtttttcaaaatgacctttcttcttggaaaatggaagtgaactcaggatgcaacatgagtgtcctaaattgaaataaacttttccactgttgatactgttttaatacctttacatagcaatttaaattactgtattataatgttttctttctgttgagcaatgtgattttaaaatgcagatacaattactgcattatatagattatggtgatttctatacttcagcttgcagcctttttaccaaaaaaaatctgtactcttttcttatagatctacacttttcctgtttgtaataaatgttggtccatgtctgtgtgattattcagatttttactttaaaactcaatatgcttttttatctagtttcttagatgcatatataaatgtagaatagagatgtattacaagaaaaaagtacttgtaaacagaactgagtgataatctgaaagtgctttgaataaagtactgtttgataagcaaaggaaatatttgcatgttgactataataagtagtaaactattttaggttttattgaattatctgattccatcccttttccctatccattctataacagagatgtttagatgctgtcacttctactaacatggtctatacattttttcccttgggactttttttctcagccaaagcaactactttcaaaaggatgtagtcacttagataatgacatttctttaaataaaactgtatgttttctaatctttataatttctagataattcttttatgtgaaatgtagccatttattttcaagcaaaatcttgtgctagtcaacctgattgcctatgtatttctcagctttataaagcaaaactaatctctgcagtcattagtaaacacattgaaaatatatggtcattttctttaccctgcaaagactcttacgttttaaactcagcttctttatattctattctttggtgtaataagagtcatgatatattctgaaattgtggaaaaaggtttatgataaaaaatgcatatacattctaaaattaatggtgaaacaaaaaggactattggatcagacaatttgaagtttttgggggaggtagtaatgttttacctaaatttcctagacattcatggaataacataataatatgtaatacctaatacttagttgttaaaaatattgggtattatagtcattaggatcataggggataattttggttcaaaactctatccctgtcccaaaaggtattaaagatacgctgcaacgtagcatccatgaatcaacacaaacatgtaagcccctcataatatcacagagctagaaacctccatatttggaaataaaactaattctaacacatgagactttttacagtgctgagcatttttggttataacttgagctcaggggaatcaggtggcaattgactttcctttataaaacaaaaggaccagtttaagtcaaaagcttaaatattttctaatggattgtttgtattttctttaacgcatcagctttgaaacagctattcctttggaatgagtctggttcaaggcacttccaggaaatgaagatgtctaaaatattaccagtgacatctgtaaaaagttgcacctctaaataaatgtggacaatgcatttattagttgtaacttattactttcaattttattactttaattttactgaatttttaaactttaaattttattattaaaccggtttgctcctagcaacttggtagcaaaaaacaaatagttggtttgtataatggcataataggttgaagtctgcatctagatttttttcccccacataccagaatccacaacagtttgaaaaaaaaattgtgaatatttgctttgaatacaacttcttgagaaactcagctgcttttctaagactcaggaaagcataatgtgggtaagttttaccattttgtatgctagacctccaaagaaaaattttctatttgcaagtgttaattaagcaatagttctaaagacaaattgacatcagcgataggattcaaatgtagttttgaaatagtacattgcaccgtagtaagggtcaaagataacaagatcccaaagctgtttttagtctttctgaaatgaaatctaaatacttctattcatgtgacagaacatgttcagttacaaccttttatttaaatgcaacatttcagctctagcatgtactgttgacgttttaagtcttcctttgtcctaagattcatattctgcaacttttcatactggatttgaagaaaaaagaaggttggctattttgtgatgatggtttccctggaaattttttcattcaccagactatgactactgtacattttacatatagttgaagtggacataatgttttaagtcagaaatttttagagctggaagatgaattagtttagccccctcattttatatgtgagtaaactaaatcaagacattgttatccctggagccaaagtttacaaacttcactgctttagaatcacttggaaagcttttaaagcatacaagcttcccagttagcataccagcactgctgactcaatctctagaggatggacatatggtatgtgtttctggcagctagttttgggaattgaggctttgcagggcagtaattgaatcttactgctgtcagtaaattttatagtttgcagaatatttcctatacttgcctggacaataaagtgattagtctcctggcttgctttttgtatataatcgagtgatctttgaagcatctactatgtgcttagtatattgtaactgttagattcacagtcagggtcagggttagggttacgctgttttaactgtaaccgtttttttactaactgaatttattcctgggtttgaaaactgattttctggttgcataaacttttttaaaaaagacagtcacatgagtgccaaactaagaatcagataacctttaaggacacttcaagtgttacgggagaatcatctaagctgaagaatgtggcttaaaagaattaactgcagctaacttgtaccctgtgtagagtttgaacaagagtgccacatcttggtatttatttttggtttatttagctaacatccttttatttcagtgcaacttgagtgttgtgctggtacttctcattcttctgggtggtggggaatgggatgttttctcacaaataaccagttatttctaacttactatagtcaggttcagtccatttctgagcttttcactagaaagatctgtagtgtttctcaaccattttaaacccatatccttataaaaaatgaaaactcaaatgcttccttaatggcttttgacagttttaaagtcaaatttgatgactaaaaagtccaccagtggtaattttagaatggtcttttcagctgtagttaagaatccaagtactaatgatatttagaattacattagactaaattttataaaacttaaatatccaaaatgacaacactactaagtattacagaagtgcagtgtcattggagggaagattgtcagcaaaataactttgtttcctgtgtttgtacatttcttttagttccctcatccaccatttcctttggttttggctatcgtgtatgaagagaatttttgaaggttttgtgcttcccgtatttggggtatggtattgggtattaggtgaaaaaatgcttaaaactttgattatttaggttatcagagttgaagatccaatcacggcagatcacatggtttaatctgctttgtattggttgaataacgagcattgcttttagggtttacaaactgacagttatttaagcaatttttgtaatgcatttgtaactttattttgaaattactttgaacttacaaaaaagttgcaagaacaatgcaaagaactcccatatatattttgcactgctttttaacatcttgacataagtgctttactgaatcttttttttccgaactataggagattgcattgaatatattatgaactttaatgctttgatgtgtttgctaataacaaagattcttatacatacacacagttgagtgatgcaattcaggaaatgtaacattagtagaataatctgcagtctatgttatacttttgtcatggtaatactcttaaatttcttcggattcattatctaatccaaggccattatataattgtcattcctcttagtctccttcaatgtggaacagcccctcagccttaatttgttttgtttttgagtcttgctctgtcacccaggcttgagtgcagtggcgtgatctcggctcactacaacctcagcctcctgaatagctgggacaagtgtgctccaccacacccaactaatatttgtatttttagtagagatggggtttcaccattttggccaggctggtctcaaattcctgacctcaagccttccaaagtgctggattacaggcgtaagccactgcacccagccctcggccttaatttgaatttgtttgatgcttcatcattagatttaggttataggttttagctgaaaagccaccaaaatggtcatgtgtctttagtgtatttcatccagaggcgtagtaatgttcatttgtcccatattggtgatgtcagttttcatgatgtggttcaggtgttgaccagcttgtccactgtgtagttaatattattcctttgataattaatagaaaaaataatggggagataatttgagactaaatattgtattctcttctaacaactgtccactccatttaaaccctattgattcttggttgaatcagtgatatttttccatggaattatctggtgtttttcaatatgtttattgagtggaaacaggtattctattcatgactcaaactttattgtgtttgaaaactattggaaagtcctagctttcccctccctactatgatttttttcatttaagaagcttactagtgagtatagttagtaaagataattttcaggattttgtcaaatataaaatcatttactgtaaatgatgcctgtcaattctgtcataaatcatatggggaagaaaacttaaaaattgttacttcaagcattaggttatatatattgtatgttacatatatattatatataaactgtatgatataggaaatggatatctatattgatttacttgaccaaatggcaaattattttaaataagaatttagatattttaaaaataatgccatcttttgctttgtaaacaaatagtcaaaaagatcatctagacaaatacgtgatcatttgcaaatgctacattatttaactcgttaaaagttttcagttgttagcaacacaaataatgaaattcttagcactttaaaggaaatagtttctattagcaattaaagatgtcagattgcttatccatgggaatatttgccaaaaaggttcctttttaaatttgaatttcctgagttgacagaatagttaggagattagcatttaaataacaggtattccaagtcaaaataactttgaaaaaaagtgttttatctggctgggcgcagttgttcatgcctgtagtcctagcatttgggaggccaaggtgggcagattgcttgagccccacgagtttgagaccagcctgggcaatgtagtaatcaccccatctctaaaatacctttttttttttcttcaacagaaaattattattcaagttcagttttttattatgggggaggggaactactctgtcctgtgcctcaactgcagggtcagaatttttcttactgtgttactgtaacagtggtctgatcatatttggtagtatggaaaaggtatgtttaaaaatgtcttcatttatttaaagaaatgcagtgcaaggaatctgcaggtaactctataaaggatatatgcagaaataggaatgaaagaatttgaaatctggggaccctaggatattctgcttgcagcttccttattactaggaccttagccaaacaatttaacgttttttctttccaactatttattataaaaattttcaaacaaatttgaaagaataatatatagtcaatacctgtgcacctctacataggctcaataaatgctttatattactctgcttatataaagaatagtaccctgtaaaaccacaaagaatagtaccctgtaaaaccacaataccattatcacacttaaaaggaacaataatgttcaaatctttgtttttttgagacggagtctctgtagcccaggctagagtgcagtgccacgatctctgctcactgcaggctccacctcccgggttcacaccattctcctgcctcagcctcccgagtagctgggactacaggcgcccgccaccactcccggctaattttttttttttgtatttttagtagagatggggtttcactgtgttagccaggatggtctcgatctcctgacctcgtgatccgcctgcctcggcctcccaaagtgcggggattacaggcgtgagccaccgcacccggcctgttcaaatctaatttaatattcagttcatgcttagatttttcctccatgtgggcttctagtcactagccattatacgaactgacctaagaaatctaaaatacagtataattgtggaaatagctattaatatatagtaggtttataactgactctttctttgatcaggagttttttgcattcttcattagctgtctcagtattaggtctatcaatattttggtgggcatttgaaaaaatggattatgtatagctactcacaaccacataaaattgcttcagagaatttaagcaaacctttttagaagattttatggtacaataacttctgtgtagccaggttatcctttgtataaaatcttatctctaaaattctagttgctattctccatacttccatagttttttaatttttagctgtagatacttggacttaatttcagagagtacaaaggaatgctgtacacaaaaggggcaaatctttgtaattttggattttaagaaatttataagagcatgtattttcttacctttttgagacagggtctcactctgttgcccaggctggaatgcagtaatgtaatcatggcctactgcagccttgacctgcacaggctcaggtgatcctcccacctcagcctccagagtagctgggaatacaggtgcataccaccacacccggctaatttttgtggtgttttgggttggttggttgttgtttttggtagagacaaaaataacaaaattttgtatttttttgttttgccatgttgcccaggctggtcttgaactcctggactcaatcaaagaacatattctttaccactttgaatatttttttacattccacattatagagagagcagtaatttttacatctgtttctgggttaggaattaggagtgttattaaaatggcatttacttaaatcaaggccaaaactaaggatttaggtagagtgtattagcctttcaatacctgcttattaaacagttgttttcatacttttcaaaggtgtgtagaagttttgtaaataagttttctgataggataaactagattccctatgatctcttatttatttatcattgttttgagacagagtctcactcttgcccaggctggagtgtagtggcgcaatcttggctcaccacagcctctgcctcctgcattcaagcgattctcctggctcagcctcccgagtagctgggattacaggcgcccatcaccacacctggctaatttttgtatctttagtagagacaggctttcaccacgttggccaggctggtctcgaactcctgacctctggtgatccacccgcctaggcctccgaaaatgctgggattacaggcatgagccaccatgcccagcctgatctaaaaggaagtttttactaattgagattatgaaattttatgaaaaataaaaatgaaagaggggcacaatatctagctctgtatttaaaaatattaaaaggatcttgacttttctagttaatgggaaaatctgatttattaaaactaaatctttatttccagttatttgtaatttgtggtgcatcaggcttagggattcaagataaactttttgagcacatctccagtctatgccactgaaaactcaagtatcttcatgtagctacctgatattcctcagttgattgtaagtaaaccactatgatgttgcatcagaatttgtattatttacctataaaacagtttgcaattctaagcatcccacaattgaagtgttttggaattttactttagtgtattcagttatgcttgtaagatacttttatgggtaagaagaaaagtttacaagctgcagtttgtcatttttaggagactgtgcaaactaaaaatgcagaattgcattgttagcaaaccttggaaagtaattttgtatgtggaggactagtccttaaaagttcccaaaaattgtggccttttagtagaatgaaatttactgatgcctactgacgtatttgcctggattatagtcacataaaattgtccaaagtattaacacctttttttcaatagtacagttggctgttgaatttagagattctcaagaaaagtcatctggtagtaactttgtagacccccccaccatctgtatatttttataggtttttatgtggatataggtaaaaaaaaaaaaaagtaggccgggcttggtggttcatgcctgtaatcccagcactttgggaggctgaggcgggcagatcactcgaggtcaggagtttaagaccagcctgcccaacctggtgacaccctgtctctactaaaaatacaaaaattagccaggtgtggtggtgtgcacctgtaaccccaactgcttgggaagctgaggcaggagaattacttgagccctggaggcggaggttgcagtgagccaagatcatgccactgcactgcaacctgggcaacagagttagactttgaaaatgtcttttttcaggttcttccatccacgttattttttcagggaagatgaggacattatcttcctaaattgcttctaaaatttattaacttttccagtatctgttgtgtaaatgcatgccagacactgcatgggaagatgggggatggtgagtcaaggaaatctggaagaacaggacttgtgaactgaggtttgaagtacatgtatgagttaagcagagaatacctggcagagactgccagtgcagaggccttaaaggaaagagagaaaacatgctttatttgatgagttgaaacaattttagcttgatgatttataattttttacattttagaaatagatgaatggcgtgtttttttaatttttaagctgaattttgcttctagtcattcccagtatattaaggcagatgacttgtggcttacatgaacgttatagaaatatgagaataatatagaaatattatagaaatatgagcttaatggtcattagctcatctagaattgtaactaagcagtgagggagaataattggagaataagcatgaacatctgaaataattgctaggttaataagttggctgtaattttgctctaggaagagcttaagttgagatatcatttataattctgggcccttattttactcaaatgcctacataaatttataagttaaatgactgtggaagcttcctgttcaattctcaaaaaaaaaaattacatgttgatttataaattctcttttggtttctttttctttatttttagtttctatttgagtattgagaaactaatacaattaagaagccataaaattttccctttaatagtcttcatagcgattgaggaaaatatgacagtaattggccagagttttcactttttgagagggggaaaaacatttcctaagataaaaaattggttattttccatagtaggtaaaacctgagaagttgcatgagtttgattcctagaaatgtttttaccatgagtaaaatttgtttttactaaatgggaatcctaagataccacattgtcagcgtctagcttatccaatgacatacagtttctaaattgacttattttgtacagaaaaaagattgcttattttatatgaattttttaaatgaaaaaatggaaagttttccccccttttggataaatatttaagttaatttgcatgtgtttactaaaagggataattttaccaaagggacaaatatttaataaccaagattaagagatactacttattttactgattctagtatcaaagtctgaaacttagttttaaacagaaccctgtaaaatgttttgatgtcttctggatacttttggaatacccaaagactggttaaaattgagaaaagcgaaagcacaagaacagtagtttccaaacatctctcaaaacccaaaaacatcgcgccattgcactctagcctgggcgacagagcaagactctgtctcagaaaaggaaaataaaactcaaaaacgttggcagatcatgtcagtttctaaattttcttttctaattttattgatttgtaatatccaaaaattagggagaattgcctacctaggtggtatgaggagagaaatataaataagaatgtgttgatgtaatagtaatgacattttttaaaagacagtggtattacatgaaataaaatgtttttatgggtgttaagagtaaatgaggattataatggaactttgatcactgaattagagttctgatacaattttttaaattgatgaattttaaatgaatttatatctgtattcttagtaattatgtgaaaagcctaacatttgtatgtttaagaatcaggtttttttagtacattcaggtaggctgatttaataattagtagaaaattattaaatgctaggatacccacaagtataaaaatttgtgcataatgtctgcatgatagataatccacatattaatagtaaagtctcttctctagtcacactggcctccttgatgttccttaaatttattccagacattcctcccttagggcttttgtctacattagctcttttatctgttctaaagatatttttccagatagctgctttgctagctgctttgctttcttcagatctacaaaaatgttaacttctcattgagatctactgtgaccactctgtttaaaattgccacttctatcccctgcagaactccttatcctttaccaagttctccttttcccctataatactcatcacctaatgtactgaataatttacttatagtttgtctcttttgtatgttgctatattccaggaagctacaataatgcttggcatataatggcactatgaatacttgttgaattaaaaatccacagtgggaaataattgtattttacaagttgaatttctaaaaattcaaaggtctcaaaaaaagtaaaatgagttatttcagtttataacaagatgtattttcatgaatataaaattgtgattggctgatacctttactgtgacaggttaaaaaaatgtctttatttttagaacactaaaaagaaactgttcttttgaattgtctaatacccctaaatatttaagtatttcagagtaagctgctttcacattatttagaattatgttgatgtataacataagagaaagatttatactttttttttttggagtcaggttcttactctgtcacccaggctggagtgcggtggcttgaactccgctcactgtaacctgtaacctccaccgtgtgggctgaagtgttcctcccacttcagcctcctgagtagccaagaccacagttgcaggccaccacgcctgattaattgtagagacaaggtcttaagttgcccagcctagtcttgaactcgggctcaagcaatcctcccgcctcagcctcccaaagtgttgggattacaggcatgagccactgtgcctgaccagatttttaccagatctggcttctttaatagattacttttggaatttagtgcctcagtgaacattggattttagagtttttagttacttttcaaggtagtttgcacacattttttttctaatctttttgaaagcttgatattaataaaatactatgaaggagactagcaggtaatatggtgagttaggttactcagattagctctctcactgaaaacagctaaggctgctaggtagaattttaagaatgtcttattaacattgaacttacagcactaaggaattaccaggtcaaagcctaatggactggggagggagaaaaaaggaacgcgaggagataagcagaatgcctaaactgttttggccctgaaagcaactgccaaactgggaagacttgagcttcaattttaaacgcttcaggacttcaggcagcaaaagtcaaaacccaaggcctgcccaaggtacagtgtccaatgggatatcctttccccttaaactatgtgctccaaaagctacactcaggatgacagtgatctagaagtaaatccatgccaccttcctacctgtaagggactgagaaaagttgcgtccgtctgagtagagcagaatgggggaatcctgagatgttctttatgtggatttgtgtgaataaacatcacctgagaatgattcagaaaaactgaagccatgtatgtaaagtagactcagcctgaattatacccctaataggtggtaatagcttattcataccctttctggaggaatgcaccttcttcctacgcctcagagagtttccacaataatctttgaagggaaaggaacagatcagttgttaaaaataagcatataaggaaaccacatacatcagaaacagacctccaaagacttcagaaactagaatttagataagattagcttaataacacaggtgaagagagaattggagaactgaaggcatccagaatggagcttaaagagccaattagatggaaaatatgaaagggatatctgagacacaaattgatagtgtgaaaatgtgtctacttgaagttctagaagtagaggaactacatggggcggaagcacaatttgaagagagaaatactgaaatttccagaatgattgaaggcttcaacagattcaagatgctcattgaatcccaagcagtaattttaaaaattcacaactggacacatgaggatgaaactatagaaaactaaagttttttttcttaaatcacataaatggttggaaacaaaaagataaatgaccttcaaaggaatggcagtaaggttggtaacttcacagcaacaagggaagctagaagacagtggaattgactcttcagtttgctgaaagaaaatagctgtcaacttgaaagttctgtacccagagtcatgttaataaaataccattgtggaagttacgcatgcatttttgaacatgtccaattgtaggtataacttaaatacatatattacattacaagctcatttattaagtatccaggtttctcttcatatttgcttcctagcctaaagtcactctgttccaatgaaagttttcataagtgaaaggactcttattggaatttgaattggtggtctgtttttagcttcacttttttcagggcaaaaatgattatgagttttatttttatgtttattataagtagaattataaatctcacttgattggtttagtaccacaagtttacagtttgggcattaaacaagtagtttcttaaatgctgaatttcagttaaatttttacccaagtatatcacttcaattttattgttaaatgtttataataaccctttgacttggttggaaattagtatttttaataatcttgagttacgccagtgtcaaattccattcattagtattcattttttaggtttggaaattaactaaatgaactaaatttttatggtagtgcctctggactttaccagtttgtgttaaggttgatagttttcttttttaaatgcttaaattatactatgtttagaggctgcaaaggtaatcctttacattaaaaaatgttaaatagttttgacaatattatacatctaatttctgtatgcataacgcatattgtgttttatttgtacattttttgcaaattttaacattttgggggtttttggaatacggttttgagaattgatgaaaatatagatatgtgtttaaatgtaaaaactcaaaagttatatgtcacctagacattccatatatatgtgtatttatattcatatatgtatacacatatgtatatgtgtatatattaaaataaggttcaaaaatcagaagataacaaaaggaacctacagtgaaaagtcacctacccctgttcttgaggcaccagttcccctcagagacaatgttcagaatctagagatgtttaatgcacatacattcatgtgttctgtcctttacattaataaatacctattacattttgttttgcaccttttttttattaagaaagtaacttttggaaatctttttctacaagtacataatattctatgtttcttttaacttgtctcctactgaaggacatgtaagttttttccctgtcttatatattattacagacggtactgcagtaattgtgtacatatcatttccatttgtgtaaatattcttgtagattaaattcctagaaatggaattgctggatcaaagagtatatggggtttatttgaattttctatttcctaatgttcttccacagaggttgtcatagttttaaatcccattgataatcctgtaaagggcccatttttccaaatcctctttacacaatgttttataatcttaatttttgccagtacttataagtaaaaaatggtcctctcagtgtggttttcatttgcatttcccttatgaatgagattgagcatattttcatttttaagagccctttggatttctttttctgagaactaatctctctagtccatttttttgtttttttttttcatctttacaagagcacattagggaagttaagggaaacttttaatgttagcacaatttcccatttagaagttgaaataattttgataaaacatttaaataatgtgttacatttattgctttacctgtttttctcattgtcagaaatggaaggaatgataaatatgttctgagataaaagaacatactttcctttgttattttgatgttcttactgacctgttttacatacttttcttttcttttttcttttctttttttttttttttttttgagacaggatatcactgtgttgccaaggctggagtgcagtgtgtgatcacggcttagtgcagcctccacctcctaggctccagcaatccccccacttcagcccctcaagtagctgggactacaggtgcacgccaccatgcccagctaatttttgtatttttttgtagagacagggtcttgctctgttgctcaggctggtcttgaactccaggactcagtctaaccaccagccttggcctctcaaagtgctaggattacaggcttgagccaccatgctcggcctatattttctttcaaatgtgtgttttgtgcttaagtatttcttctgttggccaaatctctgatttcccattttaattaagtcttaatgtttgcaaattatttttttcatctttttaagctttttatgttgcatctcaacattagacatgaggagactcacatactgttatataatgaaaatagttttgtacatatatatttttttcctgaaaactgatttgcttatgaaatagttatgaagaaaaatcttgattcacattacagattttcaataaggtcatgtatatagagaataataaggtcatgtatatagagatatcaaaatcatgaaggcatctttcaacaatcagatccttttgaagtgagtttatatataaggattatattctattaacagtaaacatttcaaaaccagttttctttcccattggtgagctaattaaatactttatagaatttggttttcaacatgcacactttgctatccaacaatgtatctcaattgtagtaatttgaaagctaatccatagattattttatatcttgtttctgtgcattttgcagtaggatgatgggatatggggagaacagaaagtggttttatgcctgctctcctttccttcctcaggtttaggtattgattgggaaagggctgccaggagctcagtttctttgagaaacagcattaggaaacttgttgttgttgttaatttaatttttttatttcttacatgtcacagcttttgataatctgatatctctactgacctgttatagtagtcatggacaaaattagacctgtatagtagaatcaactaggaagaatggccatatgtgtttattagatttggggagccttccactgcagacttcatttgctggtgaaagtatcaccaccttaacccagagcttgccattcaggtttttttcccttcaactgtctttacattttaatgacagcaccataagggtctgttcttagagcaggaatatcaatataatcttcatttcattcttgcctactaaagccttcatggcagctttccatatagtatttgaacttaattctttacctttggtggcatcactttggaaaatatcacaaatataattagaggaggtaaaatgaaatacaaacatttcaaactataaaataagattccagagaaaataggatatgttttcgttaagcctttaaatgtggccgtgtttggagaaatgcactcaggaattcataaagttaggaaaaagttttaaaatctagtagattttatgaaataattttataaatattctggagataagtacgtagactgaagccattaaaatagagccaaaatttcaattttggaacatgcccattagaaaaaagaaattcacgtctaaatcttcttgattctcctggaacttaatatttacctgaattttttctttgtttttcttaattggttagctatgtctacttttcaaacctccaaagttcctaatttcccatcttttacatggctatttgaaacagcatttttgcttcaaatagaaatcatgttttcattcaagaaaagtaatggaaaatggaattgatttgggtgtgctcacggaaagatcgaaatcctgtgaaaaatctaactttcaaaatccatattagagcttcaattattcctccattttagtctgaatttactgatagtattatacttagcaccctttctaaacctttttattgaagtgaggttttaagtcaatattttaacaaggattataggactcataaagacctttctgtaaaagttatacatttacatttttcatttcccttgatatttaagacagtataatctaaaacctatttttgaatgaatatgtgaatagtaactggtagttttatccacatttatttagcaattattattgaatgtctgctatatgttaggctttgttctaggtgctgtgaaataaaaaacgttatgcctttgtggaattttttaaattatgttgactcgcttgttttctgagtaagcagaataatacctagatggactactgagaaaatacacttaacctaaatacatgcacaaataatatttttggaattaagtggttgaattttaaaaggcaagcataatgaagtaatatcaagtgattgaaacctgagagatgggagggaaagtggagtttgtcaagattgttacaaaaaggaaaacatttttcttatttaaaagggtaatatatgtgtttattataagaaaaaaactctaatggagaaaaaaaccatattcccactacctttgaactataacttaatcacagttaacttttccagatctgtctataaaaccttaactttttgtagcttgttttttccacatggtagcatatttttgtgttatttagtctataaaatcgcttttaatggtggcacagtagtacatcctagatacatgctgtttagccagtcctaattatcatttacagtgtttccagtttttgttttataagaatctcttgcatgaatacaattttatttcaatatttttacatagtcataattgtttctttagattgaccttttagaattcatattttactatcaaaggttgctgttgctggtgtgatcttttgaattgagctgggtaatgattttttaatctttcagaatttaagtaaatatgaccaatgtgtactttgttcaagaatagagaaacagggttgaataaatatacaattttggggaaaacgatgattatttgataagcattttctaaaaaggaacttggaattaggtcacttcaacaacaaaatagaaataaactatccatataggattgagaaggctagaattgggtcataatacaaatgttgattgtatgttcttggaaaaagtgatagggtatcaaaaacagttgcagaatagaattagaatataatttctgatgtaaagttaaaagtattggagtagcagtattgataaaaactaaagtagtctgaggaatatactgtgagttttatagaatgaggaaatgggctatttctaaaattatgcttctctactaataggtaaaaactagaggagtgggcaagttgcttaaaaaatacagaaaagcaatccattgaatttgtatctacttcattgtggaagtttaatcctgtttttggaaagtgatttttaagaaaggttaaatgaagcattactcatgatactgggtatctactataaatgttatacttgatttcatagaataaataaatgtgtacttagaattaaattgccaacaagaaagttacatggaaaaaaatgtgaattcattggatgacactgaaaattaagtaagagaaatagtattctgataggaatctctatcaaaatgggaaagattgtcttgattagtgaactagaatatctcaagtagaggaaatgactaaaggcttttgtccagtgataatacaattgctaatatttttaaacagcagttttcaatttgtatgtagtgagaagtacagtaagagatgaatgaattataaacagttttaagtaaatggttttctgaacaacttcccctctgcacattaaaaaaaagtcatgtgactaatggaagattaactcagcaaacaaaagtgagattagatattataatattttataaagcaatatataaagttcctgtagtaatactagagaagttatattgtttaatattttaagtttgcctggaaggacttttattaagatgatagttcataaaagctgcaaattaaggtagaaaagactataagttgatgtgcaataaactaatattagacgtttgagggaagcaaatcagcaatctacttgattaccattctggctgtgcagtatggaattaatgtcattttttgttttttttttttagatcagaggtttatgaacttgatttcttgactttcctgatagctggagcgtctcaaatgattgcacacatttcttagtctcaattttaattaacctttagaaagatctatgccactcagcaattttgaggagagacaggggagatgacctaatgggaggtagagtagcaaaaccaattgagccatgaatgttaactagtgattttgatacttctggctaaattactcacttttctcaaaaagcaaataccctgctgtatttttcttacccaaaaattacagattattctttgaaaggtaatgtttggcatgctgttgacaagttatttacagagtttagatgtttattaagtaaagtaggctgagtctataaatgttaagtgatggttgttgatagatgccctatatattgggacaaaatcaaatctgagccaaggttttacctttgagattcttgactgaaattagtattgtctaatttatctagcatttatttaactttttaaatcctcataggcctggctaagaatttgagaggatttaaaagtagattttaaagtggggatgtttatgttcagagaaaaataccaatgaattactccgaagagaaacttaccgttcaaaatcagctgtaattttctttctcttgttaaaaaaaaaaaaaaatccctaatctgtcatgagattagagataaaaaagaaaatgttgagttattttttaaaaatcccaactctctcctttgtgaaattgatatgaaaataaaatgtaactgagacagaaaaattgtctcaatccttccagtgaaaatagttttggtcaacagttattgtgtgcatttcttcctactcagtatatattttttggatttcactttttaaatgtactatggatatatttccattcagtattatacatcattgcttttaaagttcctgtgggtgtgtatatatctatatctcatcccattgtttagacaaaacaattacttagacaaagcacagtttaatcattctaccttttggtaatataggttctcaaattttctgtgtactctttcaatgaacatcctcatatatatatatatattgtgctgagagcagtatagtatagtggttaagagctcagttgtgtgatctgggggaagttattaaatctccttgtgcctcagttttctcatctttaagtagggaatagtactttacctgagtgctgtttatggattaaatgagttaatacatataaaatcttggagtagtgcttacaaacattaaatatttaataaatgctgctagtattagcagtatttagtcattttaaattataagaagctgaattgcttcaacttttaagtgtgtaataagcaatgagtttcttattgccagatccttcgtatacccttatttttgacctgtggcatattccaccagatccctttttcttataatgttcatctttgacttcatacatattattatatcctgtttttcttatgtcaagtactctggggttctcttcctttttgttgcctgggaatggatagtttggagaaatgagtctttgcttgtctgaatattctctacttcagagaatatacttaatgccttaggtattgtataccctacatatttataagaaaagttttttttacaaatgacaaatatgcatctttaattccactgtcttattgatgaaaccaacccccatctgctaactttaatcagacaatttatacctgagttgtgtcacctcataataaacctaataaaaagtaaactttacagcaactctcataacacttttcattcttgttcccattaaaaaaaaaaaagtctgttgttcttccctctacattactggttttctctccttgttctaccttctctgagccaaagccagtattaccccacttaaggatgacagcaatagcatctttcctattgtagctagtacctgcttgtctcatcccatagcactaaaagccacctctgtattctccccagcctgtattccctaacctacttatgagtcatcttttttcaactttcctcattgtttacctgccaggaaaacctcagtggcattcagtaaggttttctgtgtgtcagatttaactctgcctttttatgccctctgtaatggaccttcaccataatcagccaacttatttttcctatgcatattctttttttcttgcttggatgtcctcattattccaccaaaaactaaagaaactcatgttgtttcattgacttgtacagactcctttttttcattaatggcctggataccatctgctcagtgaagctttccttgttaactctagtttgcatggaacaccttttcctctgaatcttataggacatagagcatacacaaaataatttaaacttaaatttagtcctttattgtttccatcattagttttatgttttcaactgggtcataaactctttaatagttcaggtccacatccccacttccacttggtaaatcctaaggacacatgacaaatactttttagttggcttgggaaagtggaagactaattaatacctaatggttagtacaaggaattaaaatgaaactaaatttaatctagacccaaagataatcatagttttgtttagcacatttcaattttaatcataattaaactatacttcacagtggtctataatttacactcatttttgacaagtagttctgtgatatatttaagggcctggataattgaaagtttataggacatgtagaggttgtggccaacctgttatatctaaatcagtatatattataggtatacatttgtatgtacatatttatatttttaattttatagacagaatctcaccatgttgcccagactggtctcaaattcctggcctcaagtgagtgaccctctcccttcggcctcccaaaatgctgagatataggcatgaactactacacctggcatttatatctatatttaatatgaaaatacaaattgcagaaacaatacaatttatcataggaaaattaggaagtacagataaagaaaactattctttaggtagtggctgcctcccaaaatataaccaaaatataattccatgagttatgacttagtttaatccaccactttatctccagtgctagaaaagggcctgccacatagtaggcacttaattatttgtcaaataaaaatgaatttatttgcagacactactttcctgatttctttaccttaaaattgggagtgggtggtggaaagaagaatattctgcaaccactccagcagctaacttaaaagcctgtttgtagatcttaaaatgtcattcttcaatatttccaaattccttaaaacgacttgtattctgtaatcttccaagatatttttcaggttgcagaggattagagaatagctgaaaagagtagtgaaaaagtaaatgaacaggagatgaatttatatttaggattccatttgctttcagatttcaggatttggctaagctttttggataattaatacaagtagaatcagacagcttctctgcatctcaaattcagtttaagatgattgtcttaagtcctaggaaagtctatgtgctatactttagagtagaaaagatgcagggaacaaattaggaatgcgactgcaattcatttattcgtttgttcacattgtgaacaactaccataagaactcactttagatggatcctagccctgcctctgctatgtgcccagtactgtctgaaaacctaagtgttgacttgtcccaaatggttattgtgtgaaaacctacacaaagtatatagagacttactttttcctttagattataaagcttcttggtgttcctctatagagttatgtcaggttaatttatttatcaatttttttttttgagacagagtttcgctcttgtccaggctggagtgcaatggtgcagtctcgattcactgcaacctccacctcccgggttcaagcagttctcctgcctcagcctcccaagtagctgggattacgggcgcttgccaccatgcccagctaatttttgtatttttagtagaaatggggtttcaccatgttgtccaggctggtctcgaactccggacctcaggtgatccacccgcctcggcctcccaaagtgctgggattacaggtgtaagccactgcacccagcctcaaatatgtttttaaaccatttcaagttaattgtataatgattcttataactggtgattttaaaaacagcgtactttttaaaacttttgactttatgggattttttttttccccaagggataagggaaaaaattgaatttgaggaaacctgtcaaaatgctgttgacatagagttttatttctctggtcagaaaaatgtgaattttgtcggcacttacatcagcatttcctaaaacatccaatgaagcatgaaatatgttcctaacattaggaaaaactcatttatttttgaacaagtgaatatcatgctttctttagatctcaatataaatatattccagggaaaggacatggctagtctaaactgttaaaaatagatgttagtcaaagggtcattagaccttttctggcaaagttaacactttaaaaattaagtaattaattttgttttaacctattaagtaataggtgatcattagttccaataatttatctgaggatagttttagttccaaaagatacgtgatgaccaattaatgcttgggaaataattgtggaagttaacaaaggcctggaaatatgaagtattcaaaagtattgggaaaagatctgtgtttcctcatcatgttatacttgttttactctccctaagataaccactgatttttttttttaaacagagatggggccttgctatgttgcccaggctggtctcaaactcctgggctcaagagatccattcacctcagccttccaaagtgctgggattataggcatgagccactgcacctggccgttaaccactgatttgaatgtaattaaacttaaaggttaattgatcttgatattgctattctaattatcatactcttctattaaaaaaaaggaagttgaagatttaaaaaatttattattttttctcaatagacacttttcatatctttgtaaaatttggataattcattaaaaaggtaatgtaattgtatgacaaatttttatgatagtatgtgtaccagataagtatttatttgttttttgtttgtttgtttgtttagacagggtcttgctgtgtcacccaggctgaaaatgtaatggtgtgatcatagcacactgcagccttaaacttctgggctcaagcaatcctcccacctcagcctcccaagcagccgggattacaggcatatgccaccacacctggcttaaagttaattctattaagagcctctgtcattgaaaatgatgcactacttttaatagattaaatataagcaagtcttagtaagttttgcaaaattatttgtatgcatataatggtcttattcatttatttatttatttatttatttatttatttattttgagacaaagtctcactctgctgcccaagctggagtgtgtggtgcgatttctgctcactgccacctccacctcctgggttcaaatgattctcctgcctcagcctcccgagtagctgggactacaggcatgcgccaccatgcccagctaattttatatttttagtagagacggggtttcactatgttggccaggctggtcttgaattcgtggcctcaagcaatccacccaccgaggcctcccaaagcactgggattacaggtgtgagccacatgtaatgtggtttataatggtctttaaatggagacctataatggtctttaaatggagacattttctattgattaatggcaggaagttctgagaatcccaaatgtcaaaacaaagtaatcttaggtatcaagaatttttttttatttttagaatttaaaccaggctttgattatcaggtagaatggaatacttatagctaagatgttttcatgtaaatattagtaagtaatacataggataataatcttttaaagaaggaaaatggtgggatggctaaagacagggtattggtgtgctagtctcaccaataatgccatttgaatatggcctgcatttttcctctgcatcaaatgggccaattatagtaacaccattgctctttctggctacttggtttacatagttctgtttagagaagatataatgaaaagttatactcctttagtttatagctttgttgactagtatgatttatgggcacctggaacatctagatgctttatattctttttaattcttgataaccctttgaaatggatgttattatcattcccattttataggtggaaaagctgatactgtaagagaggaagtaattaatgcaatgtgatcaaattcttttcattttgtcacactgcagatttaatctccaaagcacattgatgattttttttttttttccacacagagtttcgctcttgtcacccaggctgcagtgaaatggcacaatctcagctcactgcaacatccacttcctgggttcaagtgattctcctgcctcagcctcctgagtagctggaattacaagtgtgcgccaccatgcccagctaatttttgtatttttagtagagacggggtttcatcacgttggccaggctggtctcgaattcctgacttcaggtgatctgcccgccttggcctcccaaagtgctgggattacaggcatgagccactgtgcctggccaatgatttttaaaagtatttttttaatgaatgatgttttaaaaaataatgagattatagctattgtggtaaggccaccagtaccagctctgtagaaggtctctcaaataatatttactggttgcattaatgaatgacaatcagtggccacgtactagagatcagagaatttttctgtattagtcaaaagtgtctttctacatacatttattgggctaataccaatttaccaattaaagaaataattgatgaatccaagatatgggaccactttgttggggacgggtatgcaaaatttggttatttcgtagatatacataatagacataatttttactgaaatgcatagatgatagtaaagtcttttttcttgtctctatttttgcatccacccgtatcaccctgccaaccataattatgtttaacaaccttgtgggtattccttatttttctctatgctaataatacataaacatatataggatttatttttatttattttataaagatagattatataaattttactatcttttcattcaataagatcttgtggcaattcctcccaattacctgttaaagctgaatacataatattccatgatgcgaatgcatcataatttattaaactatttccccactggtggacatttggtttttaaactgtttttgctactacaaagtttacagtaagtaatcttgtacaattacctctctattctgttgcttttatttttattttatttttttagatggagtctcttgcctgggctggagtgcagtggtgtgatatcagctcactgcaacctctgcctcccgggttcaagtgattctcctgcctcagcctcccgagtagctgggattacaggcgccggccactatgtccagctaattttttgtatttttagtagacacggggtttcactctgttggccaggctggtctcgaactcctgaccttgtgacttgcccaccttggcctcccaaagtgctgggattacaggcgtgagccaccatgcccggcctgcttttatttttataggatagatcctaggagtggaattcctgcgtcaaaagatacattttttttttattagaatagctgttactaatggcttttcaaaaatgctgtaacaattcatatttcctccagctgtgtatgaagtgccttttcattacatggcttcagtagtgttaatacctttgtaagtttttgccattctaatggtttttaagtaatatctattattttaatttgtctttcccacattggaagtttacacattgtcatatagcttttaaccatttaaattttcttttctgggaattaactattaatattctatgcctattttctcaatgggtagctttggttttcctgaccagttgtgtgaactgtatataatctcaactgcacctaggaagctggtgatttaaattcatcctactttattcccactctgtttacctctactaagccaagcagccgaatgcaaggaagcttcaggttctatgggaatctcaaagaagaggcccagtagagggcctagggaaaggactaagaagctgacccatagaaaatttggaacccctcaaatgtctttaccccagacgaatgttgacatcagcctggcctcttggctgagtcctccctactcttgagtagagatttctttctggtttcttggcagagggctagcagcagcttgtttgctgcctacacctgctacacagctgtcatggtagagaagggtcaatttctactactttaggactgccaacacagcttcagtgaataggcaggaaaaaataatagcacatctgaaggatccaccaaccagaaaggaatataaactaaaactatcaggtccttaacaaaatagagctgctagaggagaaatacaactggaacaaagtaatatgaacacaggattcaaagtgctgtattaaaaactctggagtctaaaaccgttatgtatgaaccaaatacagtaataggctaagtggaagagaatattcacatggagccctaaatgaattgcctggggaatctactggacaaactattttaacaccttgagcaaaaattcaaaggaagggtaaagataacagatttcaaggacagaaccaggagatctaacttatatagttctagaaggagaaaaaaggaacaaatagaagagagacacttattcttgacctaaaaaaagccctgagtatatgggttcaaagggcatgctgagttccaagcagattttgtggtaataaaagtaaatgataattactcagtgctcaacctgctaggcaatattctaaaggcttcacatttattaactcattgagtcctcagaatagccctgacaaagtaggtattattatcccccttaatcagctgagggaaaaagaggttaagtagatagccagattgtgaacctaagaggtctgactccagagccttgattgaactgcttcaaagtacaaagagctgtgtttaagtgtgtgctaaaatttatgaactctaaagatcaagataaaaaagtccagaagagaacaagttatcagcaaaagcaaaaaagactgtcatcagcattctcacctgcagtagtttaagccataaaactgggaatactactctattactgtactacttgagataaaaggaccaaaacttctctaatcagccaaaatatttatttacctatctgggtgaaacagatttgctgattaacacagttgagcacctaaccccacccactctgtgatgaaaatactcaaagaaaagagaaatctaatagtatttaatcttggtctttgcacatgctatttctcctgcctggaataactcttccctttcttcagcaaatagctcagattctcctagaaaaagttatctttttcccggaaatcttttgcaattccccaagtctaagtcttttgctcttccaaaatgctgtagcacccagtactttcttcattttagcacttaaccataatatcttacaatgaccttccacttcgttgtcttattttccccataagattgtaagctctatgagggcaggggcagacctgtcttgtcacagtggtagcccccacgcctagcacaatatctgcaatatattaggttgatggtgtgactgaatgtttatatgtagtccaaatttgcatatcttttttgccgctcagattgttctggtagctatacagggaaaggaaagccttaagtttttcttcagtggatacatcctattcaggtagacctatcgggtatgtgtatatttctgtattcatctcatgacttttacagaattttattaaattcacaaaatttatatgtaaatgtatgaaaatccatatagattcaatttacacaggtatatttacaatgcattttatccatgtttgcttcacacttctgttatttttgaaagtaacagaaaaattaataagaaactatagggatgaatttgcaaagttggttaaaaattggtcaaaaattcagactgatgctctaaaaaaataatattaattctatatttttctgtttctcttcagattaaagctaaaaattatgacaaggttgaaaaggtgagtcctcaaatactttgaattttatattgaagtttaacttaaaacctagtatgtataagacagatgtagtaaaatgttaataataattgaatctagatagtgattttttacaagttaattgtacttattcagcttttttatatgcttgaaaatgttcatcataaaagttttggaaaaggaaaagaaaataattatactcccctgacaaatcatgagaagcattttaattatctaaactgaaaatggggaaattatttgctttttatttataagagataaattcataaagggagctgaatttgtgtttttaatgttccatttcatctatgtccatgtgaaatttatttaactggattctgataatatattcttgtatttaaagctatttcagagatgccttatgaaggttttgcacattgatttatggaagtgttatctttcatatgtccgagaaaccaagggtaaactaccaagttacaagtaagtgaaaccaggatcttaagaatgcaagtcatctccaggcacacagttaatcccacataaactcacaccttctgttagccccaagtgggaagaattatcaggatttgaaaagtcaggatttcctaagaattagtaaccttgaaaaaagtgcttcagagaaagtcactggcatgagtcttactctggagaattgaatcgcccaagccctttctatactgaaacactgtataattgcaacaccaaaccactttgttgacagacttgttgtcaaattttttcaaaaaccatcttcatacttgtgctagtaccacttttgtgaggtcacaatgcaatgtgctacttaagtgatctaaggggtctctgacatttgtagtgatataagggatctctgacaattgtattgtgaagttgccatccccactccgaattatacccacctccccatctttgccaaatctaaataatggaccttcttctgaggtgccatttttctatgtaactaacaggcaagttatgtctgttactaaaattctgtctttattgtcttttcctgattatactttttgttatgatttttgtgttttgagacagagtttcagctctgtcatacaggctggagtgcagtggcacaatcacgggttcactgtagcctcaacctcttgggctcaagtgatcctcccacctcagccttccaagtagatgggactacaggcaagagccaccacacctggctgattttttttctatttttttgtagagatggggtctccttatgtttgagactccaaacgtagcagggtctcaagcataagttaatgtccctaggctggtctcaaactactgagctcaagcaattctcctgcctcagcctcccaaaatgctggaattacaggcataaaccaccacacctggtctgtttattgtcttatattgaagtggaagttctttttccctaatgtaccctttacattttaacataagttgcattttaataaaactatactttccagatttctacattttactttagagctaaagatcttaatgtctcattaatgagagaaccacaaatttccacatttgaatctgctatgtatagaattatgcaacttaaatgatataaagataagtaagacatgagccttatttttgataagctcacaagcagtagataaaggaaacaatttatgatattgacaagcttaacatcaaagaacgactttatatacttaaaagatgtctttaatttatgtttatagagaatgttcaagtgttgttctgatcctgtgatcagaagctacattttagttatatatacatttattatttatttatttatagagacgaggtctcactgtgctgcccaggcttgtctccgactcctggcctcagatgatcctcctgcctcagcctcccaaagcattgggattccaggaatgaaccaccacgtctatcttcaaataataatttatttttaattttttttagagacagggtcttgctctgtcacccaggctgaagtgtaatggtgcattcataactcactgtaaccttgaaatcctgggcttaagcactcctcccacctcagccttccgagtagctaggattacaggtgcacgccaccatgcccagctaatttttttaatttttatttttttagagactgggttttgctatgttgcacaggcaggtcttgaattcctggtctcaagtgatccttctgcctcggcctcccaaagcagtgggattacaggcatgagccaccatgtctggcctaattgtagataaattttaataacaaaaaaatttaaaaaccacgtctttcatgttcatttcagagaaaaaatggctcaagcatatgactttgcactggataaaattggaatggaaattatgtcctatcaggtagagttaaaactttttaatgtatgcacttaaatgtaagaataccaagaaagatattaacatttcattttatttcttagatttgggtggattacatcaatttcctaaaaggcgtgtaagtatttgtatagtttttttttacatctacagttgatttagctaaaatataatttttagttctttgagaaatctccatactattttccatagagttgttctttgggtagatatccagtagtgagattgctgggttgaatgagatttggttataatataattgatggcatttcttatccaatctcagggaagctgtaggatcttatgcagaaaatcaaagaataacagctgtccgaagagtttatcaacgaggttgtgttaatccgatgatcaacattgaacagctctggagagactataacaagtatgaagaggtaaattaggtcagagtagttgtttattataaaccaagccattttaatttctatgcattgtggatttgtagattatagcctttctgtatcagtgttacactttttttattgattgtaatgaaagcactataatgtttttgcaaggtttgagagtctccatatagtgttattttttagaggatactctgaagaacaatagttcttataaaactatttttattctttgctaagccatatccacacattcatacacacacatacacattgtcattgacctataaaacagtaccttttgggaattatgtttccaatagtaccttttgggaattattttttggttgctgtgcacctttttcacctgattacagtgatgtgatgattggtttgaatttgtgaagtgtgtggctacaatccaagatctttgtgttattggtatctacttttaataactgagctaatcaatctgaatacataaatacacatgccaaataagctctagcattaaaaggaagttccttggctgggcatggtggcttacacttgtaatcccagcactttgggaggccgagatggaaggattgcctgagcccagtagtttgagaccagcctgggcaagatggtgagagcccgtctctaaagagaaaaaaagaaagtttttcgtatgtatattgtgatttggaagaactatatagggtagtgaaattgttccctcacaggcatcagctgtggttttcaaactttatggtttttggattttaacagttattgaagatcacaaagaattttttgtttttatttttttgagacagggtcttactctgtcaccgaggctggaatgcagtggcacaatcacagctcattgcagtctcaacttcctgggctcaggtgattctcccacctcagcctcccaggtagctaagactacaggcatgccccaccactctcaagctaattttttgtagagatggggtttctccatgttgctcaggctggccttgaactcctgagctcaagcaattagcccgcctcggcctcccaaaatgttgggattacaggcacgagccaccatgcctggccaaaaactgtattttccaaaacaaaaaatgtagtgtgtagtgagaagagtggcattgttttatattttcacaaatctctttcatatctagtgtaatagaaaacagctggattttcatatctgcttccatttagtgtgttataatactaaatgtcacgtagcctctgtaaaactcctgtattttatgagagaggcaaataatgtcttagtgttataatgacaactattttgatctcatggactccctgaaagggtcttagaatccttggagtactcactgagtggtaatgtttatctttccttgctacttctgtttgtctttttaaaaagtgttatacaacagaactagttagaaaagggctattagccaggtgtgatggctaatgcctgtaatcccagcactttgggaggctgaagtgggaggattgcctgaggccaggagtttgaggccagcccaggcaacatagcaagactatgtctcaacaaaaaaaatttttttaattagccagatctggcagggcacacctgtagtcctatgtctgaggcaagaggattacttgagcccaggagttcaaggttccagtgagttaggatggcaccactgcactgtagcctgggtgacagaggaagactctgtttataaaaaagaaaaagaaaagggctatcaaagtcaagccatggctattcacccagatgaatctgtacatattttttttttctttgagacagagtctcgctctgtcgcccaggctggagtgcaatagcatgatctcagctcactgcaacctctgcctcgccatttcaagcaattctcctgcctcaggctcccaagtagctgggattacaggcgcacaccaccacacccagctaatttttttgtatttttagtagaaacggggtttcaccatgttggccaggctggtcatgaactcctgacctcaagtgatccacccaactcggcctcccaaagtgctaagattacaggcatgagccatgtcatttttttttcagtagaatcttatatgaaattattgagccttttcaaatgattctatctttaaaagttcctgataaatggaaacttactgccagctcataagacataagcacatcctccttgatcttggaaatgtataatgtgattgaaccttttttccctgcttttcatgagctgtatgaacctttattaaacaagaaatcttttaaaataaaaatttaaagttatttagtaaatgaataaattaactgtattgtactaatttttaagaaactatacttaattttaaaatatttttgtttttttctagggtatcaatattcatttagctaaaaaaatgattgaagatcggagtagagattatatgaatgctagacgtgtagcaaaggtatggaattccatcaggctattttaatgattattatgagtctgttgtttacagcagagctttccctgtctggtattactcttgatattttcagtcattagcaatcttaacagcaattaattgcaaagtctgaggagatgacatatttgaaatgaaatctctctttgtaagaacaaaatataataaattgggtttagaagaaattgttttttaaaatatggaaacagaagacatagagagagacaaggctctacttagaattgatgaagtaattcttttccctctattatttgggttcatctgaatattgtattactctgtggtctaataacatagctctcagggacacattttgattgtgtgcatacctttccattcattgacactcttggaagttaggaaaaatagcctattaatacaaactattgaaattttaaaagacagtttctccaaagatggcaataataatgccaccagatcttcaatcctattgatctgtcaactcttacatcctggaaagtaacctcctagatcacttacagagagggcccatgggtgttttgtttacccactcctgggaacctgttcttgagtgggtaatactcttatctttctctctactcttaaatagtttttagattatattaacaaagtggtatttggaaaaagtaggcatcttgaacagtcttccaaactgatctaccccatccgccatatatctcagttgttcctggctcaccaaagaattctaaatccttgttgtctaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagaggtaacatgattaaccctcatgggacttcagttacatgtatgttaggccacttggtatccccataggttactaaaattttcttacccctaatctttttttcttttgttcttcagattcaataattcctatagatctatctccatattcactgaacctttgttttcatcatatgcagtctgcaattaagcccatccagtgaacgctttatttcagatactatatttttcaattctataaatttccattttagaaattttttattttttatatttcttttttatggtgtccatttcttagttgagattccttgtgtgttcattaccatctttttctttgtttcttagaacatatttataatagtagttataaagtcctcatctgccaattccaacatctgggccttcaaccaccatggagtttattttctttgattgctttttctcttgactgtggtttacatttccctatttcctgtttaaattttttcttttagatattgtacaaatgtacaaatgaaacattgtaaagactgtagattctttcatcttcctctgaagaatgttttattttagcaggaagttaaatattactgtcagattacttggactttgtggaggcttagttttatactatgaagacaggtctgttttagttttaccattaatctcagattaaataccttattcttgggacatagtctttactcctaagacaatgaaaagtctaaggtgtttaccccaaccatctaattggatgggactcaaattctaaacttcatctcccttagttgctgaggtatctatttaactctttctgccttccagctttgttttctgctggtctgtttgtattcttccctgtgtatgtacattttagggatcagctgaggatttgagaacatttatgcccagattttcgggatctggctttctccttttggggatgtctcctcaatttccagctgctctcataggccagaactccatgttacttcaagacagtaagactgcagcatttgacttgagttctagctatcccagaagtgcacaacatgggcatgcgtttgaagggaaaagccatatttaaatatggatctcacctagtgttgttctgtctttttaagggctcagtctcctgatttctgcttcttttggtcatttccagtacatttagatagttgcttttgtatttgtgttttgtttatttataatttttacttgctgagggttggtctgatacaaactactctgtcagtgccagactcttaatttggagctttattgaattcctcaatcttgccttgctgttgccttgctgtcttacttgcaggtctttgcaaatattgtttcctttgcccactccatttttgtatctaccccatccttactccacttcacttatttgcctctgaccagcttcatcccttcttcaggtgttgtgctagatgtcagttccttagtgaagcctttcttgagtccctaaactatgttaagtcctgctgctgtaagttttcagagtatactgtactttcatcatcataatccttttgatctttgctttctgtctgtcctccccgtatactgcagacttcttgaatataggaagtcttactcactggtatattcaccgtgccttccacattccctggcatatagttggtgctcaataagtattaacttaggctgggtgcagtggctcacatctgtaatcccagcactttgggaggctgaggcaggaggattgcttgagcccaggggttcaagacaagccttggcaacatggtgaaaccccgtctctaaacaagattttttttttttttttttgagatggagtcttgctctgttgcccaggctggagtgcagtggcgtgatctccactcactgcaagctgtgcctcctgggttcatgccattctcctgcctcagcctccagagtagctggggctacaggcacccaccaccatgcctggctaattttttgtatttcagtagagacagggtttcaccatgttagccaggatggtctcgatctcctgaccttatgatccgcctgcctcggcctcccagagtgctgggattacagatgtgagccaccgcacctggccacaagatttttaaaaataagccagatgtggtggcacacacctggtctcagctacttgggaggctgaggcaggaaaaccacttgagcccaggaggtcgaggctgcagtgaaccatatttgtgccactgcactccagcctacgtgacagagaccctgcttccaaaaataaaaaaaattaataagtgatggatagatggagggaacttggatggatgatggtgccagaaatcactaaagctttttatttctaattatcattaatttttgaggagcctaatttggttatgatatttacattgatagttttacaaataataattattttaattgaatattgtttgttaatttcttcccttagttatgtttgcttatgaacagtgcctgcttgtgctgggccatcaccctgatatttggtatgaagctgcccagtatcttgagcagtcaagtaaactgctcgcagaaaagggagtaagtgttccttccctatccccactttgatatttttgtggttttgatatagcaattatttactgaaaaatataactgaattttggtaataaagcataagtattgaaaatttaagtttacgttcatatgaatcttagtgacactcatataattagacctccttagaattaaaataaactggcagttttttaacgtatcaaagtaatgaatcatttagagtacttgcatggttattttgtaagttaaaataatgaaaggagtttttggaatttttttagaatccagaaatgcatatgtgtttatgtatgtgtgtgtgtggatacatatatatgtgtgtacatacatgtatgctttcttagacacataaataaaataaagtagatgtaactttattaattttattctctcacaactatattaaaattattgaagatgagctttcttttttttctaccaggatatgaataatgccaaattatttagtgatgaagctgctaatatatatgaaagagccataagcactttattgaagaagaatatgcttctttattttgcatatgcagattatgaagaggtaagtaaaaatgtttagagccttcttataattcaattttttagtgcaggactgaactttttttctggctgcttgtttgccaggcatattgcttttggtagacagagatgatgccaaatgaacagttattagttgtcagcttatactatatttatgctcaatggagatgccattgggggtgggaggttatagcctttggattccttggagctcaaatcctgcttatttatgaccatatgttgatactcacttcttctgtaccaccttagagtcgcatgaagtatgaaaaggttcacagtatatataacagacttctggcaattgaggatattgaccctaccttggtgagtaactttacaaatctttttttccacctttacagtcttatctaacaaaaaataatttaaatttatatacaataaaattcactgtttttgttgtatagttctattaatcttgacaaataacattgagtatgggatccccaccacaattaagatagaaaacacctccaccatcctccaaaaattcccccatgtgacccctttgtagatataacccttccctctgcccttacctctgacaattactgatctgttttctgctagaattttttctttttaatgcagcagtataaaatagatacagaggcactttctctaacactttctttgtgatcatggtttgaagtcactttatgccacagaattgttgcttaatagatatttctttttaaatgaggcgggagaaaccgacatcctgggaagaaattagactgaaactcactttatgctaaatcctgctctatcatagtggttttcaaagccccaagtgcaaaagtgcagtgatgctctcccattgggagaggaaggggacaggcttgtgggtgtgtctctagaacctctgcctcaagtcaattatagctacactactttttcttgttaatgatttatattgggattccactgctataattcctacatttattcatcatcttataattcattccacaaacatatctggcaaatatattgctagagtctatgcattgtgctagactccagcaacattaatgacaaactagatgaaattccttttcttgaggaactcatagtccatccatccatccatcaaaactgggtaatatagctagacattatcaatactgggcaaaccaggaccctactaattagtcatttgttcactaaacaaaactgcatactcatgatgtactggacactctgtaggtgctaggtataaaatggctcatagtttatccatgaagttctattatatgttgtttggaaaatagagtagtgggcttttaaaaagaaaccaagaaaatgtgaagttaaacatgtattgcaggctgggtgcggtagctcacacctgtaatcccagcactttgggaggtcgaggcaggcagatcacgaggtcaggagattgagaccagcctggctaaaatggtgaaaccccatctctactaaaaaacaaaaattagccgggtgtggtggcgtgtgcctgtagtcccagctacttgggagcctgaggcaggagaatggcttgaccccaggagacagaggttgcagtgagccaagatcgcaccactgcactccagcctgggcaacagagcgagactccgtctcaaaaaaaaaaacatgtattgtaagacgtgcttgtattaaaccaacacttgagttttttagatattgacattcattaatggagtatgttctagtagtgtcacacttttcactcttaaactttaatttacatattctagaattagataatggtgatgattgcacaaccttgtgaatatatttaaaaccactgaattgtaaagggtgaattttgtgctatgtgaattatgtctcaataaaaaaataaattaatttgcatgcatctctaataccagaaaaaaattagtttgtggatttaaatagaatattatctaaattcctactttctaatttattgggtattgaggattgctttcttatgcaggaaacatactgtctaatttatagaacacaaatactttcttttcataggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggtaaatactgaaatacaagtgtaaagataaaacaacttccttcatctgaggttcgtaaaagaaaggtgattttagcttctgtcattaagcttttattgctccatttcgtaaaggcagtctaagtgtatctgtgtaaaattttatggagcatcatccaaatccccaactacttgctaatttatgcttcattaatcactatatttctaatttgtgctttattaatcactatattaatcactatttagtgatttctaatcactaaactcctttgaatagtttctagctcagcaatttttacttaacatgattttaatttgttttaattcttacatattttgtcatatgtaggtataattttaatattctttcaagtgttttttatctgacatttcatggaaatctgtactttactttctttacttgtaggacaaatctgttgcctttaagatttttgagctggggctaaaaaaatatggagacattccagagtatgtcctggcctatattgactatctttctcacctcaatggtaggttgattctagaatctataatgattacttaatattaaaccatgtggaattatgttgctagatttcttccttcttgaatgtattataattttgacatagcagacaggcacttgttaggcactcaagaaatacttgtggtatatcaaccatgaatatatttactgagcaatggtagatgttttttgactctgcagaactgtctttattcagtaaagtaccatcagtagtgggataaagcttcagagtcagagtcaggagacacagagttgtttatattcatctctgatgactctgggcagatcatctcctgtttcctggaaggaaaacaaacaaacaaaaaaccctctagccaccaaaactcaaactcaaaagatgcccaaatagtaaagtaaaacactttgaggatactggggaaaagattcaaaaagaaacattttggtttttagtatttatttatttatttatttatttatttattttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccggtttttagtatttatttccctattctgttgtacgaataacactggccatcctttattgagttcctaccaggcactgtgctagataattcatatacgtatatcatttagtctagttaacaacagtccacaatatgtaatttcttaacaaaaaaagatgtagtataaaagttggttttttagctaggtgtggtggcgtatgcctgtagtctcagatacttggatcacttgagcccaggaattggaggtcacagtgagctgtgatcacgccactgtactccatctagcctggatgacagagcaagaccctgtctctaaaaaacatttaaaaataaatgaataggccgggcgtggtggcttatgcctgtaatcccagcactttgggaagccgaggcaggcagatcacccaaggccaggagtttgagactagcctggccaacacggcgaaaccctgtctctactaaaaatataaaaaattagctgggcgtggtggcaggcgcctgtaatcccagctactggggaggctgaggcaggagaatcgcttgaaccctggagggggaggctgcggtgagccgagattgcgccattgtactccagcctgggcaacaagagcgaaactctgcctcaaaaaaataataataataaagtaaataaataaatataaataaatacatcactaaaagttggcttaagaaatatgcaattatatgtcatgtaaatgattatagaattagatatcataggtataaatcagtaattttaatatttcagaaaaatagagcattccatttacctaaataatataaaagagtaaaacttaaatatgattttgtatttcagcttaatgattctacattctgggaaaaagacttaactccaaaaaatgagatagtggggcatttaatattcctcataaatcttaaattgttttgcctaatttttttttaaaatagttactagtatatgtatttttatttttttaaaaggaggatatctggtgttagcactattgtcttccaaaatcagtgtcttagatgattctttcattcatctatccatctatccatccatgaaacatttattcattaccttctggttactagagtctgggaatacaaagatgaataggatccagaaaaacgtttttgtgggggaatccaatgtgtaaatataattgcatcatcatttgatgtttcactgtagcatagttctgaggttaggtgtataatcttaaacttcagttttctcatctgcataatggtcataataagaatacctttcataggactgttgagagggtaaatgagtttttgcatgtgtttcacttatatatagaatgttgtgattattccataaatgttatgatgagggtggtgatcattaaaaatgtgctaaatactgtaatagattcctgaaggaagtactatggaagcacagagaagagagtataatttaagttatagagctatgctgcacaattatggtagtcactagactattaggtattgagcacttgaaatgtggatagcctgggctgggtgtggtggctcacacctgtaatcccagcactttgggaggccgaggcaggcagatcacgaggtgaggggttccagaccagcctggccaatatggtgaaaccccgtctctactaaaaatataaaaactagccgggcatggtggcgtgcacctgtagtcccagctactcaggaggctgaggcggaagaatcgcttgaacctgggagacagacgttgcagtgagctgatattgcgccactgcactccagcctgggtgacagagtgtgactccatctcaaaaaagaaaaaagaaatgtgactaggccaaaatgagttgtggtgtaagtgtgtaaatacataccagatttcaaagacttagtacaaaaaaaaatgtaaactatcttaacaatttttcatattgattacatgtggaaataagatttggatatattaggttgattaaatatattaatttcacctgtttttacccattttattaaattccatatgtggcttgtattatattgctgatggacagtagtgttctagagggtgtcatagagaagggcacatgagttggattttgagagatgagtggtagttagccaggtaaagaaagataaatgcattattccaggcagagagcacaacacataggcaggcagtgtgaaagttctgtggaatggtaaaaagtgtgtctggagcaaagcttgggataaaacagaaaaagataaaatgtaagatttgtttaacattttttaaagtataatatgttaaattgaagagagaagccaaaaaaatagcgccatcttctttggtctaatatatttaatttcttggttttattttgcttatggacatgtaataaactgaataactactctcaggcaataaaaaacaactcctctgctgggttaatttttcttttgaacagctttattgaagtataatttgtatactataagtccatccattaggtgtacagttcagtggttgttagtagtagattcaatggttgttgttactgttagattcttaagttttaaaagataacttagagtttagcaagaagtgtcattttcccacttccagatatagaggacctcctgagactcttaaaatttaatacacctctgtcaacaattcttaattcatttacatttccatagttacctgccaacctagatattgtacctctgcaagagttaaagtagctaaatatagcatagtcctggtgcctcaaaataagaaactcaattatttctaagtttgagtttgccatccttccatgttcaatgtatttaaaaaatagcagtagtctgactaatgtcagcagatatgtacttgtcattatttttaaaaggcaaatgggatacctggttcagacggcactgttataaatggttttgcattagaactgcagtatagtagaggagggctgaactagaagggaaaaaaacatggcttgcagttactgctctgctactcaatcaccaagagccagatcaaatctcttaatctttctgaagctcaagtttcctcatctataaaaatcaagtgtgataatagttaaacctttctgcataggatttttgtaaggatgaagtgagataatgcatatgaaaatattgttgcatcgtaaaagtgaattaaaaaaaattaaaatctttttcaatatcctagaggacaataatacccgagttttgtttgaacgagttttaacatctggaagccttcctcctgagaagtctgggtaagccattgtgaaaagttgttgatcaggttctaaagacagctttcttacctgaattgtggtctatggggtgaatgtttgcttgagtatgagtttcaagagaaatttcctttccttctcaagttttattttacctatcagcagtacttttatacctgtttaagattatttttaaatttctgcacagtgattagaattgtttttaagagatgccatagcaatttattatcatctttcttgtatactatatatccctaaccagaaattgtggctcatgtctgtaatcccagcattttgggaggccaaggtggaaagatgactttagcccaggagtttgagaccagcctgggcaacatagtgagacccaatctatacaaaaaatgttaaaaattagctgggtgtggtggtgcatgcctgtagtcccagatactgggaggcggaggtgggagctggaggactgcttgagcccaggaggttgaggctccagtgagctgtgatcacacctctgcactccagcctgggtgacagagtgagactctgtctcaacaacaacaaaaaagatacctctctctctctccctagaaattgatattaacatgttaagagaggcattctgaaattttcacctcccttactcaaaagcaaagactcttgtaaattcgaagtttgttttacatattatgtctctgacttacggttttgtctcttgttagttttaccatacagaggaacaacactgtcaagtggtacagcggaaatattatagtaaggctttggagtcttgggttcaatatccagctagatggcaaatttcatagctataccaatcttcactttcttattaacaataatgtccaccagtgtaggattttttgtgatagccacatatctggtatataagaggcacttaatagattactttagtacaaaggtgcataatgacatttaagtagtctcagagcattaattttagctgttagaacaacgatgaggcaccagtttttccccagtgatccacgttaatgggaaacaatagcgtaatcatattagattttggagtatatttctattcatatattagatgaagaatgtattctacattataattcctgccacttaaaatgaagccacattattcaggagaaattagaaatctgtctaggttccttttccaacttctccacctagagtttatcctctctaaggtaagtctcatgttgaccacaaagaagcagcagctatactaaataagtaaaaactcaaaaatgggcttaaatactgaagtgataggtttataatttactttgaaatacttaagcaaaaataagatgaagcaaatatggcaaaatattagcaatataggtagtggtatataggtattcattatactattctatttttctatagtctaaaaatctttataataaaaagtcactttttataagttaagggaaaaagagagagcttaaggcgtttttgtaaatgaactccctgccctaaacccagaataattaaagtattgattgtatttcttttcttgcagagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggtatgtacttaggatcaagatgtggagtgtcctcacttttccagtgttttagaagagttcattgataacctgcactctaaattctgaaatgtgaatctagttttagaatagatttgcaggaagcaagaaaaaagttcaaagattttccttgggtttaggaaatcctgagtgtcaaagtagctgaacaaaatgagaattgaaatgggatttaatagtttcattctgtccctgaaattgtcagtgccttatatcttatatctggtgggcaagatggagggagtgtggagggaagaaaaacaaaagaaaatctgaatgtcatcttaggtattacttttttttcctaatagttcttatcaaattgataaatatgttttgacagatcttaaaccaaatgtagttcctgttgcatattttgtaagatataatgaagaaatattacagcttgttaaatccataaagttccttgagggatttgtattcttaaaacagtgctcctccagtggcctttgggggaattagctcatctatgaatagaactcttctatacagactactgagtcataagaaaacaaatctggcacctgaacctgttcaggccacagggagagattaatatttacaaagccccagtaacagcccttgctgataaaaccactgttatatcatctcttaatctttctgtgacatgtgaacaaagactaagatggaaattcacagagaagtccttggttgatctctttaagccaaccaccattaggatgttcctgaccatcattctccttttcctcactgccctcttttagcctgggtcttgctctgtctgatccagataaaatattttgagaaaaaactacccataattgatattcagacatttttgttaatggaagccctatttctgtgccagatgcagattcctggtatgaaccataggattactgctcagggataagtagtttctgcttctagttttaactacttctcaatgaaaagtcaaagatagtttaagactacagtaaatcctcatttaacatcattgataggttcttagaaactttgactttaagctaaatgatacacagcgggtcctcaaataacttttttgtgtttaacatggttttgttataaccttgataagaaaaaaattggttttcctatacatcgtttctgtcttttttttttttttttgagatggtctcactctgttgcccaggctggagtgcaatggtgagatcatggctcactgcagccttgatctccctgggctcaggtgatctcctgttcagcctcccaagtagttgggattacaggcaaatgccaccacatctggctaatttgtgtatttttttgtggagatggggtttcaccatgttgcccaggctggcctcaaactcctaggctcaaggaatccacttgccttggcctcccaaagtgctgggattacaggcagcagccaacacgcctagcccatcatttctctaaaagttgcagtttcctagaacctatacaatgttaagtgagggacttactgtactttgtgcaattgctagaaaaagctatttcaacttttccaagatgaaaatgaaaattaaggcagttaattaaaataaagatctgccaggcacagtggctcacgcctataatcccaacactttgggaggctgaggcaggcgatcacttgagcccaggagttcaagaccagcctgggaaacatgatgaaatcccatctctaccaaaaaaagagagaaaaatacaaaaattagccaggtgtggtggcgcctgcctgtggtcccagctattcaggaggccaaggtgagcccaggagggaagctgagcctactttagtgagccgtgatcaagccactgcactcctgactgggtgacagagtgagaccctgtcttaaaaaaataaaataaaaaataaaaataaacagaaaagaaagatcttatagtggccaggtgtggtggctcacacctgtaatcccagcactttgggaggccaaggtgggtggatcacctgaggtcaggagtttgagaccagcctggccaacatggtgaaaccccgtctctactaaaatacaaaaattggccgggcttggtggcgggcatctgtaatcccagctactcaggaggctgaggcaggagaattgcttgaacccaggaggttgtagtgagccaagatagcaccactgtactccagcctgggtgacagagtgagactctgtctcaaaaaaaaaaaaaaagagagtaagtattcaggagtagaactacttcctgaatatgatgttttccatcttgtatttctatttctactcttttgttttttggggaaggattaatgtgcttctgtgtttaacggtgggtggtatggtatgtatgtatctgtgagaaagatttttaaaaagcgatacccaatgtgtctaccatttagatttgcttatataattaataccagatgtcaccaactccatttcaacaaattttgagaaagtggaatgcttttatatcccttgatggcggcaaaaaggggttcttttgtttctagacagacagagtaacactgggttgtctggagcaaaggagctcctctgagatagggcctctgttcataggtgactgtattgcttcctttggcatatcttgtctcagccctggcagggcaatgctagtgtactgaaaagaagactgtggatggatttgaggtcagagaggcctgccctcccaatcctcctctctctacttcttattagctgtgtgacctgggaaatatcaaaacctttgtgagcttcagtcccttctatataatggagatgttactatttccctcattaaaaacagaatggctaaaattgcctgatgaatagtgtctgctcagtaaatattccttgtcccctgtaataaatagtacattggaaataatttttcattgcattagcaaaatcttaaccggtgtgatgccttcacaaaacaggaagtcacttaatccagcttcttcatttaatgaaactggtgttcaattctaatggaagggaggtgtcagaagatctaaaatcttgaattttcctccaaattatcctggcctctacttggttcccagtctgactacccaaaaaagcttgtatctgtcctacaaatgtcctgcctggcaacactaagtttaatgacttgtaacttgtgtggggtaaagttatgatacactgagtcttagaaccaaatagctttccttgttgagtaacaatctttaccatcattagagtccttgcttatccgtctccattttctttctgtggttttgacccagatattcacactgtatcctcaaggttattgcatgattattctctagtagtccctttttcaggtttaggattcttctgttctgcattttcaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacgtaagccatgactttagatccagtactgagacgttggtttgtttgttgatttaaatccaaagcgtgggggtaaagtgacatggcctctcaattgtgggttaattattagacttaggatcactatgacaagtgatttagctttaatctttgaactagattaactaagaatgtcctaaaaacaaaacttcaatgatccagattccaggaacccattttggcagtaatacttggttttcagaaatgctgctatggccaggtgcagtggtttacacttataatcctggcactttgggaggccaaggcaggtggatcacctgaggtcaggagtttgagaccagcctgactaacatggtgaaactttgtctttattaaaaatacaaaaattttctgggcctggtggcatatacatgtaatcccagctacttgggaggctgaggcaggagaatcacttgaacccgggaggcggaggttgcagtgagccaagatggtgccattgcactccagcctgggcaacaagagcgacactctgtatcaaaaaaaaaaaaaggaatgctgctatgtgcagattacctgaacagctggtggaaactttcttcactgatagatttggtttctttacttaggaatgggttagtagcctctctagattctttttgaacaaggcccttctgattaaatacactgttgaataattgacttgaaacaggattgctaaacaaatgacttgtgtaactcagaaacactctttgacaaaaactgactttagttcagtccctggttgtcttacacaaagtcacttgtctacttctctgcctcccagtggccacggcattgagactgctctgtctcacccactttggtttggtaaagccctagaagtattttcagtgtccagaacaaagcagcagacatggaagatctttatgtgcaagtcacttgattttagctctgtgtagaaattcttccattccacttgattcatacttttctttttctcacagctccaggtttacaccctgtacctggtggagtgttcccagtccctcctgcagctgttgttttaatgaaacttctccctcctcctatctgtttccaggtttgttcacttattttcatggtagatactggctctgtgggtcatagtaattgtgtataaagttactactactttaacttgtcagattactgggattaaaatttattcatgtcaaaaatagggtccttttgtacaagtggatgaactgatggaaattttccgaagatgcaagataccaaatagtaagtaacagaagctccatttcagagtgtcattccacgttgttgtctcataggcagtagagattattattctctgccactgaagttttcgaaaccagccagccaatttgaagtgcagtgaaacccaggagttacccaaaccctctttggcagagagaggcttattcacattgaattccactaagtaaaatgtcataaaactttatcttttctattcatgtgaacatgcactatcaggcttggcttatgaaaattattagttttaacagcagcttttgtctttttctttaattatttagtatcagtagtactatcccatgttttgctaaaatagtaggctatgaaataaactataaagtatccacagttgaacatacataccctttcatagtggaatatgtttttacgttttgttgttttgttttaatagctgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctacagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaacatcatgcttcctctgcttctttcagattttatttacaataactacttatgttatttatccaataccatttaaaaataaatgtcaggacaaggaaaagtcatcttgtatttactaaatgtattaatcacatactccttcctggtcttttttggtgctaactaaaaacatttttaagaggcaaattaaacattttagaaatcctcaaatatgaatgcatttgctccccagtaaatctgaggcagattaagatcctgttaatacttttgtctctcttgaaagcaacctaagtgtggaaattcctttaaccacctgctgtcttgttctcacatagagtatctcttatctaaaatacttgggaccagaagtgttcaggattttggatttgttcagatttcagaatatttgcatcatacttaccagttcaccatccctaatacaagagtacaaattccacaaaactccactaagcattttctttgtgcatcatgttggcaccgaaaaggttttggattttggaacatgttggatttcagattttcagattagggatactcaacttgtatattttcacaggggcccagtgctcaagaacatttttttttccatgagctaaacatagataacattaaggaaaatgacatttatttaactaaattctaattacagtgagcaaaaacttgtcatgcaaattaagtccaaagaactagactttgctctttggtaacaacattacctcctcttctcattactagttaaaaactaaaaagcaggagggaaacaaaaaggaggggaggacaagtattatgattataaagaaatgatcttacatattagaaacaatttagtttagaatttgaattcagatgtgattaaataatctgacatttaaaatcagcttcaaatgtcccataaaagtcttacttgtaaaaaaaggttatgctgaatcatttactcatataaatttatatgtagcaaggttatataaattggtcaaaagtgtgtttagtttccagtattttcccattaaagctaaaaatcgcctctcaaaacaaagtcagctgcctctaattcagactttcttatcctttcaagcatcactttcaagttgtgagttttttaaaaatatcagttaccatcaaaacttaagacacaagtaggccaggtgcggtggctcactcctgtaaatcccaacactttggaaggccgaggcgggcagattatttgaggccaggggttcaagaccagcctggccaacaaagtgaaaccccgtctctactaaaaataccaaaaaaattagctgggcgtggtagcccaagcctataatcccagctacttgggaggcgaaggcagaagaattgcttgaacctgtgaggcagaggtttcagtgagccgaggtagcgccactgcactccagcctgggtgacagagcaagacgctctccaaaaaaaagacaagtaataccatatggcatagactttaaaatacagagatgtaggctgggcgcggtggctcttgcctgtaattccagccctttgggaggctgaagattacttgaggccaggagttcgaggccagctggccaacatagtgaaaccctatctctactaaaaataccaaaaaaaaaaaaaaaaagttagctgggcatggtagcacaagcctgtagtcccagctactctgcaggctgtggtgggaggatcacctgagcccaggaggccaaggctgtagtgggccatgattgcaccactgtactccagcctgggcgaaagagtgagaccctgcttcaaaaaatatatagaggtgtagacttgttcctgaagtgccatttttggtggttagtatcgggggtgagcagcgactatctggggctggtggtgtgggggtaagaagaatttaccaagacaatagtaggtagagaaaggtagattagagaaggtatgaaaatgcactgcaaggttggaacaggcagagaagatgcttgtctgcaaagagacaaaggcttgctggggattttataagatagtgccatgtgctgaagagggttttatgtactactgagaatgccagtgttgcagtgagctaacttgcaggtgtctggtgataagttgggtgcagtacggctacatgtcctggaccatgaagaaaggcagactcataatttatctgcttttccctgctcccaccagcctgactccctttccctaattaggactccacagttagtgttttgaagacaaacaggccgggcgaggtggcgcacgcctataatcacagcactttgggaggccaaggtaggcggatcacctgaggtcaggagttcaagaccagcctgaccaacatggtgaaaccctgtctctactaaaaatacaaaattagccaggtatggtggcacatgcctgcaatcccagctacttgggaggctgaggcaggagaattgcttgaacctgggaaggagatgttgcagtgagccgagatcgcaccattgcactccagcctgggcatcaagagcgaaactccgtctcaaaaaaaaaaaaagaagacaaaacagtttcaaatacctgtaagtgatctgccaaagtgttcccacagacaataaaacaaagccatgcgaacatgtgtgaaaaaccattttttagcgtgtgtgcgcgtgcgtgcgtgcacacacgcacacacacacttggtgaaaagtgtctttaatcactttattagtccattcccacaatgctataaagaaatacctgtgactgggtaatttttaaagaaaagaagcttaactggctcatggttccgtaggctgtatagatagattagtggcatttgcttctggagaagcttcaggaaatgtataatcacggcagaaggtgaaggggaagagggacgttttacacggccagggcaggatgaagaaaggggggaggtgccacacacttttaaacaaccagattccatgagaactcactgtcacaagaacagcaccgagaggatggtgctaaccctttcatgggaacttcacccccctggaccaacacctcccaccaagccctacctccaacactggggattacaatttgacatgagatttggtggggacacagattcaaaccatatcaattattattaaggctactatgtatattataattgttcctattgcatttatttataggatttttttctcctagaaatgatcagctctttgagcataaaaaggattctcattagaagaaaacattttcgaatgttctaactgctagagatatgtatgaatttttagtttttaaggtgattctgcctgatatttgataattccttttgttaaacagttcaacaagcagcatgatgttagacatctgaacttacctttggaaatctaatgtgcagactcatgggataatcagtcctacaattccaaggactcatatcagtattgctggacccaaagaaattgccaaaagatatccatctttttcctgtttataaaagcaatgacagcatctcctcaagattctagaactagacaaaagtttcaaggactatatgtatgtccttcctaaacaaaaattagtcaaactctggcctttaccactaaacttcaaacaagaggttgcacctatgtggccacatctagtacagtaaaaggttaatagaaactactagtaaactttctgaacaaccaaactgtaccaaagaaaaagaaggaaaaacacatcatttctgttagtatattgaccctggtcaataattatgaatttatttgatattataaccctgtattggcctatagttaataaatgttgagttcaattttattaaaccatagtcatcatggtcataaattattattattattttttttaacatggtagttctttgactgtggcaatgagcaagtgaacttacgttttacttaataaaaatttcagccaggcacggtggctcacatatataatcccagcactttgggaggccaaggcgagcaaatcacctgaggtcaggagttcaagaccagcctgggcagcatggtgaaatcctatctctactaaaaatacaaaaatcagccgggcatggtggcgcacacctgtaatcccagccactcggggaggctgaggcaggagaattgcttgagcttgggagctgagattgtgccactgcactccagcctggacaacagagtgagactccatctcaaaaacaaacaatcaaaacaaaagaaaacaaaaattttcataagtctttttgtttgttttgagacatgatcacagcataatcctcccacctcagcctcccaagtagctgggaccacaggcatgcaccaccatccaccatacccagctaattttttaaattttatgtagaaacaggatctacctgtgttgtccagcctggtcttgacctcctgggctcaagcagtcctcccacgtcagcctcccaaactgctgggattagccaccatgtgaagcccttcttttttttattttttattttcttgagatagggtctcactttgtcacccaggctggaatgcagtggcatgatcttggctgaatgcaacctctgcctcccgggctcgagcaatcctcccacttcagcctgctgagatgggagcacaggcctatgccaccacgcctggctaatttttgtacttttagtagagacaaggttttgccatgttgcccaggccggtctagagttcctggcctcaaatgatctgcctgcctcggcctcccaaagttctgagattacaggcgtgagccaccttgcccagcccctcttgttttaaggttacttttaagtcaagaaaagtgacactccatcgaaccaggcctatagcttagttctggttcttaagttcggtaggcaataaatgtaagtcaggtgtgacagaaacccacatgagggacagttttaagtagaattatatgtttagacttttaacacatattttgtagaactctggctatttctgaaagtaccagtgaacacttgatcgtttaataaacagagcttacctgggcttaaagattatccccttccccacccattgaagttgctttgaatactatgactaaaaaggctttccattaaaataattatataatgcaaaatccaatataaatacacacttgcaaatatcattgtagttatttatttagattgtttttaaatgagatagtgcctttaaatatgacttcatagcccattatccattaccattcattcatccactcatttgttcattcatgaattcatttagttcaaataatatagaggtggagatggggagaaatcactggggtgggggtggatgtcaggaagtaagcaaatgtaagactgcagctctagtatagaagagatgatgaacataaacaagtcttaggagaggacaggaagaaaaccttccctgtaggcccgtaaaatgtgcttgaatgaagggaggttgggcgctaccagtggaacgtaacaccacagcaaatgtgcgcccacaggtagagggttacatgttcgcctttgtagttaaaaaagaaaggtatagtccttttccatgtacaaagcattctatcattcattaccaaatgtaatcctcacagcaacagtgtgaattaggagtgttcccatttaacaatgaaaatgccgaggccttggggagaatggctggtccaatgttgtacaaccggtaaggcggcgatagaggagaaaagactaaaacccagatctttctctaaattaggagctttgtgcacaatcctgctaccaccaaatgttagaatcggaagggagcttaaagaccaagtctagtcctttcattttaaaggagttgggaatgggccctgatttgccccagctggtacataacagagtggagatccaagccttggtttcctgacagctcccagtctttccactctaccacctggcctcaaaatgaaaagaaacacaaatgttctacctataaatcagagctcgccaaaaggtcactagaaatcaaacagcaaacacctattctctttgaaattcaccagcaaagctggtggcagcaacatttcctctattcccaggaatcttaaggctttggagaaatgagaataagcacctccacaaaaacagaaccgctgaataatccatttagaatcttggccagtatgtgcatactataggcctattaagtcaaacttattaatagcttttcttcacagagaaaaaagttcatatatacctactgactgcatttgatcagtaagatatcatgtcagtgtccttcttacctgaagtacatttatggctgggtcatatcgtgacataaataatcacattttgtagcttgctttagacggaatgcgattttttttttttttgagacggagtctcgctctgtcacccaggctagagtgcaatggcgcaatctcggctcattgcaaccaccacctccagggttcaagtgattctcctgcctcagcctcccgagtagctgggattacaggcacgtgccaccacacccggctaatttttgtatttttaatagagatgggttttgccatgttggtaaggctggtttcgaattcctgacctcaggtgatctgcccgcctcagcctcccaaagtgctaggattacaggcgtgagccaccgcgcccggctggaatgagatttttaaaaacaccaggactgagaatccatccacccaaccaagagccaacaaagtagtagttactttaaacattcacttatccatgagactactgaagaaatccaagaggcttggtgatactgacctcactctcagttctatccacaagtagtaaagtactgccaaatacacttagcaatttcaggaaaagacacttgtctccacaacctgttactgaatgcagcatatagaatccattcgattctggaggacaacacactccaaaggatgtttcgttttggaaggagagctgtaggggaaggtacagggggatgcttagcaatgcttcctgagtgactaaatgaacgaagtggatctccctggcccttagtaataatcctatgagattccaggaagaaaattagcttatcttcatagagcaacaacaaaatgattcaatatgaatattgtggttctgaagtttgcttccttcattcttgacttttgccagttgcagaactccaccagtggacaccgaggtagtgggcggccaagagtctgtgaagccagttattcatgcatcaagatttcaaacggtccaaatggaactctggcaatgtaagaactcaggaggggaaaaatatcttgcaagaatctactcttacaaaagaagagtttttgagatttaggaagaatgactgcaggaagtggtgatcagcgctgtgcagttggggttaagctcctctccttcagccttggagcggcaggaaaaggccccaaacactctg

SEQ ID NO: 15274 - DNA, 12797 bp, Human
aaaggcaggttataaggcacaatctgggaattaacaagtacatatgtgtcaataaggagtcatgtttctttggggaaaaaacgatgttgctaaagttccatcactattaatatgtgtgaaaaacacataactctagtatatgccatctgtccagactctcaggccactttgcccaggggccaaagagataaggctccctagatgtacaaataattgaaaagaaagccatcagtaaatctcattactacggccatcccaatttgtactcattcatgttgactatttttggaaaggcttaagctagatcttgtgatcaacattaacatttttgtatcactcttaaggccctgtcatggtacatgctttactgtggatattctgcttcctgggggcaagcagcatatcacattctgggcttgtgggttctcatatgctttgtactcacatggctccagcagagtgctttgcatatggcagatactcaatatttatggaatgaacactgttaacactgtgaggttcattccacaaatgtttattgaccaactacattcaaggtactgtgaatatccccaaagctctatttatttatggcctcttttctttccctttttaagacttccccctgggtttaactatcacccaaacctttttattttttgagacaaggtctcaaaaatccgagtctcagttgttgaggatggagtgcagtggtgtgatcatagctcactgcagcctcaacctcttggactcaagtgatcctcctgcctcagcctcccacagtggtgggattacaggcatgagccaccacacccagcctatccaaatattttctttctagtcctggtgtgtactagtcctgtacttcctcccacctagatttgctgctagtgcctcaaattcaacaagtgtgaactagaatggtcttccctaccccctcccccatcagttccccttcatgagttcccagtttgggctaaagctttgctgatggctctagttgctcagccttgaaaagtcagagtcctctatgactcctaagacataatcagtagattctgggggttcttcctctgtaatctctcttacatctgcctgttcctttccacagccttcatgtctccctctctctgcaactgactaaccatctctggtataggccctctcaatgccacccactcccccaagtctttctactctaaactgacctaaaaggagacaatgctaccttgtgctgtcttctgcatagtcctgaaatggtctaatcccatactggtacttagctctttcctcatatttattatatgttttatcatccaactagattataaatctggaaaggaaggatcctgtggctgagatgtatctggatcccccatggagttatgttttacacttagaattcacttgctatgacatattttaatttgcgtgaaaattcaacccttagatcacaaaattatctttagaaggtttttcaaaaccagattaccctggttcctctacatgtttgctcaatgaccctggacaaattatatcacttctctattgccccatttccccatgtgtgaaatggggttattaacagtatcttatagcgtggtaatggggttaaatgagattatccatgtagatgcatactattgacatgtactccgtaagtgttaataataaccaaaatgttctccattactacaatcttgatttatattcataagcagttttatcagtgccttcaaaatactcattaccttctgtttatactaaccacacacaataagctcaatatgaacacttaattttttgactctaccaacatacacccatggctggcccttgagaagtggctctaagcagcagctttaaagctcagggtctccctgaagccctctgcatgtcaagtacatgaaagaaggaatgccatctcaccagtggcccagcaggggcgccataggggccagtggcagggtaggctccggtggcacttggctgtccagaagatgggtaggccccagggccgctgggtggccctgggtagactccaggtgcaggtgctccgggataagctccaggtgctccagggtaggcgcctggaggtgcctgtccaggataagcccctgggggtgcctgcccggggtaggccccaggataggaagcccctgggtagccccctgccccagcaggctggttcccccatgcgccaggccatccttgagggtttgggtttccagacccagataacgcatcatggagctggaaagaaagacatacacaattacgggacagaaagcattctcaaaagcagaattttcaggaaaataggaatatgtgatctaagaaggagaggaatatggcaaaggcattacatgcatatcattaaactttttccacttattaatagtttgagtttctaagactaaaattagatgttgggattacatatactttttcactttattcttgcctcccaacgtctcagatcagggagggctgcattttcataattagctcaagtcaggagttagcgctcctctacttatagcacatactttttcatcaccgtgagaaaaacaatcacaaacatcagaatgcccagactgtaccgcacttcccgctactcagaggatttctcagctcctgccggcagagtccactcccttccgccctgggccttttggtgaaagggttactgtgagtgagtcccaggcctcgctctgcctggctttcttcccaaatctgctgctggaaaaacaaggctccagcttgcaagccctcattggacaaatgagtccaggggaagccacgcagtgggagagtgaaaagggaaagtcatggtaaaaacaaaacccccaaccctcaaccatgtggagctgatcaaggggaagaaacaggcataaaacacttaccgaaaaattgtctgccattttcctgaaagaaacaaagattatcattttatcctaaaagctttcaccaatttccattaaactgaacctcaccactagttcattgtgcagttctaatccatctctaggcattatgcctaagtcagtagtgtggcgccacaaaaacatctcttcaaggggcagggatgctatccagctagattgccaaaccctatttaactcacaagtttaaacttccgtcacactagcctgtgctctgaatcttacccatctgccctctgtccccactaactgccccatcccctactctgggtttttgaagataagcagtgattgattactactgagacaggaaagacaatgacctccagacatagttgctgccctgctatttattcctctatttgcacacacttatgcctgctcctggccaggcactgcgcaggctcctatctaggtgtgaagatgaataggccatgatctgcatggtcaaaggggccacaggatctaaaactcaaaacaattgagcccacagagatatagaatagaaggatggttaccagaggctgggaaaggtagtgagggagggtgggagggaggtggggatagttaatgggtgacaaaaatagttataatgaatgaataaggccgggtatttgacagcacagcagggtgactatagtcaataatttcattgtacgtttgaaaataactaaaagtataactggattgtttgtaacacaaataaatgagaagagggataccccattttccatgatgtgattattaggcattgcatacctgtgtcaaaacatctaacgtatgccataaatatatatacctgctatgtacccataaagattaagaattaaaaaaaaataaaagccgaagggcctacagtgcagcaaggcagatgagatgcatccatggaaatgtgaaataacaagtcacagatgctatgagtcagaatgtgtgctgtaggaattcaaacccagaaagcttacttctaagaaggaaaggaaaggtgctgttggagctaagcctcaaaggggagctgaagtttgtatgtgctttttttttttcaaaggtacttgttattccaaataaaatatttggcagtacaacaaactaaggtgaaaaaattcaggcaacgtgacgtgaaggaaaaaaatatttgggtctaagatgctaccaaagagggtttgcctaaggggtggtctggagacatcagtcctgctttctcctgttccttcccatgtcaaggctccaaaagcacaagatgcttcacagctgttgtaggtgctccagcagtgaggggaggagggcagctgggcccctgaggcatgggtgagttcttcctaagctcaggatcacctgtgccatggcctgaattacctggaccttgaaacaaccagaatatccttctctttgatttgcccacctgtgatatttactcaatcacttttagaaatggcatcggccccaagggatccaataaatgtccactacttgattcaaatgcaagatattggctgggtgtggtggctcatgcctgtaatcccagcacactgggaggccaaggtgggcaaatcgcttgagcccaagagttcaagactagcctgggcaatatggcaaaaccctgtctctatgaaaaatacaaaaattagccgggtgtggtggcgcatgcctgtgttcccagctactcgaggggctgaggtgggaggatcatttgagcctaggaggtcaaggctgcagtgagctgtgatggcaccactgcactccagcctgggtgacagagcgacctcatctcaaaaaaaaaaaaaaaaaaaaaaaaccataaaatattaccttatttttggtaaaactcaaacaggcagagctcctcctagggcttaacatatgcttcatttatacacactggatattttatacaggttgagtatcccttatttgaaataggaccagaagtgtttctgatttacatttttttttattttggaatatgtccttatgcccagttaagcatccctaatctgaagagccaaaatccaaaatctccagtgagcatttctgtagagcatggcctctgaacatcatgcaggcatgcaaaacgtttgggattttgaagcatttcagatttctgcattggggatgctcatcctttactatactgctattatttatatcatagtcagacattacctttgactaaaatatttttgcacatcttttttttttttagacagggtcttgttctgttgcacaggctggagtgcagtgacatgatatcagggctcactgcagcctccacctcccaggctcatgtgatcctcccacctcagcctcccaaggaactgggactacagccacacaacaccacacccagctaagttatttttttttttagacacggggtctcactatgttgcccaggctggtctcaaactcctgggttcaagtgatcctcccacctcagcatcccaaagtgctgggattacaggcatgagccaccgcatccagccacacatctctttttgaacatggtcattctgaaacctattcagaagtggttaggttatgaccatgcccattttccaacctagggaactgctggcagcttgacagggaagtcacggtgactccagaggttactgcatctttcatttacgttacatcctgtagtgcttggctttttaaagcaaaagttgtgagctcctctgcatgtgcctccttccccaaaaggctgccacactaccgtataagaaaccgtataagttgctactgcagggggaccttgagagaagagttgttacagaaaaggaaaataaatgaaaatttttaattcagaaaaagaaagtctccctcattttggatgccatacgaaacaatcttgaacttcaaggtgggcagaaagcttagttcctttaattacacatacttcttccaccctaaggcaacatatcaaagacccagcaataacgttatcaacattttgatttcttttaaatgtcctcattgcacaggagcttattgtgaacctcagcaccactgacacttcaggtcagatgctttgctgtggggcgctgtcctgtgcactgcaggatgttcagcagcattgctggcttcaatacatatgctgccagaactccagcataccacactccaacttgtgacaaccaagtgtcttcaggccaggtgtggtggctcacacctgtaatcccagtcatttgggaggctgaggcgggaatattgcttgagcccaggagttcaagaccagcctgggcaatacagcaaaaccccagtctctaccaaaaaaaggaaaacaaaatgtcttcagacattgccaatatcccctgggagcaaaatcatggctagttgaggaccgccaatctagctagttagcagtgtatccctacatgaatgtacacacgtggttcaataaaaaccaaaaaggtagtttcaattgttaaaactagctgaatttgccttataaagggtcctaacataactctattcaaattaagatgtgtttaaaggctgattccaaccagaaagtcaaataaagaaggcatttccataatttaatatttattcttttcaaagcctctgctcaagcatgtttagtttattttccaatctaaccaaatccagtttgggaaacaaagcagatctcgttgcatttccactgtttcaacaccacctcggagggcagtatagattgtgtctcgacacattagacaaggccactagaacaaaacctggcatttgtgtggcgcttttcagcttatgaagcatgttcacataccttatctattttagttataatgacattctttgtggtgaaatcttgtactgtcctgccatctcactgtccagcctgggacatgaatcatccctatgtccagcctatctacactgtagatgctacccacccacaagtcacttagtagcaggcttggttatcagatcaaaaaaacagtatatatagggtttgatactaaccatggtttgaagcatccacagggggtcttggaatgcatcccctgaaaataagggggagactactgtgttctcaccataaggaaactgaggctcagagagataacatggtggcccaaagtcatctgtcattggcagatcaaggagtagggctcgtgtctttttactccttatttaggctcattctacaccaatagaaaacatcacactttgaaattttaaagtacagtcctttgaaagtgttaattacttcattgtgaaattaattctctgacttactcatctgtaactacataacatactgaaattgtaaacaaattttttaaaaaggattgtgttttggtcagaaaactaactgggtgattcattcaagcacaaaataatattgaatattgaatacaagaatgccattttgtatagtcatttgctaattataatgacattttaaccaataaagtgtacttttccaaaaattgggtatgccccgtcaacttccaaccatgagatttcttttttgaaaagcattataggccgagtgcagtggctcatgcctgtaatcccagcactttgggaggcgaaggcaggaggatcatgaggttagggttttgagaccagcctggccaacacagtgaaaccccatctctactaaaaatacaaagaattagccaggtgtggtggtgggcgcctgtaatcccagctactcaggaggctgaggcaggagaatcgcttgaacccgggaggcagaggttgcagtgagccaagatggcaccactgcactccagcctgggagactgcgaggctccatctcaagaaaaagaaaagaaaagcattataactgatgctcttttgaaatcaagattattaacctcaaaactttcaggaaaacaaaaaagacatctattcagataagtatcatccttacttgcctgaaatttttttcttttttcttttcagatgagtagtttacagagagagacatacaatcaaatgtcacaaatcttcccactctacagacactatagatatgtgaaccccaccctggtgtttccaggatcagagaattttgaacagtcagaggggaaaaaaaaaaaacttcaaaaaataaactaaaagtagagaaatactagctgggtctccacatttgtaaacacctacagtaagcagttcagtgtagcttcagaataaggaatttaaacatgagttagaatacagaccattttaatcggctgttaattggtagcttttccctttaacaaagagtagctatccgctgcactatgctattctaggcccacccagcaatcagtccagttgtctgggttcccaggaacacttctgaaatgtctgctcataaaggtccctgacctgtgcgcaaccgtcacagaagaagactacttcctgagcccctaggcactgccctacactgctcctcaagtaacacaagaggcagtctacttcctgtccttgctgaaacacagagcaggacttgaggaaagcccatttgccaaagacaaattcagtgatgctaagttggaataaggggaactggtcctttcctaggatttctttctcatcatagctccctggcatcaaggaaggtagagttactttctgcttctcatgactgatcttcccccctacggaaaagctgaacagttcaaaagagaacacatgacacttggtcaatagcgaactggaagtatacagcaagcacagcctagactggttcttaagttacccactcagaatttaatgagaagatccagttcaggcaccagacacaaggagctacccttgagtgggagcctgtgtcccaaacgatcacaggaaagaagagctatgtttgagatcagttaccacaagtatcaagtacataagtttacaagccacttggcatttaaggtcaacacgagattctgaaggcatactacatgaacaaaggtcttggctgcagttaaggtttagagtctggctaatgagggttctatgtaaaaaggtacctaaattatacatgagaccagcattagcctcttgacctcactaagtgaaaagtctttgtaaagcacctatgcatatttgtagtacagcgaactatcatagtttaaagaccgcttaacagagcgagacacctattctacttggacacagctagttttcggggtcaatccatcaggcggtactcgtcctcttctgcttcttacgtaacttagtgaggcatcctcctagcacttctaagtgctaaatattcaaggaccatcatcaaacttctccccagaatctggactaagtgctgattttaaacatcacctctaaatattatgaatttaggaagttgcttaagtcccccaaagatcaaggatggggtatgatcatctttagaatgagagaccctaccctaaggattgagagtcaatgtctaaaagggagactattgttgtagaaaagtaaatgatcattattcaactttaccttttatggaaacacacaatttcctagtatgaaatgtttataaacttgaggtaggccaggcgcagtggcccacgcctataatcccagcactttaggaggccgaggcaggcgggtcacctgaggtcgggggttcgagaccagcctgaccaacatggagggacccccccccccccaccaccaccaccacgaaaaatacaaaattagccgggcatggtggcgcatgcctgtaatcccagctactcgggaggctgaggcaggagaatcgcttgaacccggtaggcagaggttgcggtgagccgagatagtgccgttgcactccagcctgggcaacaagagcgaaactgcgtctcaaaaaaaaaaaaaaccttaggtaaacaaatcagaactttggaagctgacgaaagctttttcttctcaggccctgtgcccaagtagttaattgtatcagtctcattttcttcagaattaactgagccttctcccatttcttccccagaatcctagagacagcctgagtcactgaggtccaggtgtcctcattgcgcagcaacccaattcccagagtcactttacaaacattccgcagtctctggaacccgcatggcgaacttgaagggtaaggctgaaacctaagtcccagcctccaccatgcgtccccgactccctggacctgaacgcctactgctcagagggcaatcgttttagtgtttctatttgagcacccgataattcagaataaactctcaaacatgttgtgaaagccccccggtagggctctgcacgctaggaccaacattttgccacacccaccatttcctgggcacagacagtctgggcagggaggggcatttgattcggaaaagcttagagtttgcagtctttgcaaagccgggtcatgcccactcaggccatggggcaagcaccattttctgtgggatcagcaaccagacagcggctgcagcccggccgcagctggtcccggtggaagaactcattcgcgctccacagcgagatctcctccaagtccagcctcagctgatgctcaaaaggggccgggccagccaagctgtgggtcccgggaggcgccctatgcagtcctgggaagtcccttcgctcccccgcggccgtgatctggggaagggtgacggggctccaaccccaattagagaaactggagcggccgtctggtttgctgagcgagcccctccgcctcccctcgcagcgggacctggtgggactggggtgaccagactgcggctcgtcaccggatggggcttactctggggccgcagagcgcaggcggcggaggtgcgacggcggcgaagcccacgaggctccgcagaaggtggcccgtgccgccccggggacgtgtgtgggtctcgtaaggtgctgccaaccttccccgaacgccagcgccctcgataatcaaaggcgactgccccgggcccagatcgctgcccgccgccccgctcctggagggcagagcacaggctgtggggctctccgcgcgcgccccggcccggtcccggggagccgaaccctctccggaccgcgccccaagcagcgcccgggcgccctctcccctgcccggccggagccgcgtcccccgcgccccgcgcagctcaccgctcgttggctggctccggacggctgctggcgaggaggtgctgcgggcgccggcggggcggtggctccgagcctcaaatactcccagccccgcccggcccgcctctcccgaggcggggcggcgcccctgcccagccagtcctctccccggaccaggctgggcgagccccgcgccggccagacaccccgagccgccgccgcaggggcgaccaggaagctcccgacggggagagcgcgggcactgaggggcgcgacctccgctgccaccgttaggttccgtggcgctcccgggacctgggctgcggccgcgtctgtcccccgccctctccagaatcacctgagtgaagaattcgctgagaggaattcaattaataggttgctttatttgtagaatacaaaaccaaaaatcttttcaatgtctattccctagggaactgactacaaattgactacttattctagatcaataggcctagtctcaaagcaattcccttataaagcaattaatcagacaactctttaacacattttacacaggaaattcacattatatatatatataccctccttttaacttcaccttatctttttgttggaagaaagagataagtattattatctcatttttactgtcagggtgctatagtctgaatgtttatatcccgccaaagttcatatgttgaaatcctaaccctcacggtgatgtattaggaagtggaggccttgggaagtgattaggtcataggggcagggtccttatgaatgagattggtgccctaataaaagaggccggagagagaccccttgccacttccaccttgtgaagacacagccagaaggctccctctgtgaaccagaaagcaggccctcaccagacatcaaatctgctggcctggatcttggatttcccgaccttcagaactgtgggaaataaatgtatattgcctataagctacccagtttatgatattttgttacagaagcccaaacagactaaaagagaaaatgatttacttatccaagctcactcatgtctaggaacaaaatccagaaatcctggctcttacactttacctggaaaagcaccaggccaaagaatccttgcaggttggaacaaggatctctgaggaaaaaaaaaaaaattaaggggggtaggggaagaatctttgcagggactggcttatgtaaactatggagaaaaccaggtatcatctggttcctaaataattcctgtagcccttatagtaaccaattaataacataaagataaattatttcctgcagtttttcaacttagggaaatgttcctgtgaaggactcacttgatggaattgagaagctgtcttggcattctctaggataaacttgaaagtgtcttagtggttggcacggttcctgcaacatcgtcccctctaggcttgcacatagaagtcacagtgtggctggggattatttatgcaagtttgaactcttatctgaagaggtagcctggcaaccaatttatttgaatggatcacccatagtaaatgactaacctctgggtagtaaaaaggtatcacccaaaggaatgcccttggtctccagggaaaatgctataaatcttaagactttgagtcatgaggcctcatggccaggagtggtacccttagagggttagccattggtaataagaaaagtagatagccaaatgaattgctgtggaggcaagggatgaatcacactcttgccttttcttctggtcatttcagagatagacaaagttcatgccctggctacttagggggcttgcttacacctgat

SEQ ID NO: 15275 - DNA, 51754 bp, Human; identical to SEQ ID NO: 15009

SEQ ID NO: 15276 - DNA, 51754 bp, Human; identical to SEQ ID NO: 15009

SEQ ID NO: 15277 - DNA, 51754 bp, Human; identical to SEQ ID NO: 15009

SEQ ID NO: 15278 - DNA, 51754 bp, Human; identical to SEQ ID NO: 15009

SEQ ID NO: 15279 - DNA, 15007 bp, Human
gtccgtgacatgcagcatgccagtggtgggattagaagtcagggtttagaggctactgatgtgtcctgtttttgcaaacaagaaatacttattagacatctgctacaatagtaaaggctaattctacttacatataagtaacactttataattcaggtacccctggaaatcatggctcgttttacaaatgaggacactgaggcaggtaacttgttggggtccttaaaagtcccaactacactgtttagaactcagggtcctgattcccaggccagcgcactttccagtaatccatcctgcctggaccttgtttgagatcctacctgcctgaaggtcctacagtctccaggaagagtttacattcactttcctgacaggtgtggggaaaagtcacatcgattcattcacagtccttggttaggatgagccaggtggatgtgtaagatcctccttttctctggcttgctgttggataattataaggatgaacaacgcacaataaaagtgacttttcaggaggtaccgtctacacttgagatcccagctaccaagcagatggtttgctgactcacagctgctgctgtagccagccctgcttggtgatgtaactgctgtgggatgcagaaatatgggagggggaataagagcctggggtcctgcttctcttgccaggattcacttgtctgctacaacttgcagccaaggaaaggatgctgagtctctggggccaacacggggaaatgttgtggctgcaggccaaccttatcttttccattttctgaggtttggaaagatttctggctcatgctagcctcccattgattaaatgagataatgtatgtagaggccttggcacatagtacatagccaataaatggtaaccgctgtaatagtaataattacagtaataatggccttaattactgtagtaatagagcaataattatttaataatcatagtaataataaatatggtaatataataatcagtggtgtggggagagtagtgcattgggagggaggctcccagtgggaaagagttgtatcagtgatgcaagaaaatgaaaagcagactgtgtgagaatgcgctgtacttgccctacaattttgctggcaagctaaaactgctctaaaaagtaaagtcaattattattaatatatttttttttttggagacagagtctcgctctgtcacccaggctggagtgccttggcaccatctcggctcactgcaacctccaccttctgggttcaagcgattctcctgcctcagcctcctgagtagctgggattacaggcacgcgccgccatgcccagctaatttttgtgtttttagtagagatggggtttcaccatgttggccaggctggtcttgaacttttgaccttgtgatcggcccgcctcggcctcccaaagtgctgggattacaggcatgaaccaccgcagctggccagtgttttttttttttttttttttttaaatgaaagaacaaaatcccagactgatgataagttgttattgtgtttcacttctctaaagacaaggcgcctccttattgcctgtaccaggtggaccagtttctaccacccaaaccttggtgtgccatttttaaatggcctcattggctatgcagatactcaaatgagtcatatgttaatgaagaagtaaagtttgctggtaggatgaaagctccagtgactctttattcaccactgggtgttgttgaatgctggcgaaactggcccaggacatggctgggcacagaagctgcaggtcttgggctgctggtggctctctccacggagctaagcagccacctcatctccactcagcatggctgcagtgggtgtcttggctgtgagcggcccctgggagggtgcccaccacgccccatgcctagtgagagctctccaaatccacagaccagggcaagacttgtaccgacattgccaatgggttggcttcctttcctttgcctgatgcaaggttctctttcctttgagtaggaaaatgcccagataatcagagaagtggaagtggacaaggtctccatgctctccagggagcaggtggaggccatcaagcagctctggcaagatccaggcatccaggagtgttacgacaggaggagggagtaccagctgtcggactctgccaaatagtgagtacagagcccaccctggccgcccgcggtgctttcaggcaagctcggccacacttcaaagaagtttctcgctgaacgctgctgaaatgcggtgcacagtggcagcgctacttgcctttgctttcccatatccctcctgacctcttagtgccatctctcaccacctcctaaagccctcggtcactctgtggatcgcagacctctcttcctgccgacacccgcctgctcttgctgtgttctaagcctgtcgttttcaatgagagactcaaatcaaatctgaggtcccttaagtgggactgatctccttaggagtgctgaaattatctgatttaaacaagaaatacccttgcttttggcttctactttcctcctctctatatccctctgcctttctggtttccccatcagaagacagcaggtccaattgcgctaaaatctaaagtcaagtttagagcagcggggccgtggacccatcagctgctgatctggtgctgtcctctagtggcacagataggaggctgcgctcgcagcacacacaggaagctcaatcctttgtttattggctgcctgcgaaggcctacacactgtattttggatccatacagctcaatttttaattcattaatccttgaaggtaaaaagatttctatttagatgtcccagcatgcaaactgtcccatagagatgacagattttcactttcttgggcatttcctgttcacatctgtaatcccagggacttgggaggcagaggtgggaggatcgcttgaaaccaggaattcgagactagcctgggcagcagagcaagacctcgtctctgcaaaaattacaaaaattagctgggcagctgctcgggaggctgaggcgggaggatgtcttgagcctaggaggttgaggttgcaatgagccatgattacactcctgcagtacagcctgagtgacagagtgagactctgtctcaaaaaaaaagaaaatgtaaataaataaataaataataatatcccggggcaatgcctcctcagtctggtcaccgggtaaatagtttgatatgggtccttcttaaagtggcaataactcctgcttctgcagctcagctctttcacacctgtcccgtatcatcttccatcctctgagggctcagaaatcccttccccagacgtacctccttccctttgggtgccactgtcaccctctgagcaggcattgagctggacaaggcattgggcaggaaagaaagccagaagtgtcacctcctgtggtttcaatgggcttcctttggtgtttatcccgggctgagaattgaatgtcattaatccaggttggcacaaccaatctaagtacaggaatgtttagatgcaaaaaagcatcaaggcaggaaaatacagaaaccccactgaggtgttagatcagcatagagaggtggaagaaagaaagagtgccatggaggagggcttgcctttgacagctcgaggagccaggaacaggtacgacgttcctgagccatacctgaggtggcctgagttacctgcctctgtgaaggcctggggattggctagggctcttgatgtagatccatttggaaaagatccaccagacctgctacagaattcagtgtaaccctgaaaaccatgggggcaaggccactgacatggacgaggggcgtggctagggtggtgagagctgtcacagagaaaacagcctctcctaaacccagtcgcccaaccttccaaaccggcaggactcaaggcacttgcacgttttctccatctgggccagcggttttcaacccctcagctagagatgtctgctgattggacaatgtgatgagtgcttgtgatgcgccaggcactgtggtaagggctgcaggtattatacaaccagtgctctctgctctcagggaatatacagtctggtggagcaactcaggtgtaaatcaaataattacacatcaaagtacagcaaaaacagtgataagccctgggactgtatctgggcagagaggtgggttgtggaaggctgccccagagctttgcttctggagctgaaggcatacggtgaacagggtttgcctgtgacctcttggttagcctgcatgcggacctgctcagcccctgatgcggtgctgggacagggcagggccgacctcagcatgcagcgggctctgcatctacaactcttttgttagcgagggcctgagttacagttattttacctaaaagtgtcttttagaaaggccttaaagttttttttttttttaaaggattctcttattttactacagaaaaaaaaaatatgttttaagctcagggcttcaatatatggccaaaaataagttaaggcaagttttgggttattttaggagatgtagtttcccagtgtcttcaacaggaaaacttgttcttgttgctgttgttttgaatttctcctcggcctgttttacgcctgtgtattttcttagaaactatttaattcattgagcaaagctttagagaacagcatctccattatataatgctcttggacaagggtgagtgggagggagaaggggctctggagggaggatgacagatggggtgttggagagagccatttccaacatcctggtccttccagccccactgtctccctcgctggtcaaatagaagcgatagagcttagaacccaggaggaagagacggagtgctctgcagatgtcccagaaggcgcatggaagtccttctgacccatattgtcttcaaaacagtcgtaggaaggatggagaagcctggcctggcactggctctcaggaaagtcattgatggaattcgtgtgtctgtgtggggctcactgtgagtggggggtgacttcctttgagtaggatggacatttccccctgctctaaaaggagagtcagttcctcgttctctaatatacagttacctgactgacattgaccgcatcgccacaccatcattcgtgcctacccaacaagatgtgcttcgcgtccgagtgcccaccaccggcatcattgagtatccatttgacttggaaaacatcatctttcggtaagtctgtctccctgatgtaccatgaagaatctgcccaggcttggaagtccccaggtggattcttaaacgtgttattcctaagcagggattatatctcttaggacagagtgaccctctctgccaagggtatttagaattgtggtaggtaggtctcaaccctggaatggagaggaagtcaccttcctgttacccttggagaaaaagggtttccttactggaaactggaatgattcttatgtgtaacacacactcatacacacacacacacacacacacacacacacacacacacacacaaatgtatacttctgtatcccacaaattgaatgtagtgattatcgatgtcttttccttaaagatgaatcatatttcctttctcctctatttccttctccaagatttatccttagaaaattaaggatacaaaaaatgtgtatgaaaactgtgaagaataatatgtacaaactaacagctgtgtaaaaatgtatgcatttccacttacaaatataggaaatacttttaggatgacttagtgaatcttcactgcatttagttatggtaaaaaatgaataataatatagggcatatatgtagcactgcacatttcaaagcacttttatatccactgtttcccttgttcctcctaacaattatcacacacgattttctagttgagacaacacatcagtcctcccacatccgggtcctgtctgatccccagttatagctcagtgcttctctctccagaattgctgtgtttgggaagccctcaggtccagcccctcaaacatgtcccccatctatattagcatatccctgattttaatagtagccctctgtgcctgtgtgcccatgaatttctctaaaccttttcacaattaactgctttttgcaatgtccaaaacctctcagactcccaaggattttgtttattcgttttgttttaaaaaatacttttatttcttctaagtttatccttcttggactgcgatgaatgggttttgcattactttctagaggctggtgaatgggtttaacatcatccaccagtgaaatctattactttacaactcagagcacctctcccagtgggatatttctggctgaaaaattccgatctttgaaattgaggcttttatagaatggcttcttcaagctcaaccttttgacaattgcaatgtcctgtttcaagatcggttccctgctgtgatagccagccatgaacatgtcattgtgggagtggctgcacctccaggacatggttcaagaacagtattgaatttttcattttccttcctgcacttttccagacaacagttctgggtggttggcctgtggaccacctaaccacaatgacccagtgccttcagggactggtgtgtgtgtgtggtggggtggtgatgtaggggtgggtgggggttacttggcagctgtatctggtccattatgtattttctttggctcacttggtgttactaaaaaaacgtttgagctaacacattggataccttgtttctcctgaaaaggcagagactgtggtcatggcaagcctgcgtcttgttctgcagagcttggctgcaggtacgcggcaggcttccctgtagacagggcccccggctgttgtgccatgtatgttttgtactttggggagcccacttggctcattcccataaactgcctgattcttgtagcatttgagctcatgatccctgggctaggagttgctgaaatttttcccaaagacacagatatagaggctttggatttctgtactggacagaggacacttgtaggtttttatagggaacaagaggtggcatccagggaatgcagaaaggatttacaggtaagttagaggagccacaaaaacagaataggctcgggtcctgaagccagcctgggagacccggaagacagctggccgctgcgtccctcttgagtctggtatccagggactctacagtggttgtcacagaacccaagtgaacgtttgcgttttctgtctggacactggttagcttcctaaccggcaggctccctgagtcacctctgcatgtcttcagaaatgtcatttacattctctcccttctttgctaggaaacatccagtggtccctcattgcttaaagcagcagcatcaaacattttaaaacttagaacctcttttctctcttagaaattactgaggactccaagagcactggtttccatgctataattcatgtcctttttccccgaagtgtcatgtattccaacctttgaaggatctgtgtttctacacaacaggatggtggatgttggtggccaacgatcggaaagacggaagtggattcactgctttgagagtgtcacctccattattttcttggttgctctgagtgaatatgaccaggtcctggctgagtgtgacaacgaggtatgctgggcgggaagtttgggtagctgtggaagccagagcctattctgtggtttctaagaaggcagccgggtcaggaaatagaccctcgtcattaggtcaaacagtcttgctactcaaagtgtgacctgtggaccagcagcacaggcatcacctgcatggcttgttagaaatgcagtcttactgaatcaaccccgaccaactacatcagcatctgcattttaacaagaacccaggtaattcaaatacatatgaaaggctgagaatcacgggcctggaacctgggttctaaacttgaatgcacactggagtttgctgagggacttaacaaaaacctggtgcctgagtccaaccccagagattctgaatgaattggtggtgaatggggcctgagtggggggatttttaaaaagcaccccaggtgaatccactgtgctgctaaggtcggaacctattcaaaagcctaggttctcatccttggtggcacagtggaatctcttggcgaggtttttaaaaatgccatctcttggctgggcacggtggctcacgcctgtaatcccagcactttgggaggccgaggcaggtggatcacgaggtcaggagatcgagaccatcctggctaacgtggtgaaaccccgtctctactaaaaaatacaaaaaattagccgggcgtggtggtgggcgcctgtagtcccagctattcaggaggctgaggcaggagaatggcgtgaacccgggaggcggagcttgcagtgagccgagatcgcaccactgcactccagcctgggcaacagagcgagactccatctcaaaaaaaaaaaaagaaaaaaaaaaagaaaaaatgccatctcttggactgaacactaaaaattcatatttactgggtttaggttgaggcttcttttgagagcccaccagggattctactgcacaaccaatgccgagcagcactatctctaaaacactttacctgggcacaggcttcctaacctccataggcccatggtgctcccaaattagatccctagtggaactggggtgggcagtggtgctagatgcttggagctgttctggggctgtctgggattgcatctgccttcacgtctcctgggagggactccctcagggcagctgggatggatccagcctggtcaggcatgcgttgtcccctcagagtggccatagcactggctgcttccaattccatcagtgggagctgccctgagagtgaagaggaccctcacagccacttctctgtcaggttggggacagtatcggtggaacactcatgtcctcctcgtcatcttttcccctgaacttgcattaagacctcttgaccttttaaaaaatgtcttttgtttccaaggcgtgaaagtaaatcaataaaggactcagtccaggattaggcaataactgaacaaattgtatcttgtatttcttgagagcacacttttctctgaggagcatagcttatattacctaattagtggaggattaacccatttaattgtgtcattgtgcaaagaacggaaatgctggctgtcgcccagccctctcagttggagattttttttttttttttaaaggcaagacattcagttatcaatataaaaaaaatagctgcaaatttgtttcaggaattatttgtgacgttcctcaggaaactcaaacgattagtaaggtgcacaagggaccagtatctcagcccaaagtgcttagaaattaaatattttctcttctaaaaatcacaaaatatttggagaaaaattaagtggttgccactccagactttcccctcctggttgtagatatgtattatatccactctgtatactgtctgggaagttttcatatattttatttccttggagatcattatcattcagatcataataattttaaagctttaatacattccagatcgtaattcccccaatgtgtactgagtggcagaacaaacctgggtgtctggaagttgtggggaaagagtgatttatggcgtgtccctcttgagtgtgtgtgctgagcttggatgtttttcactgtgatcccttccctccctacagggaagttcttgtttctttcctcttagaaatacttgagaaagagcagaatgctatctagaacaattattgtcacagataagatttgtttgtgccctgtctgttctcagtaaattaggagcatttaatatcttcttgccaatgtctaacatttagaaattatcactgtctttctacacaaccttccccaggtcccactattacatgggcttgggaaagttatttgaatgttctaaacaaggccaggcgcggtggctcatgcctgtaatcccagcactttgggaggccgaggcgggcggatcgcgaggtcaggagattgagaccatcctggctaacacggtgaaaccccgtctctattaaaaatacaaaaaattagccgggtgtggtggtatgcacctgtggtcccagccactcgggaggctgaggcaggagaatcacttgaatgcaggagctggaggttgtagtgagccgagatcgcgccactgtactccagcctgggcgacacagcgagactccatctcagaaaggaaaaaaaaaaaagttctgaacaacagtatggtcacccatcaaacgggccactgctctgcttgtaaagtgtggcacagggtgggttcccagtagcagtgcgtcctgtctctgccaacttctagcattcctagggccagtggccttgctggaagagccttgtcacttgactgctgaggcccagtctggaagcccataaccaactgaggtggccgtgtcaggtctgaagctggcacttccccacttagtaatcccaacgatcacatgacacaggaaacttgtgaaacgtgggtaggaaccttccttttccaagctgcaccaaagcctttcttacttcgttccatgtgagttttgggctggagaagagctgggatgctacaggagaggggacccagaaggggatggttagtaagaggcttggggaggggcaaacagaagcaggaggcctgtagcctggggccccacatgctcaccagcttcagcagacagtggcccagagactgcggcggggcaagggaagagatggatggactggcaatgcgccatgttgtttccaaaatatttcctttctacttcatcccaagtcccttgtttttcacttagaatcgcatggaagagagcaaagccttatttaaaaccatcatcacctacccctggtttctgaattcgtctgtgattttattcttgaacaagaaggatcttttggaagagaaaatcatgtactctcatctaattagctatttcccagaatacacaggtaagtgtctatcttgtggacagtgttttctgtgctgatctcgtccacctcccgggcatcagtctagagttatcacggctcaaaggggcctccctggtctgcctgcaatagcctctccccctattcccaccttcaaacagaagctctagttgcaccattgttgtgttttcaccacagcacctccacatgtgcttccctcagtgcttggaatacccttaccaactcctttcgctgcctccatgttgttctccaaaacccagcaaaggcctccccttctctgggagcctttctggcttcccctgcccatctggtctgcaggaagggtgcctcctcctttctgctccctcagcagcctaacccctgcttgctctcttggccacatcatgctatgtcatatcctctgctcactcagctctcttcccagtcggctccatgagggtagagactctgcttgatttatctgtgcattcctcatgccagtcagagcacctggtgcttcttatgtgtatgttagagtgtggcatcccttttcccagacacatggtggactcacataacctgtccaaggtaggagagtctcatgccctgttgctaattgtttctggtacaggaggtctcaaaccttaagtttgacactgatatttagtggattcatgttttagcactcttctttccccttttactaaccatactggctgtgtagtgtagcaccctcgagctttaaaatcagcctgatgttagttcccacattcttccttttatctctcctagaccagagctgtctgtccatatgtgttagccaggattacttctcttcaatagtggtccaaatcagacaaattgggtcactatgtttaaacaaatcactgtaaagtacaatttttagataccagaggacattttaaaatatgactattttatgggttcatgatgagataccataaaaataatgctccaggtaaaccgttccctggaaataaagatggatcaaagcaggatctcaaataagaacaagaatacattaaaaaatggttcttggggccaggcacggtggctcacgcctgtaatcccagcactttgggaggccaaggcaggtggatcacctaaggtcaggagttcgagaccagtctggccaacatggtaaaaccccgtttctactaaaaatacaaaaattagctgtgtgtggtggtacgcatctgtaatcccagctacttgggaggctgaggcaggagaattgcttgaaccccagaagcagaggttgcagtgagctgagaccgtgccactgcactccagcctgggctacagagcgagactctgtctcaaaaaaaaggttcttgggaggacatggtgttaagtctgtgtctttattcctgtaattgcacttgtgactaggaccgaaacaggatgtcagagctgccagagactttatcctgaagctttaccaagatcagaatcctgacaaagagaaagtcatctactctcacttcacatgtgctacagatacagacaatattcgctttgtgtttgctgctgtcaaagacacaattctacagctaaacctaagggaattcaaccttgtctaaaagctgctgcccactcctcccctataacagaagatgtgatttgcaaactccttgttttatttgcaagtgcttctgacatcaccagagccagccccatgccaggaactaaggatgtcatgtagatcgtggggacagagatgggtgatggaacttggaagatatttgagtttaccaacatactttaaaagtccttacatcccaaattgtgtttataattattttcttgacttttggctataagattttgtgtaatttttgaatttggtgttttctagaatttttaaaagccactttgatttagttttaaatatgtttaaaaatagcgattaaaattatgtaagcaaggagcctgttagtttatagatcatgccttcaaacctctagagttaatttgggtgacttttttaaaaataagaatgttaatgggtttgaagctttttattaaaccttgtaatttagagacatttttaattgtgtttctcacctcatgctgaagggtgactcctttaacatgccaccaaagattttttttaaacacttggttctttttgtgtgttaactttctaagccaaattaatggatatataagtatatctaatttagctttgccacagtttgatcaccaagaagccaaagctgacatagagtaaatgggctctagatagcatatatgttttattggtgaaaaatgtgtgtgtgtgcgcgtgtgtgtgtgtgtacatttttacccccaatgtatatgaccagatcttaaaaatgtatgaaatggctagaagtccacattgtttgacaaatgttacgtaaccctgccaaagttctgatggccaccacagatttgctgtttgaattatgtatgctgtgcctttctgaggaggctaagaatataccattctgctattagcactgggttatgttgtgtttcttagagctcatggttgactgatggttctgctcctaaacagaaaaatgctgtggccttaatagtaactcggaaactttcctaagattcctcctttcaaggcaagtctgcgcatcatcgtgtcatgctgcagttccctcagtagctggctgggtcaagcagaaggagaatcctctgggaattaagagtgctccacactaaaggccaagatggttttgtgcatgtgtgcacacatgtgtgtgcacacacacatacaccatttggggacgtaaggtatgaaatatctgtctcaaatcagtctataaaatgcacctcggttggctacatatgttatggaaccatgtgtccccattctgtgggaacaattccaattgctgaaaaagactgaaattattctgatatgcagcaattctacaatagcaacatctagctttaaaaatatgaatcctcactcaagagataaatgcaatagcaacagcttttgtggaagttcacaaattgatgttaaaatttatctagaacagtaaagtccagaaatagccgagacagttttgcgtgagaacagagagaggggaatggagctctttaggatatctagaagcacaaagaaaatacaagacaattcccctccccaccaacgatgggctaaaggctatggactgggtttcactagccaattaacataaaaagggttcaacagaatccagtcatctgggaaattaaaccatgaagaattccatttcttattttaagcactttcttgcattgagtttttgttaatttatagttggctgactacttaaagcatataagaaaatgatggctttccatatcctggttgtgggagggctgttaaataagtcattcaaagggtggtaacaatattttcttaaggcatggaaaggctagactctcaatgtcagaggtgaattaattacctctgccaatactgattctgctggtagaaaattctctcctggcccttcattcaatattctcattacttactggggaaatgagtcatgcggagttttctaaggttaagagacagaatgtcggtggttaagaattcactaggtcgagacaatcctggccaacatggtgaaaccccatctctactaaaaaaaaaaaaatacaaaaattagctgggcgtggtggcacacacctgtagtcccagcgactcgggaggctgaggcaggaagatcacttgaacctgggaggtgaacgttgcagtgagccgagatcgtgccactgcactgcagcctggtgacagagcaatactgtctgtctcaaaaaaaaaaaaaaaaagagaatttactaggtactataccaccccaagcttttagtcagcaatgatcatgctgggctggaatgtcgcctgctttgactgaaaaatcaggaccttgggcaatctgttattcacatttgtttcagccccaaagagggtggaatttatataggcaagggaagggtattaataatgtttctagttctatcaaaaaactaaaaacagaagcagaccaaagatcagaaa

SEQ ID NO: 15280 - DNA, 7355 bp, Human
gagtgcatagctgatatttatgctttcctgataaactttactcattgctgacattggagaaggtcaggaaagggcctgaaatgagtgatctttaggggggttttcattctcttcctgtaccttcctgccaaggggaagtccgtcttgcatcaggctgcagcaacctcagttggtgacaatatcaggcaatgtcagcctggcctctgctgctccttttctctgacattcctttgttacctgatggtctaacttaagccacctaagcaggattgctcatctccagttgtattcccatttcaagtacgtgtatatttttgtcagggaaaataccaatcttcgtggttcccttgcaagggcaaagttatctgtagcaaagccttttttattaggaagtctgcttgtactattacctgcaactcttcagaagggccacccagattctcatctgcaaagcccaggatctactcatccacaatgttcaagaggcctgtctttaggatttactgtcacataccctctctacctccatcatacctccaaccaaggtgttctcaaattaataccagccatgcacaaaatgtgaacaattacacaagacacatggaaggtctaagtggtaaatggcagctgttgatactgagtaacctgtatattccatgaactgataagcaggtatttatcagatataacgaagaatcagtagctgaaagaagtgctaacaatgcaggtctctgatagggctttttggaaacacaacacgtattatgaaattacacagacaagaatgaaacaaagatggtaagtactatatcctaatacttagaagattaaataaaggaaatctcaccaaattcatggggaaaaaagccagatacataaagaaaaatacacataatgggcttgactcagaaaataaaatatgaacaaagaagaaccagaaagaaggtggggaggaatgcatatcagaatattatagaaaaatactctttgtggaagaacaatctgagaaaacaggtaacacaaatactgactaaaccaagaataccaatagaatgcaatttaggctttaacgagggtatctgattatcctatttgaatgtagaattgtagccacttaattataagtggtaggaattcaatacaattattaaaagaaatgaagcagagggtgaatattatagaatattctggacaaagggaagagcatgaaggaagttttggcaacatgatatcgcatggctcccgcaaggaattatgtattcagttttctcagatctagaaatttccttatggtttctgtgtacattttgcattaataacccctaaaggtactttaaaatacacaattttggccttcctgtgtggcacaacaacaagccttgcctgagctgagtcagatccacagaagcttgaacaatagttgtagcccgagcaggctgtggggcagctttctgtcatctatgtgtgcccaggagtgtgttgtcttcacaccatcacacaggtaacagaaaccatctctatcgcatcaaaactttagccaattgtgatactatctgtacacacacatcacaagagatggaaataggctctataaagagccagagaaattgaccatcttcactgctggctgtagcttcactgcccccacaaatattacacagaaataaatagtagagtggaaagcagacatagtcttaccaaaaggattgaaactctaatgatgtctgaagttcaattatgacacagtgctgatagcttggacacagttcctttagaacctttattcaagtcatagtcgtaccttttagaaataaggcacaaacaacatccaacccaccccatccctctgggctagagttccaaagagaaataagggatacacctgacctgcagtaaggaaagcagaacccagtctctgaggtggtgaggcccacccagggctcaaaggtgccattgttttgctcctctttataaagggagttgccacgttcctcccagcacagagttgggagtgactccagagcctccagcgagatgctgctgattctgctgtcagtggccctgctggccctgagctcagctgagagttcaagtgaaggtaaaacagaagggggaaaagatgcggtgactgcttgggacttaggaggtgacagtggtaattatggggaagagaggagaatgaaaacacagatggggctgcagagttttcatgcctaggatcaggagacctgttgtgccctcattccacaataaggacttctaatttatttaatgtacaatgaaatccaataacgaatttgttccaggggaatgagaaggtaagatttgaatttatagagatagaactgtgctgtgaaggctgcagtggagagtgcaaggcagattcagggaagtccagctgtgaagatcctatactgatcccagtaagtacacagggatgatggtggccttgctgtacagacagtcggcattgatgatagagatacatacacatcagagatactgcagagacagaactggatagaacacttgtctctgtctaactaaagatgtagaaatatcagagccaatcattacaatttttctctcccctacatgcagtatttcaatgtgctgggagtggaatgggttagattgtattgaaatgattacttctggttacccctattgagaaaacatgtgtatgtatgcaatatattaacaggagatggagggcataagaacaccaaaatatcacattgaagtacctggcatgcataaactaaataagcattaagtcttgagggatgctagggaggaaaaaaaggggctgttctatgttgaactcattgctgttgctctgtgtggtaacaaccctgcctcctcttacaccttccaccccttccagcaccttcacagatggtggctgatgagttaacctaggggatgcatggggtgtggtgagaagacaattttccctgtagaacacttgtgagtcttgaagatttgagatgtaacatttcccatcatcctgtgcttctcttctagatgtcagccaggaagaatctctcttcctaatatcaggtaaatcccaattcattctcaatctgttctgactccctttttctgcttacaaatggatcatttctccagtgtcttcttatcaacactttcctttcaggaattgattaatgttattgcccctaatgatataggcaatcttcatgcaaacttgattctgggaccatgagcaggccaccaaatggaatgtcagagatgcttgggttggatgacaacaggagtgggttgacatccccctgggagatgacagacaaatggccagtgtccttattctgactccttcctagactgggcctattctcctccttagactgagagcccctcaacttctcccttttcccccagcgttccactccagagttctagggcttcactgaaaatgcaaagaaattagtatctgggtctcatttttgtgcatttccccatttagctccattactgtaaaaatttgtggcaactattcagtgaatgccgtatgtcccccacctcctccaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggtaccccacctcctccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacaggtatgattccactttattattcatcaggactctaattgctacagttctccaactttattgtgccaatgaatcaactaaaacccattgacattgtattgtcctagaacccatttctaaaaatttgtattcagatactctggaatagggtaaggggaccctgtatttctaacaaaatctttaaggaattctgatgttgagaaacaacataccatatgatctgtcttaaattgtgttggcaatgaggaggtagtaccatgttcattcttggcgttctgttttctatccactaactcagagacctcccatttaaagttttcacctgagcaccatttgctcagtcctgcctcacaccagcctctcgagtccagtattcctgccaaatggtccctgatctttcagcagctaaatggcgtgtcactttttagatacttaacttttcaatacgtacatgattaagctaacaaaaaatatctaatggaatggaaaaatatgaagctaattttaaaggcataacacatcctacccaccttccttccttcaaaaagctcccactgttaaccttatgggatcttttctttgaaatatttatgtgtgcatagacatatagcattcttttaccctaccactaatgccataacttatatgcaggtatatatgttagtcatttaaaaaatacatttttttaaaatttccacatcagtttatgaaggtcactacatatcttcagtggttttctgtttgcttttacatttttatactactctattgtgtagctgtgccatgatttcgttaaccaatccctgtcactggacactgagggtggttttagcttctcagtattatagaatatgttccagttaccatctgtgtaaatatatccctgaacaaattcaacaggaatgagtcacagcaacctaaggatgatcttttctcttcatcttctaagccacaatttggagcacattgtgtgcaagggcatcaaaagagtgaatctatgaacttgcttgtttgtttatttcaggaagtgaataagaagatatcagtgaattcaaataattcaattgctacaaatgccgtgacattggaacaagttcatcatagctctaactttaatataccaataaaataatcagcttgcaatttctgattgtggtgttctttctcagtgtttgtgaatgtggaatgtgaggaccaagaacacattataagaacatctaggaccccttctgtctgatgcttccagggagtttcccttctctttaatcctaacttagccagctgccatgaaaaatgttttgctgtttatctctttccctgacttcaatttttttttctttttctgagatggagtcttgctctatcacctaggttggaatgcagtggcgtgatcttggctaactgcaacctgcacctcctgggttcaagctattctcctgcctcacccttcacagtagctgggattacaggttcccaccatcacacctgggtaatttttgtaattttagttgagatgcgttttcaccctgttggccaggctaggctagaaattctgacttcaggtcatccgcttgccttggcctccaaatgtgttgggattacaggcatgagccaccacacctggctcctccctgacttctacagcacaaattgaaaatctaaaattattttcagattgtttactgatattccagtaattttaaggacaaaaaccacaacaaatggaaaataagtcacagaaactaaaagaaatccttataatttctaagaaactgagtttggtttcaagggaacaaacagggttctatgcttcttattcccagagccctctctatcccattgaccctattttaacagtgatcacttccctccctccctatgttcctcacctttctttaatgaaacctgaatggatttcatcaaggaggcagcatgacttttaggagcaaagaattgggacactctcagattttagttaagacataactctttcttgctagcctgaactcttaaaaagctacttggtctctcagagcttcaatttcctcatctacaatgagaagaatcaaaacaactaccttagaatatggagactattcagataacatatgtaccaaaaaccttgcagagattggcatgtctgcttctcaagcaaggaaggttcaatattagaaaactgcccctgtgcccaccgatagcctcagataattcactatgaatttcagaaatttcagaatagaaggatctcactgtaaccatcaccaagttgagcaacccacattcagttcaatcccagttctctgacttctctcctattatcatagttgaaggctccctacccctatctcttatctttcctcttgattctgaaccacattacccagtcaaggattttgcttctgtatgtgacccttttgtctcctgattcttacatctatgctctatgggattacctcaatcagcaaaagcctgctgaaacatcacccatttttacagaggttttgctaagactcttagtgtttctttcctaccctattatttgtctgccatttttattgcaaaagttcttgaaacatatgtatgtgattatttccccatcccctcccttccattttctttttaaacacacattaaagatgcttttgttctttccactccaagtctgtcaaggtcatctactgcctgcattccactcatttcaggaatcgattatcagtcctgcatctcctgtgaccccttggcagtttaacaccattgatcctacaattcttttgggaacactctatcaatctttccgggaacctcccactctctcctcgggtttctcctacctctgcctcttccctcctgtaactacaaagttactcctcttccaactctatttggtcttggtaaattattcatctaattaattaaggaaactaggatttattctagactcttctcttttcctcttacatcacattacatctagtcaaatcagctatgttatcattgtgaaattcaagcttcaaaacaatttcctactgcagccagtttcatcattttcatctctatcagcccatctaagcaagcctcatctgcagtttacaccaaatagttctatttatttcccaacaatcaattacccaccttggccat

SEQ ID NO: 15281 - DNA, 11808 bp, Human
gaggccaggcacagtggctcacacctgtaattccagtactgtgagagtccgaggtcagaggactgcttgaggccaggagttcaagagcagcctggacaacatagggagacctgtcactacaaagaataaataaattagccaggcttagtggctcatccctgtggtcccagctactagggaggcagaagtaggactgcttgtcccaggaggtcaagactgcagtgagctgagacccagccacctgcattccagcctgggcaacaaaaagagaccctgtctcaaaaaataagttaaataaataaataataaaaatagtttaaaccctaaacacatcttctttttcaaagaggacttcttaaggacttcatgctgcgtcctgttgatctccacttccctttttcagcgtccacacttttaacagtctcttttgccaaggataataagtatatagtttctggaatccagattcttccctgtttggacagccagggggacaatttttggtctgcaggcctttgcatctgttctgctgttgctcagcaatctcacagcaaatttgccgagcctctccggaatgcacagccagacagagctcagcgcaaaagctagagaacctggcggagggagactcacagtgccacaaaaaaactttatcttttctttttttttttcttttctttctttctctttctttcttgtctttctgtctttcctctctctctctctgtctttctttcctctctttctttcttttttcctacatggcaagatctcctcatggcagaaataatctgccttgacttctgtttccacgctgcttctgccaggaccatgcgctcggcgtgtttttctttccgctataattatccaggcccatcccagctctggtcccctcagctgttccctggcagtcccttctgctggtgaaaacacatatggcgccggcctgaccagggtgtaagtgtgtgaatatcaggaagatgactgaacgtctttgggactccgtttcctcattgtaaaatggaggttaataccagccttcttctactccccaaacgcacgtgtttgtcccggccagagggcccaattgttggctgttcacgcgtcagttacccccacaggacgggtcagccaattaaaggcgaaccaggcccggtccatctcctgacgccttttctcatcccagggctggacaggcagctggcctgggcccggctctgccttgtcacgtgcgggggccggcccgtttgcttgtctgtgtgtaggagcgtgaggtcacgctgggtgctcccgccccgccggggcctttagtgtccctggtccctaaacgccaggccgctccaccgggggagaaggcgcgaaccccagccgagcccaacggctgttgtcggttgccgggccacctgttgctgcagttctgattggttccttcccccgacaacgcggcggctgtaaccaatcgacagcgaggccggtcgcgaggccccagtcccgccctgcaggagccagccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctcgcccggctcgtccgacgcgccctccgccagccgacagacacagccgcacgcactgccgtgttctccctgcggctcggtgagcctggccccagccctgcgccctttgcgccccccacgcttgttctgcgtgcgctgcccgctcttccatttaccttctctcccacccaagtttgtactcttttctttctctcggttttattttttgtttttgtttgtttgtttgagacaggctttcgctctgtctcccaggctggagtgcagtggcgcgatctcggctcactgcagcctccacctcccaggttcaagcgatccgcctgccgagtagctgggattacaggcgcccgccaccacgcctggctaatttttgtgttttgtagagatggggtttcgccatgttggccaggctggcctcgaactgctgagctcaagcaatccgcccgcctcggcctcacaaagtcctagaattttaggcatgagcctccgggtccggcctgtgctaatcctttctgtccttggttctttatttctcttctctctttttcttagtcccttttgttctttccctctcccgttcagttggctgtcgtttgagcctccaccttttcactccctcctttccaccacgatgccgagccctgccttggatggggaccatcagcgatgaccacaatgacctctcccttaccaggcagctccaggcagtgttcctgcaccgcctttcccagggcttgggggctttttctagtgggctttgagctgctcaatctggcctctgcagggccggctcccagcccttccaacctcctcacagcccgacctgggacctagccaattcccggagagtctctgtcccatcgtgaccccctcacaactctcccactcaccaaagtctgatgactgtgctagggggtgcttatatagagtactgagtgttacaaaagcagaagtctggatgagaaccaatttgtgatattaagcaggtggggtgggggtggggagtgtacctaggttcattttccgccctgcttttcccctttccagtgtgtgcacttaaccagtccctgggccctgttccccatccccctccaaggcatggattgggtgggcttgtgtgtcttggggcaggtggccctttctaaactctctgcctttgctcacccacaggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccgggtaagagtccagtccaaggaagaggtctcttgctgcctcctaaccctgtggtctaggggcaggagtcagcagggcattaacaaaaataattaccatccccacccccgacagtgaagtggctctttccagttcacagagcactctcacacctccccgctctcattctggcccttcagctgactcggacaagccaaggatcttggtccccattttataaaggagaaaactgaggcccacgtgtaacagtgattggccccaagtcatcccgggagccagcagaagagctaggacaggaacctattgttctaacttcatattgatgctagcttttgactatccctgaaaccgagattggtaatcagcccggctctgaaactggttatttgctggggactgtaaaataggattaactatttctagtcctgcattttaattgctgttagtagggccatcttacccaccctctgaaggacctgacttggcaagcccaaggcaacattcagaatatggcagctgaacctctgtgcacttgtctttgggcagcagctgggtcttattcttctctggccttcacaacatcctgcaacccagctcaaggtcaggaatgtgacagactcatgtcatcatatctctgatgcccagagaagggataccatttgcctgagccttctcagtactgtttaatcagcctgtgagaactttccttgtgaaaggccctgtctgtgcctggggctgataaaacagcaagaacgaactgaggagctgggcagcagtgcaaagcaaatactaccagctttggtgcctgtaagtgtggctcttactcatctcacatggaaataagggcagccaccttgcagggctgctctgaggattgagctaatacagtgccctgggcgttggggtggggaaagttgtggagcacctcctgggggaagggggtgtcagagcagggaatctggggagtccgagggcaccttcatcaacccaatctgtcatttgagcaccagtcttcactgagcctcgtgggcaagctggagggaaacaggaataaggtcaggccctgttctataggtcccagtgtagttgctatggtgagtatcttcatttccctgcttgccccagccacctggagtgagaagcccaagaggaagctgggtgagctgtttgtttccatgggtctctgtgttcacagctgactcccttcaccagccagccctttcacctgagccccagcaacaaaggcagtcaggcggggctcaaagcagctgctccaatgaagtcaaagaaataagctcaggggaagaagcaggtcaccctcccccactagggtgctgggctcacttcctcctggggcagtggaggagggtgtggttccaactcagaacaaaatggggcttttggtttactttatcactcttcacagctctgacctggacccctcatccctgcctgtcttgtggtgtaagtgcggatccccctaagttggaggaaaggaaactggcccaaacaaaaaggagagcagttttctctgcatcacatggtaggccaggaggagtctaatgccccagagtttactctcagcccccaaaatcacctagctaaatgttaccttatctaagaagtccttaggttttttggggtttgttttttttttttttgagacaaggtctcactctctcacccagactggagcacagtggcacaatcacagctcactgcagcctcaacctcctgggctcaagcaatcgtcccaagtagctgggactataggcctgcaccaccatgtccagctaatttatttttatttatattttttagacagggtctcattatgttgccctggctggtcttgaactcctgggttcaagcagtcctcccacctctgcctcccaaagtgctaggtttttttttgtttgtttgtctgttttttgaaacagagtcttgctctgtcgcctaggctggagtgcagtggcacgatctcagctactgcaacctccacctcctgggttcaagtgattctcctgcctcagcctcctaagtagttgggaatacaggcgtgtgccaacacacccagctcatttttgtatttttagcggagatggggttttgccatgttggccaagctggtctcaaactcctgacctcaggtgattcgcccgcctcagcctcccaaagtgctgggtttacaggcgtgagccaccacacccagcccaagaagtcttttctgatcacccactcttccttctctcccaatggcattagttgttccctcctttgcattttgagagtatgtcctgtaagccccaaatgcagcttgaatcatctgcccatccaccccctgtgcccaacagtaagcctcctctagagtagatactatctcctgcatctcagtgaaccactgcccagcaaagcagtcttgctaaaacaatgactctagagatcctaagctgtgtgagagctggaggagagaattagactgatggtctgggaagggattgaattagtcatcttgtaccttttcttcttgacttaagttccagacctgtagcaaccattcctgcttagacatccagaacataagcctatgggtctgtgcctgttgggtcttagtctgggtgaaacttttctctacttctgtcagctctccagatgaaccacagaagcaggaatgtgggcatcatcagtgaaatctctgcatacagcagacaaagggctggtccagtggctgtttatgaggcagcgctaggagagctctgatccagactctccctgcagtgaaagggagggagcccttcatgaagtattgactgcttgagcaggaattgcttcaccagcacctaactgagtgcctctcgagctcacatcggttttccctcatgaggccacttggagtcttgctgagggacttggttctattagggaaggtgagtttggggatggtgagcagggagggcctggggacattgtggctaatggggcttttctcctcttggcttagattccggcagagttcctctatctcgtcttgttgctgattaaaggtgcccctgtctccagtttttctccatctcctgggacgtagcaggaaatcagcatcatggttgggttcaaggccacagatgtgccccctactgccactgtgaagtttcttggggctggcacagctgcctgcatcgcagatctcatcacctttcctctggatactgctaaagtccggttacaggtgaggggatgaagcctgggagtcttgatggtgtctactctgttccctccccaaagacacagacccctcaagggccagtgtttggagcatcgagatgactggaggtgggaagggcaacatgcttatccctgtagctaccctgtcttggccttgcagatccaaggagaaagtcaggggccagtgcgcgctacagccagcgcccagtaccgcggtgtgatgggcaccattctgaccatggtgcgtactgagggcccccgaagcctctacaatgggctggttgccggcctgcagcgccaaatgagctttgcctctgtccgcatcggcctgtatgattctgtcaaacagttctacaccaagggctctgagcgtgagtatggagcaagggtgtaggccccttggcccttttttctcagtgatgattgatcttagttcattcagccatatagttttttaggccccacgatccctaggaagatcaggggaacagagaactggaaggggccctggtcctccacatagttcctaagcacctgggctataccaggctctgagcagggcgtcatcccatcacagtcttcaacaccaccttgggagtaggtagtatcatcccagtgttatagaagaagagactgaggtgggaaggcagtgggtagagtggggacttggccaggggcacacagtagagagccagaaaacacacagtagagagccaggacactcgtctctaaggccagcgttcttccctttcacctccttagtatgccatgccaaccctccattttacacatgacgaaacagagccccagacaaaaggttgtctttcccagatcacatggcaggaagaagtaaagctgacctgagatcccaagtcttaggaatcccagtcctcagaaagccacttctctctgagccttggttttcacatttgtcagatggaaatgattgtgatttctcagggctgttgagcaggtaaatgaaaatgttttatgaaagaaagcaccaagtttcattttggtcttagcccttgctatgtccctagcaagaagtagatattcatagggatattttgtttgatgtgaggagttcttacagcaagagcttgtagaaggccaaaagcttctggattctattcccaaaagcaggagatgacagtgacagggtggttttggtgaggagagatgaggtagaaaatgagtgcaagcccgctggccactgaccccatggctcgcccacagatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaaggtgtgtaccagttgttttcccttccccttttcctcctccccgatactctggtctcacccaggatcttcctcctcctacagggacctctcccaatgttgctcgtaatgccattgtcaactgtgctgagctggtgacctatgacctcatcaaggatgccctcctgaaagccaacctcatgacaggtgagtcatgaggtagacggtgctgggtctcacccttcccccatgccaggagcaggtgcgggggtctagctgacaccagaagaccacatcttttcatcctatttgccctttgcagggagagtaagatatctcttacttgccatattgaagccaattgggatgaagctcccactttgcacattgaggaactgaggctagattggcaaaatgactctttcaggtcctcagaagatgtctcagctggagtccctgtctgtttttgtttttttgtttgtttgttttttgttttttttgagatagagtctcactctgttacccgtgtaatctcagctcactgcaaccttctcctcctgggttcaagcgattcttgtgcctcagcctcccgagtagctgggatgacaggtgtgcaccagcacactggctaatttttgtatttttagtagagatggagtttcaccatgttagccaggctggtctcgaactcctggcctcaagtgatctgcccaccttggcctcccaatgtgctgggattacaggtgtgagcctctgcgccccatcctcttgtttgttttttgagacagggtcttgctcggttgcccaggctggagtgcagtggggtgattaatggctcattgcagcctcgacctccctgactcaagcaatcctcccacctcagcctcctgagtagctggggctgactacaggcatgcacactgtgcctggctaatttttgtattttgtagagacagggtttttgccatgttacccagtctggtcttgaactcctgggctcaagtgatccacccacctcggcctccaaaagaagtcctggattacaggcatgagacattgtgcccagcctctctgtctctttaaaatcatgaaaactcgtagctacttaagtaattctcctgccttctggaatgatgggtgaagatcttgactgccttgcctgctcctccttggcagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggtgagcctctggtcctccccacccagttcaggcctcttggctatgcatgtctattgtgggtgggagagaaccacctggaagtgagtagcagccaagtgtgactatttctgatcctggtcctggcatttcaccagcattcacctatccccttaattccttcctcccagaattgctaccatcactgtttattaggtgttaaatggagactcaaagggaattcatgcttatagccaagcagctgtgagctcagttcattgagtcctcccagcctcctttgggacagagcaactgggttggattgaataccaggcccagtgagggaagtgggaggtggaggtgcccccatgacctgtgatttttctcctctaggttcatgccctcctttctccgcttgggttcctggaacgtggtgatgttcgtcacctatgagcagctgaaacgagccctcatggctgcctgcacttcccgagaggctcccttctgagcctctcctgctgctgacctgatcacctctggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcgtctcctccctctcttgtagctcttaccagaggtcttggtccaatggcctttttggtacctggtgggcaggggaggaaccacctgactttgaaaatgggtgtgatccaccttccacctccagcatccaatctgaagcccgtgtaggtcatctggtccatttctctctagacccaggccctgtactaacatggggagtgcaggagccacctgagagacagcagtgcctccccttcctttgccgggccacttgagctcttactcagaatctggtactctagtgcctgccatcccaaccccccaccccagccgcaggcctgtttatctgcacaacaagagtgctcctgtgtgccctgcatctcctgcagttccagaggaacatgagactcttagatgctgttgactttattttattccattttacaaatggaaggaagacccacctcccccaaagtcccagaccttgtgagaacaagtcagtcagcctccttccaccctccacagccacagccacacccacagaggaaatgttactgaactgggtggagcaggccctgactccacagagggtgggtggaggctgcagggcaaacatctggtctctgcctgaggatactttccatttgtgttttttgttgttttgagacagagtctcacttgctgtcacccaggctggagtgcagtggtgcaatcttggctcactgcaacctctcccaggttcaggcgattctcctgcctcagcctcccaagtagctgggattacaggcatacaccatcatacctggctaatttttgtgtttttggtagaaacggggttttgccatgttggccaggctggtctcaaactcctgacctcaagtgatccacctacctcagcctcccaaagtgctgggattacaggcatgagccactgtgcctggccaggatattttccatttggagtctcaccaccacaacccccctccacctgcccctgccccagctaggcatccaaggaggccgcaagaagccagggccttggctgcacaggggtctccgcttctctgtccctgttcttatcacctgcactcagaggcaggtgggcaggggtactacaatttcaaggagtggagactgtgaggtcctggaatcccaaggcatctcctgtagggctgggcccttagaattatgtcactcagacccagtttgtaggtgtctgaagaaactgaggcctgacacaggtgatgcaggcaagaacacccagaaagtccactactgaactgggaccgggacccagtcctccttccccttgtggactcccccagagaccagtgctggggtccttggggaagcctgtttggcagctgtggagctaggccctgagaacacgaccaccctccctcttccctcagcctcaagccgctgaagccactgctgcttcgccgcctcgtaagcccaatggtcagagctggaggctagacccttcagtgcttgggttgagggccagggtgttagattggtttttggagaaggaacgagggcccaggattcttcagcttcttagtttttgacaaattgagctgaggccccatagtcctcgggagggacagggttgagtgccataagtcggcaaaccagggtaaaggtgacaggcagctcagccaggctgcagggggtggcatatac

SEQ ID NO: 15282 - DNA, 4615 bp, Human
gtagctgggattacagtgcccgccaccatgcccagctaatttttgtatgtttagtagagatggagtttcgccatgttggccaggctggtttcgaactcctgacctcagtgatctgcctatatgggccttccaaagtgctggggttacaggcgtgagccaccatgcctgcccctagcccctgcattttaacttttttattttattacattttattttacaatatttattactatatttaagggtcatttaagatttttaatcttcttttgatcttatggcatgttatggtggaaattacatggcacaatggtgatttgattgtgagattcctgagggctgcactaagcttcactaagatcctatttattctgacttgacccacagttctggcttatctggtttccctgcctacttcagctaagacgtagcagattagaaagcagttaagggcatattttgacagaaaacagtactggagagagaaactaaaagcaaacaaaacactgaactggtatagcattgcgaagtcattttagtacaggacgaaactgctaacaactttatacagcagaacgcaccggccatattaacagcacagtacagaaattaatgtacataatgaccttgattcctcaaaaaaggttatgttaagtacactctgaatcttaagagagggctatatacttcttataggctatacactaataatatgaagacacatttaaatggtcacaataatttagctgttcaggggataatgtcagttagatgaacaattcagttaaacctctaacgatagcatacaaatgctaagcagataaatctcaaaaatcccattataattatgtagtacagataattaacatttatgaggctgatttggggagagaggggggaaacctaagttatacactaaaattcttccccctccctgaacatgcaataaggcgtttcaccttttaaaaatgtattcccgtcactagtattagttgcctttctccttctaataccaaaatgaaaaagaagaaaagtatcttaataattttccccactgtcacgctaacccctgcatccagaggccactaacacagctggtctaagtctattcccttcttacaaaatagcgctttcaaaccgattgttaatctcagagagaagggttgtgcctaagacttacggctgaataaaagcagcacataaattagtggttatgtgtaatccatcttcttagtttaaagggagaaacaactataacctaaaactctacaagatttagagagcaaagagccctttacattttgttcttataacaacaacagaaatctaacgcaggtacacatatgaatcagaaaacgtcattctccaagtctttataaccaaagggaaaataaaataccattaccctgtcaagagctccgtaaacttattttaaacatcatataatggatttatctgacttgttcatactaagtttattccagtaatagcagtgacttgcaatgatctagagaaagcgggtcaaaaggcacatggtatacgtcctaaaaaagggtggggggcggacgtcaagaaagatctaatcttaaatatcttacttggaagagtcgactccctgctcacaccacccccgatggcttcccccgagtcgtttcttaaagagaaaaaaagacagggatccgggcccttcggggcggtgggagaagaagtccccactgcaccctgaacccttcgggagggaacttggcactgacggccaggcacctgaccaggtgcagcagaaaacgccgggtccgggtggctgctctcggaggctgccgcccggctctgtctacacccctccgagccctcctagggtgggcgcagcccggccccagcctccctccgccccgagccgccgcccagccgaaggccgtttcccgcgggtcccagaggaaggcccggcccgccaggcacctttgatgacgcggtcggtggtggagaggtggaagcgcctcccggacatggtcccctcggcctcctccaggctccaggagcccgccggacgtgcgcctacgccgcggccgccgccttctcctcgggcagccttagctgcccggagccgtcagccagccgtgcccggccccggctcctcagcggtgtccgagcaccagaagggcgcggccaccgcagcgccggcctccgacgccactgacaggacgagggcccaccggccgctctcttgggaggcgccagcggctaaggcggggaacaccgcttcggcaccgaccgcgaccgctgctaagggtggcgaccgggacggccgcggctgctcgcggcccgggccctcgtgcacgcaagcgcgcccccgagcgccgctctcacaacttcccagcggccccgctgtcctagcggacccggccgggcctcccgccccgagcgccgccctccccacccttccgccttcccgcgaggcagtagagctcggcgcacgcgctgctctcggctcctccggctccgggtccctgctgctaaccgcccattttcgcttcttctcagccagccctccccgcagccggccccttctctcctgccagcccctacccgggcccggaacatctgaaacccgcccgcgtggcccgcgcgacccgcgcgggaggccggcccggccatcttgcgacccggccctgcggcctcgcagcggctccgcgccgcctcctgggaccgcctcgccgagaacccctggcctcccagtcctcgcccacaggcgaccaccctcctcacctctgggtctcccacccgctttgtctcaaggagtgtgatcagtccggccgcgctccttcagtttttgtgggtcattcaacaaacgcacacatttaaaccccctcgcttcatctttcccgcttgttgagtgcagttagtacaatgagaaggacattcgtgtccatcctagttccagtccagtagctagggcggtgggggattgggggagctccgtttctgagcaaggctctgctccctcctcactttccacatcgaagagaagggagatctctgctcctgggacccccgggccggacctcctcggccacaagaactgacctcttcctatgccctgtgtgtcacctgcccagctagaagccccttttttcttccccctgacacagtacctgcctccccggcccaggctcactgtggaaccccatgggcaagtccgtagaaacttaacagtctgttcatctcgaggttaaaaactaacctttatctgtccttaaaactgtaagcctagaacagaaactggctccaactgtcctctcactgagtaactggcaaagtcaaaaggattttgacttttagcaatgcaaatgaaatattgaaactgatgtccaataaaacatatgcaagttacaggcaaaaccagtcttaacaattaccgcagtgaccgataagtagttgtagctatgtaaatttaaattaatcccgttcctctaggggactagccacatttcaagtgttcaagagctacacgcggctaccttattggacatccagaaaattctactggacagctgttaggtaaaagattataggattaagcgtaaatctccaataatatggatttatgtataggcggtctggggatatatagtggaatcagaccctgaattatcccttggaattttgaccatagctctttgatggtaaccgcaggaggcaaaaggactttaggagccgactagaatttggttttcgttttcatgatccttgagtcttccacccaagagaattgttcagatatcctggggaaactcttcatttaagaagtaaccagaactccacgcctatcaaatcatacccctgggtcagaggctaaaattcatctggaagaacctcaacaggatagctaaaaataaaaagtttaagaaaacattgcgggccggcaaaaaagaaaaaaaaaaagaccgggtggggtggctcacgcctgtaatcccagcactttgggaggccgaggtgggtggatcacgaggtcaggagatcgaggccatcctggctaacacggtgcaaccccgtctctactaaaaatacaaaaaattagccgggcgtggtggcaggcgcctgtagtcctagctacttggaagactaaggcaggagaatggcgtgaacccgggaggcggagcttgcagtgagccgagatcgcgccactgcaccactccagcctgggcaatagagcgagactccgtctcaaaaaaaaaataaaataaagaaagaaagaaggaaagaaagaaaaaacattgcgggccgggcaaggtggctcacgcctgtaatcccagcactttgggaggccaaggcaggcggatcacctgaagtcaggggtttgaaaacagcctggccaacgtggtgaaaccccgtctctactaaaaatacaaaaattagcctagcgtggtggcacatgcctgtaatcccagctactcgagaggctgagggaggagaatcgcttgaatccgggaggcggaggttccagtgagccaagattacgccccggcactccagcctgggtgacagagcgagactgtctccaaaaagaaaaaaagaaaaagaaaacgttgcaggccgggcacagtggctaatgcctgtaatc

SEQ ID NO: 15283 - DNA, 5585 bp, Human
cttggcactgtttgattccttcatagtaattgcaataatgaaaacaaaatttatttatttgttttaaactaacgtctctgtttgaagcaggcagctacgaggtatgttttagccaacactgtatatcctgcacttactagggcaccaagtagttaatgtttcagttgaatgcaaaactcactgcacttattttgtgatttaaaacaatccccctcaagaaattgagctcttttcaagttaggattgtgttttcatttttaatttttgaactgttagaaccaaccacagtatcagcctcacagtagcatgtaatccatatttattaaactgtactaaatccaactaacacaatgaggcaaataactagataggaggagggggagacactaaagaagtgggaggtcccaagacaaagggtggtagcacaccattcatcaagaaaggcaatacagcagcaacagtaagcaactttgggaaaaggatagtaaaagttcaatatttgacaaggtgagcaatctgtaggatataaaagtagatttccagtagacatttggaaataaggacctagagtggagagaaaagtccaaatatgtggataattttaaaactctctaagatcagaagacattttgaaaatatcatgaaaaaaacctctaagaaaaaagcatgcacatagtttctttcatagaccttttgaaacccatccatggtttcctcaaggttatttatttctgatataggcgtaaaatgaaatcctgaagacagataacatcaatgaattgacagagaagaacaaagacctggaagccactcttcacatctgtacttgtatacagatcttatttccttccacttgtaatttctcagttcctgttttattagctgtaaaatgggaatggcaattatcttctttagaggttgttgcgaaggttaagtgggaacattgtaaactgtgtgacacagcatctggaacataggaggcctagctcttggaagttcaaggttttactggcactcaccatgaataagacaacatttattctacagtagttatttatgttccattcttatctcaactagaatgtaaagcaggaaactgatcttcatttttttgtatccttccagacccaaggccagtgctttccatatagcaagtgctccataaatctctgttgaatgaggaaactaagcacaactcccagtcatatccagtttccttctgctggtgagtcacaccaattgtgagtacagtgtaataaaccttacagggaagaggaagggatttgaagtggatgaacatttaaaaagttgccatcctgtccagttcatcaaaatgactttgtaaaagtactgcagtgttcaataagaacacgtttcatgttgagtttctgtttttcatttgacttcagataaagtattttagtgatactcatataggtctcatctgacaaaacaagtaaacgcaaaggaaaaagaatgtcatatctcaacaaagccattcgttacgaataaatatgaaggtttatgtggttctgcaccatccgagaagagcataatttagctactgaatattttcgacgtttacctgtacattaattctcagctacgtgtattcactcccccaaccccaatttaaatatgtgggcgtctgcttactaggggaattccaggttgtgctttcagctgttgagcttcctcaagcccccttatgcaaaagagcttcacatttttggtccactgcttgggatccttcacctggtacagccttcgctctaggctgagtgagcagcctaggcagcctgacttaaggatgaatctgagccgccagtccctaacgaagcatctccaagaacccagttggggggaaagcatgaggagatgggtgaggagtgggcaagaatcaaaacaccacttggcaacaaagcccaagctctgcgtttagcgatgtaaaacctggattgacagatcactggaggatcactgccaccaaggtccctcggatgcagggctcgccacagtcctcctgtgctaggactttccgctcctccgacctggaggatcctccttgtcctcggactccaggcttccgctttcctctcccgctgggctgcagcccgcccccgcccgccctgggcacagctgcgttactcacgtccttcttcacttcagtgaggtcctcctcggtgagggacggtgcggtgggctccatggtggaggcgggagatggcgcttcttccgggtccgggagctcgggctgcgccgccccgccctggctgggggcttcggcctccgggtaatggggaagaaggagaggaggcggagcgggtcgggagaaagacggccgccccttcgggaacagagggactcgggggtcaaaccgtagcgcttccggccccgcctctgaggtcgacggcgacgcgaatctacgcgacgcgacgcggagctcggagcagcgttccttccctctcgtagaggctcaggcgcaggcaccgccccacggcgaggcgcgtcccttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcggtaagtggcccgggttagcttcctcataaggcatcgtttccgtgggtggggtccgtcagtgcccaggcagctggcactctcagcctttgctgcctgctcacttcgggggagtccggtctgggcttgtcagtaccttgggttcctccccttttcccagaccctgccctacaatttcctgttgttacgtttgccagttactgttttggtcacacacaaacgcactcatacacacatacacatgcatacacacaaacagcctaactacaatactaaacaaatttttgaaagaaaaaaagaaaccacctacaatcccaccactttaacacctcatttaacgtttgcatactttttggtcactgttcattataaacatagcttttcctcattagttaatctgtgtaatggagatagatatgcttaccttttagggctgccgggatcatatgtaaagttcttaaaggtagttgggcacacagtatgcactcaactgattatttatttatttattgagacaggatctcactctgtcgcccaggctggagtgcagtggtgcgattctcggctcactgcagcttccacctccagggctcaggcgatccttccacctcagccaccaagcagctgggagtccagctagtttttttgtattttttatagagatggagtttcgccatgttgcccaggctggtctcaaactcctgggctcaagccatccacccgcctcggcttcccaaagtgcagggactacaggcatgagccacccagctcatcctactcaaacatttattgagtccttactaatatgttctaggcaacttatactatgagtcctccattttatagggggagactgatgaagagacgactatccccagaccgtattttaactactatggcgctgtgtaagaagcaacctgagaagtgtggatgaaaagctacaggtagagccctgggcccaagacggtggcttggacaacatgctaaataaactataaactagatggtatttgaagctacgagagtagataaaaatgacaggaggaccaaggagaaacttgggaacgccaatgtttaagaaacgggaaagcaaaaaaaaaaaaaaaacacacaaaaaaacaatgtaaccagagccacaaaaaccagaatcacagcaagggattctgatgtttacattatgtcctgtttccatgttgacacattacacaaggacagtttttttctaattgcttaatttttcatcatcttccatccgatttacttaaccatccttaactttaggatgaatcctttcatttaacaaatgtgttttgaatgtccactatgtgccagacactgttctaggtgctaggaaaacagctgtgaacaaaaccaataaaaatctctttcctcatggaatttatattctagtttatttgtgtttggggcagacgaggtaggcacttgaaaaattttatctaagtttatttatttatttatttggagacagaatctcgctctgtcacgcaggctggagtgcagtggcacgatctctgctcactgcaacctcctcctcccaggttcaagtgattctcctgcctcagcctccccagtagctgggattacaggcgcatgccaccacacccggctatatctaagttattttaaaaaaataattaattaatttatttttttgagacggagtctcactctgtttcccaggctggagtgcaatggcaccatctcagcttactgcaacttctgcctcccgggttcgagcgattctcctgcttcagcctcctgagtagctgggactacaggcacacaccaccacgcccagctaatttttgtacttttagtagagacaaggtttcaccacattggccaggttggtttcgaactcctgacctcaggtgatctgcccacctcaacctcccaaagtgctgggattacaggcatgatcccccacgcctggctatatctaagttatttaatttattagaagatgataaatgctaagaggaaaaaataaaacagggaagtaggatgaggctgtatggattggtaaaatttaagctagggtggtcatgacctccctgctcactttggaggagtctgtccttgtcttgtcaataccaagataagggatttgatttatgcttaaaggaagtgagggagtgaaccgtgtggatataaggagagagcattatgagtacagtcagcaaccaataaaaatgctcagtgtaactggaaggagatgatctccttgtgtgttgagtcatatgggtgtgctgagtcagacgggaagccactggaaggttctgagcagagtgacatgatctgatttgtgatttgaaaagaagcactttcacttctgtgctaaggggaaagaagatggaagagggaaaaccatttagggaggtattgctatatccaggccccaggaggttgtggttcagaccagggtggagcagtgagggtggtgggagcattttgaaatgaagcaaggaagcagtttgatttcattttgaaaggatcactctggctgctaagtggagagtagatggcaggggcaagggcaagaagcagagactacgtggaggctaccacaatgtcaggttcacgactgagccaaatgtcatgcttggggtcaggttctagcccatgctgaggtccaaggggagtgggtggatgagcagaaagaacactcaggggaccgtaggcaggtaaaagatgattttactcagcagcagctctcatcaacagctttcttacactagctctctacactgtctgccctgtctcaggtgcttagtctggcggctcccccacacagctgcatggccgactctcccttgccttcggggtcagcagcttaactcttcctctctctgggcatgagcaagccgagctgtgtcctggctccccactgtcagtctccaagagggtcaactc

SEQ ID NO: 15284 - DNA, 5832 bp, Human
aagatgcttaaaagtgttggatttggattggtataatgtattctctaaattcacacagtgtccttgtaaaggagacaaaacgttttaaacatcagtactgcggtcacattcctgtaaccatgacaagcagtaaaaatctcacaccaagcaagtactctgtgggaagaggggagttctccaggctataaatagcccctctctccaaggacaaggggcacgcagacaccaaaggcgcctgggcagtgaatgccaacatgacacggcaccattcttcctattccaaggggtccccagtgagagaaacaacagtccacccaccaggacttggtgattaccataagtggaagcaagcaagtgcagcctccaagtgcagacacaccgaatggcttttcagctgacacaccgaatggcagttccggattaattcccacactgtccactccactcgtccacacccatctctgcacccttcagcagtgcagagcaggaggaatcacagtcaaacaaaacctcatggttgttttcctgacactcccgctttcacaatgcaagcaaacacacccccgagccactgatacagttgccagtgaatcacacactctgcctgcagacgcccattctgtttgtggaaacgtattcactgcacatttgcgcttagaactcaatctgggccaaaagttcccagtacagtcccactggcctccttgactaacaaacttcaaggcagctgcattgctaacgtcacaaaccctaagcacacttggaggcaggtaagaagaaacacaaataatcctgcatcggaataaacattccataaggtcacaaaaagaaaaggtgctctactatgctaaacagacactgacagagcctgggctaacaagagctgagaaaagtattagcccctcaagctgggcccaggtcaaccctaattgtaagggtcaggaaactgaagttaaggtggcactattccccaccactagtggtcacctggaaactccacacacggaagccagcatgacattgtgaaacaggtccaaccatgacactctccagcttagaacctgctggattttcccgcagcccaccaggccctggaggcccagccccacaggaagccaccctctataaacactgccggtttctggaactctgagtctcctgtcatgcactttcctcccccagcccccgcgccctcactgcttctttcttggtcagcctcccggggactcagctcctcttggataggagctctggctgtcggtcaccactgtggccgcagggcctggcgcagacgggataaacgatgaagaatgccacctgcgcgtctggacagcgtagaaccgcaatcagcttgcttcaaaatcagatgctacagcctggctttggggacgccttcctttctaaggcataagtgcgagcgttcgctgctgtgcgtggaactgcggccgggagggagtggcggcgtgaacgccggcggctgtagagacacaccggccgcggccccatcaccctgcaggggcctgcggccgccatcccggcctgcccccgaccagctgtgcgacctcgaacacgtcgtgagccggcttcccggctcgggatcgaacccgaggagtgctgtttggggtcgcagtgaggctaagggaggccgcaggtgccaagcgtcccgcctgccgggcgagggccaacccgaggccacgcgcgaggagcggccgcagcgactggacaaaacaaagacaaagacaaagacggctcttcccctgcccgcgccccagccgcgacggcagctcccgcggccgccaaacgggcgtgaccctcgaggagcctccgtcggggcgctgcctgcgaccgtgggcccaggccgcccgccgagcccagcgccctggccgaaaccccgaccccgaccccgacctggacccaccagccgccccgcccccttcgcggccccgcccgccccggcgccctcaccagctccgggaggctcctgcgcggcggccaccgggatgagcagcaggagcagcgcggcgccaccgaggcgcaacctccagtacggcgtcggcccgcgggccactccgggcgccatggtcggccggtcgctctatcagtcagtggagcgttacaactccgactccagcacaagcggtctccgcccggaacagccgcggcgccggaagtggacctgcgaggtggggccatgcgagtgcgcagcctcaaaaagcagctcgccccgctccctcgccatccgccccgcccctcgccaacgggctcgcctcccggcgcggctgaggttcagtgcgcctgcgcgatagaggaaaggagcctggtagcgaggagagcggctgaggctcagtgcgcctgcgcggcgcggatgggcgaggcgtgaccgaggggcgaggcgtgaccgaggggcgaggcgtgaccgaggggcgaggcgtgaccgaggggcgaggcgtgaccgaggggcgaggcgtgaccgaggggctcgccgcggctcctgcgcctgcgcggcggggaacggcgaccggctgaggggactaggggagcgcggtgcttcggtggcggaggtcacggtggcctccatcctaaagggctgcgggcgtcccggacggcggtcccaagcgctgctcacgctgctcttaagtgagccctggacgaggcgcggtgggccctcatagtccgcgccggcgccctcgctccacaccgcggcgtccggccctgggctcccgccgatgtccgcgtgggacttttaggggatttgtttatttttgtacgttaaccacactagaaacggccccagaatgggctgaaacgtgtgctgctgaagctgccacctaaactcccgagagaagcgccgtttctcctccatggcttctcgccgacgccctcgctgcggccttccgggcccctcggttgataaaaggactaaatagtgacggacatttttaaggctacttaagaaatggcaaaaatacatttagaggtgtgaacccgaacacactgcgcgctttaagccccgcgagagccggggccgcccgcttccgtgcgcccgtagctcctttctcgggtccgggattcgccggtgccggggacagaaacctcctgccttcttagttcatgacccttgtagatgaacttccctgttttctgcactgcttagaccagaagacgggaaaccgtgactgccgcacccttccctgaagcaggcactgcccgtcgtccatcaaacgcgaggactgcgcccacctcgtaggaaggacgccgcggtcctgctaaaagcctccgcctctgcctgcccgagggcacccttcccctccccgcttccgagggcggactccattcctctggagccggtgtttccgggtgggccagcctccaactgcctttgaataacccccccttacattagattctgaccctgtggtgattttaggttgggatttgggcgcctgcagatggctccgaagccagcctcttgtgatccgagccacttctctggcactcggagcgctggcacccgcggagcggccttggttcaccggaccgcctgggaacctggccggggtctctggcagcctcccagggctgaggttcagactctgttccgcctacccaggtccacacctgatagggctggagttgaggcttggttttaaggcaagagtttcgtttgttatttctccaaagagtcagctgtttgcaggtgtgtggttaacactatccttcgaggttaaggttttgttcgtcttgctaaagtttgcaaccttttttgtccttcagatttggagaaggggaaagcagtttctctttgaaaagaagcagcgaatcgtggcttaagcaaaatttgtaatccttaaaactggccaggctctggagctgagttcaatttgacatgtctaaactttcttcttgagtaaccagattttcccttacagtcttttgtcacttaagagaactcataggcaatcgtccatccaaaacaagtctttctccttcagggaggacccatctttggaaactccagctggtttcctgtgcagtgcttatggtgccacctctcgttatatttagaaaaatggtctcacgtaacttgagaaaaaacatttcagtgaccaaagccgggtaccattggaacaccaagctaatttacttgtttgctcaattggaaaacgctggctctaggataaaacggaatctttgggagagttattttttatggtagttggaagcatccaaaagaagttctaataaaggtatttatgagagaaaaacaaaaattatctaaaataatttctgaatttaaaaaagactactgaaatttctccccctcctccctcagctccttctctttatcctttgttgtctgaattacctcgcccagacccacctttcttcctcctcctcctcctgttttggggccattgctcaaacagccagtgtctctcataggggacaactatgtgccctagttcatgagttatggtcaaaggtagaacttaaaagtataatcaaggaatttcctgatgctcaccaggaccccactggttttcccagagaatttaaatacccgagtgtgtgaccctgcctctactttgggaaaaataatttttttttttttgagacggagtctcgctctgttgcgcaggctggagtgcaatggctcaatcttggctcactgcaacctccgcctcccaggttcaagcgactcctctgcctcagcctcccgagcagctgagaccacaggcacgcaccaccacgcccggctaatttttgtatttttagtagaaatggggtttcaccatattggccaggttggtcttgaactcctgaccttgtgatccacctgcctcagcctcccaaagtgctgggattacaggcgtgagccaccacgcctggccataaaaattatttaaaatagttaacacgagttcccattgctgacataagcttttgctgatagagcagccgtgttttctgtaataaatcccatcttgttacaaggttccattccttggagtcaaaaaaaagttcaaagggtaggtgtcactaatacgcctgtaacggcacgtaaatctcagcctatagcttttcaactaggtcctttacaagggactcacattttccttctggttctatcagctgccagccatcttataaaaggagacttcttagaattacaatatccacgtttctttctcccaaagggggaagacgtatttagaattagatgagaaagctgagttactagacataaaaaaagtttcaaaatctaacccaattgcgatccctaattgccctagaagacactgaattattgaataatgaagaattacaaaacctactaaaggcagtacttgatcaaatatggtcagagtcttccactgatactggaagaatcctcttggctaccccgatcaaagtcctttagtgtagtggacttattagcacatccttcagtagttctgtgtgtgaaagtgttgatttctctttacctttacttgggaaggcagacaatacacacagacagccatgctcagggctacactgagagtccaactgatgcaaagacagttgtcttacatactgacttgttcttttttttttttttttgacggagtttcgctcttgttgtccaggctggagtgcaatggcgctacctcggctcactgcaacctctgcctcccgggttcaagcaattctcccacctcagtctcccgagtagctgagattacaggcatgcgccaccatgcctggctaatttcgtatttttagtagagatggagtttctccatgttggtcaggctggtctcaaactctgaaccccaggtgatccgccca

SEQ ID NO: 15285 - DNA, 26134 bp, Human
cctgtgacagaaagtacagggttctctttactttgcaactgctacacattccccacacaggcatattctatcaagatcacctggccgttgcaccaaatgccaaatcaatcttttgcttttccttttttatttggtggggtgggggtgggctggtgggggtgggacgctgtgactcaaatacaaaccatcttgttctttggagaaagaaaaagagcatattgacgaccttttctgtcttattgcctctggctaaagtggaaaacagccttttgaaacagggctataagcagccacatccataatctctattttacctataacaccaaaatgcacatctctgacctacacctgaataagtaagaacaactaccattcccatggtcaccaccgaaagccagtccttctagagtctgaaactggcctccagctggtcttcctgatccaggcaacacacagccaccaggctcctcttcctaagatggcacttgcattatgttacttcctcctcaaaatgtaaagtgcttctccattggcttttgcattgagtccagacagcttgatattcaaggacaccatgatctggctccagcctcatttttcacaaatcacaatagtcatccttcactactgagtgcagtggctggtctcaccttgatactgttttttttttttttttgagacggagtctcactctgtcacccaggctggagtgcagtggcgcaatcttggctcactgcaagctctgccccaccccccctgcgttcatgccattctcttgcctcagcttcctgagtagctgggactacaggtgcccaccaccacgcccagctaattttttgtatttttagtagagatgaagtttcaccgtgttagccaggatggtctcgatctcctgacctcatgatccacccacctcagccgcccaaagtgctgggattacaggcgtgagccaccacgcccagcctactctttctttttctttgagacagagtctcactctactgcccaggctggagtgcagtggcatgatcatggctcactgcagccttgaccttcctgggctcaggtgatcctcccaactcagcctcctgagtaactgagacaacaggcatgcaccatcatgcctggttaatttttgtattttttgtagaaacagggtttcgccatgttgcccaggctgatcttgaactcctgggctcgtgatctgtcttccaaagtgctacgattataggtgtgagccaccttgcctggctgatactctttcttaggccaccttggcatgccttatgtccttcacaagtctacccacccttcaaagccttccaaaaagccttctgactacccttgtccacaccatctttactcatctccagcttctatcatagacagggctatccttctaaactctatggtcatctgatcttatgcatatgttgccttctcagttacactgcactgtctaaaggcaaggaccaagtcttcttagattcccttatgtgagttcttgactggcctctgtgggattgaggaggaataaatgagtcaattggtcccttctgttgcactgggaccccagagagaagctcagtatgattctaagaagctgggacttctgctgggcgtccggtgttaacatgtacataggcctcctatctagtgttatccagaccctctatctgctaaccatgattctcagcctcaacattaaacccttctaacatggtttgaggacctgacaatacaggtgatacaggaaggcctgggagtgccctgggggattgctgggattcaagttggctgatttatgaaggtgttgagccacattgtgtggagtgagcatggaggcctcctcacccacaagatgtaacagctggaaggcggtgagccaggcctctgggatggctgcagcctgggtcagggtcaatccctctgggataggcatgaggagcccttcggggacagtgacgtactgagcctggcccccaccggggagcagagccatggctgtgtccccgatcttccagtgtccctggcagccaggccccagctctgccacatgtccagatgcctcaagtcccaaaatgttgctggctcctggaggtgggtcatactggccttgtctctgcagagaaagaagtgcactaagtggtgagcatgatcagaaatctgtatgtcactacccctggccccccttccaagatcccctcttttttttttcaaaaataaatttcagaatgaagtcaggtttttgtaagtaaggagaagaaaaaggagaggccattagttttatgcaaataaactggaggtcacatgatcagtggatgttataactggtagagtccttagctatttacctcatctgaaccccttgctttacagatggagaaactgagtcccagacgggaaataatagtagtgggattaggaaccttgacgatggttcccatgcatcaagcgctaggctctgtgctcactcaccccagtcctcagaagctgtagagcagagggacttaaccaggagtgtgtggcagaaccacctgaggagtatttcaaagtacacgtgcctgggcccccatcacgtttcttttgtgccccgggggattctgatgcacatttctgaatgaccccaaccaatgcagctggcccaggtcagtaaatcagcatcagacagaagaaaattcttaagagtactgcccgctgtcagctccgggactctcagagtggaaagagttaagaggtctttggagccacaaagacctcagcttgaatcccagctcttctgattgctagtgtcacggccttgggcgtactgcttaacctcactgaacttcagtttccttatctgtagaattaagatggcgaacagggtagcctggggagtaagtgtgcccacaccccacaacaatgttagttccgccctcatctggaggcctgagtggctatggattagctcggggtggattctgctttacaagtactcccccttgttttgcatgaacaaagagggcgccctgggtttaggtctgggaagccccagcgcagctgcctgctgggtgtggagcggtgcacgccttcacgtctggtcaatgtccactgagtgctgttgagagggaggctctggagtcccgcccgccccggcgcggctgagccctgggtacctgcattaagtccgcccggttcagggcgctggccgccaccttcaggaggacttcaccctcccccgggctcggcttggccacctccttcacgtagaggttttccggtcctcccggcttgtcaaagtgcacggctaacatattgtctgaggacacagggcagggcagggcaggacaggacagggcagggcagggcaggacaggacagggcagggcaggacaggacagggcaggggccgctgtatcctcgcggagcagcccagcctcaggctggcaccgcagcgccccctgccggccagcgcctcgctgccctggtctgccgcggacccggcctccgccccgagctcctgcctgggaagtcctcggccgcctccagaccgatcccacccggaacacagatgggaacggcgggaagtgggatggcggtacagggctggatgcggcagagcaggacaacgccgaagaggatcaggcaaatcacactccctctgagttggaagcccccagcccgacccgggtccccggcgcccgtatgagttacttactcctggcccggctcccctcccatgcaccaggcggcgccgagtggttctggctcctgcgggtcccggtgacaaagcccgagccccagagccccaggactgcctctgcctccaccggaatggacggctggacctggggtagccggaggggtggggctaagcagaaccaccctccccctctttcctttcctccttccccctttaaaacgcaaagttagaagcaagcaaatcagattttcttgtccttttagcctctggaaaagagtctttctctcagcttgacagaaagtgcgattctagctctcacttcaaggagaggaaacttccttctctctagggaacgagacccaacctcttggcgggcggattggtccattttccaggcatggccaggcttttggcacatttatgtaacaggctggcatcccgcccatcttgagcatgggtgggcaagctgggtgctgctaagagaagagaaaggagccgttgggagtgggggtggggaaggaaggcaaaacgcagtcctgggatccttatcactcgcctcctcctgacagtcctgggggagaggttcagccccaggagaaggatgctggcgattgggtaaaagctgtatccgtaagctacatgaaggtttctcaatctcggcgctattgacattttggactagctagttcgttattgtaggagatcgtcctgtgcatcgtaggatgtttagcagcatccctggcctccccccactacatatccgtagcactccttgtaaattcctgttttagtaagaacctcccatccttgacatctgatcaccctcaatatctcatcctccaccatcccccaagtgatatccgaccaccctggcctgtcttcagtgagaatcctgttaggtcagtttagatagaatcccccttacccctgatgcctcttaccaattttccatccactgaccccctacactgctccttggctatacattcccacttgtccgtgatgcattcagagttgatcccaacctgtctcctccactgcaagaactcattgcagtggtccctaaacctgtagcgatggtgctaaataaagtcttccttaatgtgctttaacaagtatcattgaataattatttctttaacacaacagagcaaaagcctatagagatggaaataataaaatgatgggacttaaggaaaaattcaggagaccctgctatgagaataacaggaattttaggccgggcgcggtggctcacgcctgtaatcccagaactttgggaggccaaggcgggcggatcacgaggtcaggagatcgagaccatcctggctaacacggtgaaaccccgtctctactaaaaatacaaaaaattagccgggcgtggtggcgggcgcctgtagtcccagctattcgggaggctgaggcaggagaatggcgtgaacccgggagggggagcttgcagtgagccgagatcgcaccactgcactccagcctggacgacagagtgagactccgtctcaaaaaaaaaaaaaaaaaaggaattttagaaggaggaagaggaatggatgaagaagattcaatagttaaccaaataaaagaatacagttttcctaaattctaccagattatacggattgaaaacattcactaaaggatggattcataagaacaaaaatgcatgcctatattttataaaatttcaggttctaacaagtgtggaaagaataagttactcacaattggttaaaaaaaatggcttccttctctccctccctccctccttccttccttccctccttccccaccccctctttctctctctctcttttttgtagtgtaggggtctcattatgttgcccaggctggtctcaaactcctggactcaagcaatcctcctgcctcagcctcccaaagtgctaggattacaagtatgagccactgtgcccagcaagtttctatctgcaatctggaagctagaagagagtagactagcgtctattgactagaagaaaagcactgtaactcaatataccccattaagatataattcacttgttagggcaaaaaacatgtctgaggatgtataaggattcagagacacatcatccggatacacatctgtccaaaatcgaggaaaggtttgaaccaaataaatatcctagaacagagacagatggaaaggaaatagttgtaaataacaaactttgcaaaaatcgacactaaaactgattggattaagaaaatggaatggattaagatagatgaggaatgtgtaatgtaagtgctaaataagaacttttaagatgcaaggagtaactttaaaaaaaatctaataataccaaccactaagtatactaaagtatcccagtaaaactagtagttgaaagtgcctaagattttatcttagtgagcccttggtcgatgtaatcttgcagtgtgtaataagaaatatatatttttggtctttgtcctgggttcctacaatagcactcctaaaacctttgttatttgctgaataaacatctctttctttcttttgtttttaactagatatacggtcttgctacgttgcccaggctgatcatgaactcctggactcaagcaattctcccacctcagcctgtaaagtactggaattataggcatgagccactctgcctggccaataagtatcttttattatattttgttctcctgcagagctcctaaaacccttggaatttcgtatgtgatagaagtgactttttatattaataacaaacccttataagcacactcgagtttatgctaatatgacttagggtgggggccctagatagcttcaggatgagctggtcaccagaaagaccctgggaaggggaagcagggactggagattacacgctataagaattcttttttgttgttgttgttgaaactgagtctcactctgttgcccaggctggagtgcagtggcctgacctcagttcactgcaacctccacctcctaggttcaagcgattctcctgcctcagcctcccgagtagctgggactacaggtgtgagccaccacaccagggtaattttttttttttttttttttttgagacagagtctcactctgtcacccaggcgatctcggctccctgcaatcctctcaagtagctgggactatagatgcacgctgccacgcccagctaattttttgtattttagtagagacagggtttcaccagcccagggttttgcaacagtccaggctggtcgcaaactcctgagcttaggcaatccacctgcctcggccttccaaagtgctgggattacaggcgtgagccactgggtccggcccatttttgtggttttagtagaaatgggatttctccatgttggccaggctggtcttgaactccttacctcaggttatccatttgcctaggcctccaaaagtgctgggattagaggtgtgagccactgcgcctggccctaaaaactcttgaacaaagaaatgtggtgagcttcccagctggtgaacacatccaccatgggaagatggtgtggtgtaccccaactccatggggacagagactcctgcacttgggatccttctggacctcattctacatacctcttcacctggctgttcatccctttattatatatatatatctttttttgaggcagagtctggctctgtcgcctaggctggaatgcagtggggtgatctcggctcactgcaatctctgtctcctgggtttacgtgattctcctgcctcagcctcccaagtagctgggattacaggcatgcaccaccaagcccggctaatttttgcatatttagtagagacagggtttcgccatgttggccaggctggtcttgaacttttgggctcaagagatccacctgcttcggcctcccaaagtgttgcgattacaggcgtgagccaccgcgcccggcctataatattctttatcataaactagtaaacgtaagtgtttccctgagttttatgaaggattctagcaaattatcaaatccaaggagggagtcatgagaatccctgatttatacagccagttggtcagaagtgtaggaggcttggatttgcagttggcatctttaatgggggcaaccttgcgggactgagcccttaatctgtgggatctgacactaactccaggtagagagtgtcagaattgaattgtggaacacccagcctatgtcagagaattgattgatgtgggaataaaacctgcatatctagtgtcagaaacgaagtgttctgtgtgagtgtagaaacagtgtggtttcccagatatggggaaatagattatatttagtagaaatgtatccaattatgaaagttgagaaatgggctgggtgctgtggctcatacctataatcccagcactttgggaggctgagaggggtggatcacttgaggtcaggagttcaaggccagcctggccagcatgatgaaaccccatctctactaaaaatgcaaaaattagctgggtgtggtggtggttgcctgtagtcccagcttgttctttataaaaaccagtaacatgaatgaaatgtattgtgagttacagctgggaaacaagaaatagccaaggtctgaaagactgggaatgagaaaggagatacaaccacagatataggagtgattaaaacaaaaataaattaaattatgtgaaattctacagcaacaagtagtaaaatctagaaaaaaaaaggaagatttttttagcaaaattactccattctacccaatgggtagagtattttcgcctcattctgttgatgttgggtttggccctgtctcttactttggtcaatgatgagtgagaaaggcatggtcagtttccatcagtccccttaccttcctgccacccacagatagcctctatttcagcttgtccctgagtgagaaatactcagggtagccctgaatccaacctattgtcttgggaccagcctagcagagtcacaaccgaggaagaaataaacatttgtttttgtaagctgttgttgttgtaagctgttaagatttggggatagtttatttttgcagcaaaggcttgttaataaagataaacatttctttaaaaaattagcaagtatacaaaattagccaggtgtggtggcgcatccctgtaatctcagctactcgggaggctgaggcaggagaatcactcgaggcagaggttgtggtgagccgagattgtgccattgcactccagcctggggaacaagagcaaaactccgtctaaaaaaaaagaaaaaaaaaaaaaaaacgccgggcgcagtgactcacgcctgtaatcccagcactttgggaggccaaggcgggcggatcacgaggtcaggagatggagaccatcctggctaacatggtgtatttctctactaaaaatacaaaaaattagccggggtggtggctggcgcctgtagtcccagttactcgggaggttgaagcaggagaatggcgtgaacccgggaggcggagcttgcagtgagccgagattgcgccactgcactccagcctgggctacagagtgagactccgtctcaaaaacaaacaaacaaacaaaaaaattagcaaggactggcacggtggctcaaccctgtaatcccagcactttgagaggccaaggggggagcagaacagttgaggtcaggagttcaagaccagcctggccaacatggtgaaaccccaactctactaaaaatacaaaaattagctgggcgtggtggtgcacgcctgtagtcccaggtacctgcgaggctgaggcaggaggaggttgcagtgagctgtgattgcaccactgcactccagccttggtgacagagagagcctcccatctcaaaaaaaaaaaaaaaaaaaaaaaggaaatggagttcagcaacttatattccctatgattatacaaaatcaatattgggaagtctatcaatacaaccccaaaacatcaacaaattaaaggagaaaacaccatatgagccaatcaatagaggccaaaaaggcattgattaaacgtagaagccattcattataaaacctccaagcaaaataaggataaaaggaaagtatttatagtagactttttttaaaagacaaggtctcattctgttgcccatgctggagtgcagtgttgtgatcacagctcactgcagccttgatatggctcaattgaacctcccacctcagcctcctcagtagctaggactacaggcttgagccaccacacccagatagtttttgtttgtttgtttatcgtttgttttgtagatacgaggttatgccatgttgcccaagctgacattattatttaacattaattcggaagttttagtcaatacaataagataaaaaacgaggtaattgataataaatactggaaaagtgataaaacagcctccttttgttgttgatatgattgtagacttagaaaacgcaagagatgcgctgggtgccatggctcacgcctgtaatcccagcactttgggaggcggatgacgaggtcaggagatcgagaccatcctggctaacacggtgaaaccccgcctctactaaaaatacaaaaaattagccgggcgtggtggcgggcgccagtagtcccagctacttgggaggctgaggcaggagaatggcgtgaacccgggaggcggagcttgcagtgagccgagatcgccactgcactccagcctgggcaacagagtgagattccgtctcaaaacaaaaacaaaaacaaaaaacaaacaaatacaaaaaaccacaagagatgctaattttaaaaatgaagcaaacatttttgtttgagataatgagataatttgtaaaagctgtccagatgaaagctacatacaccagaatcaatagctttattctacttcagttaagcaactagaaatattaataaaaatggggaaaataacacttttaccatagcagtacaagttgtaaaagcataaggaatgtatttaacaaggaagatacaaaaattatataatgaagactgtaaaactatatcaaagaacagaaacaagatctgaacaaatgaaacagtaccatgtttttagatgagaatacagtacccaaaatgtcagttttaccaaattagtatacaaattcattataaatttggttataatgccaacagtatattttttgattggataaagtggtgttagagtgtatgtggaagaacaaatccccccaaatgaccaataaatatatgaaaaagaatagtagggttgggagtgttggctcacatctgtaatcccagcactttgggaggccgaggtgggcagatcacttgaactcaggagttcaagaccagcctgggcaacatagcaaaaccccatccctacaaaaaattagccaggcatggtggcatgtgcctgtagttctagctacttgggaggctgggagatggaaagatcacatgggcctggcaggcagaggttgcattgatcataccactgcactccagcctgggtgacagagtaagactctgtctcaaaaaaaaaaaaaaaaaaaaaaaaaggaatagtagtaggaaagacttatattaccagatgtcagaaaataaatcagccaagcatagtggctcaggcctgtaatctcaccactttgggaggccaaggtgtgtggattatttgaggtcagaagttctagaccagcctggccaacatggtgaaaccccatctctactaaaaatacaaaaattagctgggtagtggtggcatgtgcctgtaatcccagctattcgggaggcggggcaggagactcgcttgagcctgggaggcagaggttgcagtgagccgagatcgcgccctgcactccagcctgggtgacagagtgagaccctgtctccataaaaaaaagaaagaaagaaaataaatcatagcgatagtaacaatgacagtatgaaacttacttctaaggagtttgtcctgtagaaataaaacacaccaattatacagatgtatgtacagagatgtttatttcagccttgatcatagtaacaaaaatttagaaacaaagtagatcccatcactaagggaatggctgcataaattgtgaattctatgcatccacttgaaaaatgaactagagctatagcagttgacatcaagggatttctgtgaagcgtttgtttaatcagagtaaaattatggtaaaacaatgacaaaatacccccatacacatatacatgattttatgcacacacacacacacacacacacacacacacacacacacacacacaccatgtacagaggctacctgcctctgccatcttcctggccacccaccaccatggctcagggctcaaggcgtttctccttactccaggtggtagtctgcacacatttttattctgaaataggcaaaaagcatgtcccaaaactatgtgtcccctctcactttttatttttatttttattttattttactttaagttctgggatacatgtgttgaaggtgcaggtttgttacgtaggcatacatgtgccatggtggtttactacacctatcagcctgtcatctaggctttaagcccctcatgcatcaggtgtttgtcctaatgctctccctccccttgcccctagccccccaacaggccccggtgtgtgatgtccccctccgtgtgtccacgtgttctcattgttcatctcccacttatgagtgagaacatgcgctatttggttttctcttcctgtgttagtttgctgaggatgatggtttccagcttcatccatgtccctgcaaaggacatgaactcactcttttttatggctgcatagtattccatggtgtatatgtatcatattttctttatccactctatcattgatgggcatttgggttggttcggtgtctttgctattgtaaacagtgctgcaataaacatatgtgtgcatttttttttttttgagacagaatcttgctgtgtcacccaggctgaagtgcagtggcacaatcttggctcactgcaacctcctcctcctgggttcaagcgattctcctgccttagcctcccaagtagcttgggactacaggggcccaccacctagcctggctaattttttttgtatttttaatagagacgggtttcaccatattggccaggctggtcttgaactcctgaccttgtgatctgcccacctcagactcccaaagtgctgggattacaggtatgagccaccgctcctggctgcatgtgtctttgtagtggaatgatttataaacctttgggtatatacccagtaatgggattgctgggtcaaatggtatttctggttctagatccctgaggaatcgccacatacttttttttttttttttttttttttttttaagacagggtcttgctgtgtcacccaggctggagtgcagtggcaccatcatagcttactgcagtgttgacctcttggattcaagtgatcctcctgccccagcctcctgaataactgggccttggcctcccgagtagtctcatgtgcctgggactgcaggcacatgccaccacacctggctactttttaaagttttggtagagacaagatctttcatgttgctcaggctggtcttcaactcctgggcttaagtgatcttcctgcctccatctaccaaagtacagagattacaggtgtgagccactgtgcctagcctcctctcacatttttaagttgatatctaaaattattcacctgaaatataaatagtttaaaagataaggatttcttatttcttttaatactgacattttaaactcttaaaacaggctttttccccctcccgagagacagagtcttgttctgttgctgaggccggagtaaaatgttgtgatcataactcactgtaacctcaaactcctgaactcaaggaatcctaccacctcagtcttcctagtagctgggactataggcacatgacaccatgcctggctaatttttctgtttttcgtagagacagtctcactatgttgcctcagctggtcttgaactcttggcctcaagggatcctccttccttggcctctctaagtgctgagtttacaggcatgagccactttgcccagcctacatcaggcttttaaatatatcaattgggccgggtgcggtgactcacacctgtaatcctggcattttaggaggccgaggtgcgcagatcacttgagttcaggagttggagaccagcctggccaacatggtgaaaccccatctctactaaaaataccaaaaaaattagcctggcgtggtggcacacactcatagtcctagctactcccaagggtgaggcaggagaatcacttgaacctgggatgcagaggttgcagtcagccaagattgcgccactgcactccagccttatattagagcaatttgatatttattaatataatcatccactaagaaagacccaaactcttctttaacagttaaaagtttaacaaccggaacagctccagtctgcagctcccagcgtgatcgacgcagaagacaggtgatttctgcatttccgactgaggtaactgattcatctcactgggactggtttgacagtgggtgcagcccacggatggggagctgaagcagggcagggcgtcacctcaccctggaagtgcaaggggtcaggggatttccctttcctagccaagggaagccgtgacagactacctggaaaaatgggacactcctgcccaaatactgcacttttcccaagatcttagccaccggcagacaaggagattctctcccatgcctggctcggcgggttccacacccacggagccttgctcactgctagtgcagcagtctgagatcgaactgtgaggcggcagcctggctgggggaggggcgtccgctgttgctgaggcttgagtaggtaaacaaagcagccgggaagttcgaactgggcagagcccactgcagctcagtaaggcctactgcctctagactccatctctgtggccagggcatagctgaacaaaaggcagcagacaacttttgcagacttaaaggtccctgtctgacagctctgaagagagcattggttctctcagcacggtgtttgagctctgagaacggacagactgcctccttaagtgggtccctcacccccatgtagcctaactaggagatacctcccaggaggggccgacagacacctcatataggcacctgcctctctgggacgaagcttccagaggaaggatcaggaagtagtatttgctgttctgcaatatttgctgttctgcagcctccgctggtgatacccaggaaaacagggtctggggtggacctccagcaaactccaaccgacctgcagctgagggacctgacagttagaaggaaaactgaaaaacagaaaggaatagcatcaacatcaccaaaaaggtcatctacaccaaaaccccatctgtaggtcaccaacatcaaagaccaaaggtagataaaaccacaaagatggggagaaaccagagcagaaaagctgaaaattctaaaaatcagagtgcctcttctcctccaaaggatcgcaactcctcgccagcaaagagacaaagctggatggagaatgactttgacaagtcgacagaagtaggcttcagaaggttggtaaaaacaaacttctccgagctaaaggaggacgtttgaacccatcgcaaggaagtaaaacccttgaaaaaagattagacgaatggctaactggaataaacagtgtagagaataccttaaatgacctgatggagctgaaaaccacggcacaagaacttcgtgacacatgcacaaccttcaatagccgattcgatcaagtggaagaaagggtatcagtgattgaagatcaaattaatgaaataaagcaaataagacaaggttacaggaaaaagagtaaaaagacatgaacaaagcctccaagacaaatgggactatgtgaaaagaccaaatctatgtttgattggtgtacctggaagtgatggggagaatggaaccaacttggaaaacactcttcaggatattatccaggagaacttccccaacctagcaaggcaggccaacattcaaattcagaaaatacagagaacaccacaaagatactccttgagaagagcaaccccaagacacataattgtcagattcaccaaggttgaaatgaaggaaaaagtgttaagggcagccaaagagaaaggttgagttacccacaaagggacgcccatcagactaacagtggatctctctgcagaaaccctacaagaagagagtgggggccaatattcaacattcttaaagaattttcaacccagaatttcatatctagccaaactaagcttcataagtaaaggaaaaataaaatcctttacagacaagcaaatgctgagagattttgtcaccaccaggcctgccttacgagagctcctaaaggaagcactaaacatggaaaggaacaactggtaccagccactgcaaaaacatgccaaattgtaaagaccatcgatgctatgaagaaactgcatgaattaacgggcaaaataaccagcgaacatcataatgacaggatcaaattcacacataacgatattaaccttaaatgtaaatgggctaaatgccccaattaaaagacacagactggcaaattggataaagagtcaagacccatcaatgtgctgtattcaggagacccagctcatgtgcaaagacacacatagactaaaataaagggatggaggaagatataccaagcaaatggaaagcaaaaaaaaaaaaaaaaaaaagcaggggttgcaatcctattctctgataaaacagactttaaaccaacaaagatcaaaagagacaaggccattacataatggtaaagggatcaattcgccaagaagagctaactatcctaaatatatatgcacccaatacaggagcacccagattcataaagcaagtcctttgagacctacaaagaaacttagacttgcacacaataataatgggagactttaacaccccactgtcaatattagacagatcaacgagacagaaggttaacaaggatatccaggacttgaactcagccctgcaacaagcagacctaatagacatctacataactctccaccccaaatcaatagaatatacattcttctcagcatcacatcacacttattctaaaattgaccacataattggaagtaaagcactcctcagcaaatgtaaaagaacagaaatcacaacaaactgtctctcagaccacagtgcaatcaaattagaactcaggattaagaaactcactcaaatccacacaactacatggaaactgaacaacctgctcctgaatgactactggatacataacgaaatgaaggcagaaataaagatgttctttgaaaccaatgagaacaaagacacaacgtaccagaatctctgggacacgtttaaagcagtgtgtagagggaaatttatagcactaaacacccacaagagaaagcaggaaagatctaaaattgacaccctaaaatcacaattaaaagaactaaagaagcaagagcaaacaaattcaaaagctagcagaaggcaagaaataactgagatcagagcagagatgaaagagatagagacacgaaaacccttcaaaaaaatcaaggagtccaggagctggttttttgaaaagatcaacaaaattgatagactgctagcaagactaataaagaagaagagagaagaatcaaatagatgcaataaaaaatgataaaggggatatcaccaccaatcccacagaaatacaaactaccatcagagaatactataaacacttctttgcaaataaactagaaaatctagaagaaatggataaattcctggaaacatacacccacccaagactaaaccaggaagaagttgaacctctgaatagaccaataacaggctctgaaattgaggcaataattaatagcctaccaaccaaaaaaagtccaggaccagatagattcacagccaaattctaccagaggtacaaagaggagctggtaccattccttctgaaactattccaatcaatagaaaaagagggaatcctccctaactcatttcatgaggccaacatcatccttatgccaaagcctggcagagacacaacaaaaaaagagaattttagaccaatatccctgatgaacatcaatgcgaaaatcctcaataaaatactggcaaaccaaatccagcagcacatcaaaaagcttatcaaccatgatcaagttggcttcatccctgggatgcaaggctggttcaacatacacaaatcaataaatgtaattcatcacataaagagaaccaatgacaaaaaccacatgattatctcaatagatgcaggaaaggccttcaacaaaattcaacagtgcttcatgctaaaaactctcaataaactaaatattcatggagtgtatctcaaaataataagagctatttatgacaacccccagccaatatcatactgaatggggaaaaactggaagcattccctttgaaaactggcataagacaaggattccactcctacgcaacatagtgttggaagttctggccagggcaatcaggcaagagaaggaaataaagggtattcaatcaggaaatgaggaagtcaaattgtccctgtttgcagatgacatgattgtatatttagaaaaccccatcgtctcagcccaaaatctccttaagctgataagcaacttcagcaaagtctcaggatacaaaatcagtgtgcaaaaatcacaagcattcctatacgccattaacagacagagagccaaattatgagtgaactcccagtcacaattgctacaaagagaataaaatacctaggaatccaacttacaagggatgtgaaggacctcttcaaggagaactacaaaccactgctcaacgaaataaaagaggacacaaacaaatggaagaatatttcattctcatggataggaagaatcaatatcatgaaaatggccacactgcccaaagtatttatagattcaatgccatccccatcaagctaccaatgactttcttcacagaattggaaaaaactactttaaagatcatatggaaccaaaaaagaaccccccattaccaagacaatcctaagcaaaaagaacaaagctggaggcatcaagctacctgacttcaaactatactacaaggctacagtaaccaaaacagcacggtactggtaccaaaacagatacatagaccaatggaacagaaaagaggcctcagaaataacaccacacatctacaaccatctgatctttgacaaacctgacaaatacaagcaatggggaaaggattccctatttaataaatggtgctgggaaaactggctagccatatgtagaaagctgagactggatcccttccttacaccttataaaaaattaattcaagatggattaaagacttaaatgttagacctaaaaccataaaaaccctagaagaaaacctaggcaataccattcaggacgtaggcatgggcaaggacttcatgactaaaacaccaaaagcaatggcaacaaaagccaaaattgacaaaagggatctaattaaacgaaagagcttctgcatggcaaaagaaactaccatcagagtgaacaggcaacctacagaatgggagaaaatttttgcaatctgcccatctgacaaagggctaatatccagaatctacaaataactcaaacaaatttacaagaaaaaaaatcccatcaaaaagtgggtgaaggatatgaacagacacttctcaaaagaagacatccatgcagccaacagacacatgaaaaaatgctcatcatcactggtcatcagagaaatgcaaatcaaaaccacaatgagataccatcttgtgccagttaaaatggcaatcattaaaaagtcaggaaacaacagatgctggagaggatgtggagaaataggaatgcttttacactgttggtgggagtgtaaattagttcaaccattgtggaaggcagtgtggcaattcctcaaggatctagaactagaattatcatttgacccagcaatcccattactgggtatatacccaaaggatcataaatcatgctactataaagacatatgcacacgtatgtttattgtggcactattcacaatagcaaagacttggaaccaacccaaatgtccatcaatgatagactggaataagaaaatgtggcacatatacaccatggaatactatgcagccataaaaaaggatgagttcatgtcctttgcagggacatggacgaaggtggaaaccatcattctcagtaagttatcacaaggacagaaaaccaaatagtgcatgttttcactcataggtgggaattgtacaatgagatcacttgggacacagggtggggaacatcacacaccagggcctgttggggggttgggggctggtggagggatagcattacaagaaatacctaatgtaaatgatgagttgatgggtgcagcaaaccaacatggcacatgtatacctatgtatcaaacctgcacattgtgtacatgtaccctagaacttaaagtataataataaaaaaagttttacaaccttatttttcttctactactcatattttcattccactgttttcattgaatcatattctgctatattttatgctttactgatcattcttatctgcaggaaaaatatgtatgtaaattgacattaatttaaaaaattattttctgtgaccacagggctactataagtgttaaatttcttttggatttattattatgatattattagtccacaattgatcaaaacaatatgtattattttaaataataattattaaacataaaacgtaattggaaatatattcttaatgatggtagggctgaatttttcccaacatttatatatgtggatgaatattacttattgctagaattggactgagttcgaaattagttctcttcctagtttttattattttattttatttttttattattttttaaagacggggtctcgcactttcgcccacgatggagtgcactggcgcgatctcagctcactgcaagctccgcctcccagattcacgccattcttccacctcagcctcttgagtagctgggactacaagcgctcaccaccatgcctggctaattttttgtatttttagtagataccgggtttcaccgtgttagccaggatggtctctatttcttgactttgtgatctgcccgccttggcttcccaaagcgctgggattacaggcgtgagctaccgcgcccggtccctattttttatttttatagacaagctctgagaaatctagtttgcataaattagatgggaaaaaaatttcatcataggaatgccagccgattctttgaatacctctgaattatataataaaaaccatataatgatctatcatcaaaagttgttttcaatgctctattagctgacaacttaattagatcttgcttcagttttgttgaaagtaaagacttggaaaccacccaatctgttactcagtcacaagtgtcactcaagttctcagtttctggaattataccagcaaagctttctgaagacttatcaaatgcttattaattatatctgctattttttcacttagaggcaccttgtttcaattgatatgctcaggaaagattcgggaagtaaaaatgttaattttaatacatttttgctaaattttttggatcaaatccttttaccctatctcatgttttaaatgtattttcaggctgggagtggtggctcacgcctgtaattccagcactttggaagcccaaggcaggcggatcagctgaggtcaggaatttaagaccagtctggctaacatggcaaaaccctgtctctattagaagtacaaaaattagctgggtatggtggcaggtgcctgtagtcccagctactcaggaggctgaggcaggagaatcgcttgaaccctggaggtggaggttgcagtgagctgagatcatgccattgcactccagcctgggcaacagagtgagactctgtctcaaaaaagaaaccaaaaaacaaaataaatgtattttcattaacatatcggagctgcagacttaactcatttatggaaaacatctgtgacattcttattggcaaaagcagtcctcactgttaaactaatcagccaaatcaaattactttgtatcagaaaaagtttctcattttttaattcaataatcatgttaatatgtgccttgtaacaatcattttgcttctgaaccttaagaaatatagatggacaaggcatgcagccctcctttcctggatgaattatgatacaaaagtgttcactgtttctcactgatactttttttgctttactctcatgggactctccttcacatatgatgcatttttgaacaatggaggatgaaagaaatcatgcaatttaaaatatttagaattttctcttcctttggcaccttacagttcttttgctccaagccaggctcaaaggctcaaagggctgtgtgagcgtgagcccttttgtatactgggtgaagggaggctggggagggaggccagaaagtagctttgacatcagtcctcaactacagcagatctttttcaggaaagtacgtatggaagttgagaacctgggaaaaaggaaccccttaaatccattcatgcctgtgtgccccttctaatggctttgtgaaccatcaggacataaagttctctcatttggagacctctgttacaaaagattgcctgctccctgggcacctccacaggtgctgtatagctaccaccaaagggtcacttgtgtgggtctctctgcgtagctggacccagttggaagtttgtaatgagaattataggaggcaactggaatgctctacagaggaggctccagacagttattgccttgaggaagtttatgaaaaaggcttccactaggcacccagcaatgcagcgggtgtgtttaggaaaggctggccggccaggaggtgagctgccaagaggcttcaccaggcctgcagaacttcagagaatcgctatagtccaggtcagactccctgcctgtcggtatgtggagcgcgggtctacagctcacagaactgagttcttaaatccaggtatcagtgtgctaatttgtaagaagaaattattggcatgggggctgaaccccaaaatctacaggcaaatctatgtggaatgtcaaatggtaagccaggactcaggacaagatgggacgattgagatgaattgggggtggggccgagatagtggactagaggcagctcatgtgtgctgctgttttggagaagaaacaaaaggactagcaaacactgagctgcaggccgatcatctgaaaaaccacgttgggacccatcagggcagtagaggaacacagagtgcagaaaggagtgaagccaggcaccagctgtttgggctcagcatggagccaggagaacctctccagcacaggacagggtgagtgagtgagagcccccagggtgattcatgctctccacagggacctgtgcaagactgggaataggagaatcccactgggccccacacccacccatcgtgtttctagactgaggcagagagccactcagacgttttacagggccaactctcgagtccaaggggacctctataagccttgggccctggggcagaccagccagcgccgaagccccagcaaaggctgcagttgccatgcatgggagcagtaaggttgctccacccacccatgctgggtaggactcaacaccagcctctagcccagtagtctcacttcagcctgaactcggccagccactccacccacccccaccactggtagccaggcgggcaacacctgctagagcttccagcctaatagccctgcttctgtgtgaactcagctagagggtgcagctttctgttgtcctgggaaacacccgaacagcagagtaagtgactctacctaccctgccactggtagccagttgggtaacaactgctagagctcctggcccagcagctctgcttctgtgtggattcaactggtgggtgcagcctcctgttgtcataggaagcacccaaatggcaaggcacatgaccatacccacccttgccactgacagccaggtggataacacctgctagagcttctggcccagcagtcctgcttctgtgtgaactcagccaacaaatgcagccttctgttgtcccaggaagcacagacaccagagaaggcattcccaccaaccccagccactggtagccaggcaagccacacctgccagagctggcccagtggctctacttctacctgaatttgtcaagggacgcagcctcctgttgcactggaaacacccagacagcagggcagccaactgcatccacccacccccgcgtcctgtagccagatgggccacacccagtagtttccaatccagtggtcctgattctgcctgaactctgcaggcagggacaacctcgtgtttccccaggaagcacacagacagcagattggagctgacctggcaaggttacagcttgtctgccacctgtggcccttgcctaagggagctccatggaccagaacaccccaaaaaagaaatgcaaatagggagacagtaattggaaggggctcctccaagacctaggagtggactagaattgaaagcagttaaccaaacccaccttggtttggtttgccctgtagtcaaacccccaagggcatcaaagaagaaaaaagcaaaaacaaaaaatttcatccaaaggacagcaacttcaaagattgaaggaacatcagcctacacaaatgagacagaactagcacaaaaactctggcaaatcaaaaagccagagtgtcttctttcctccaaatgaccacactagttccccagcaagggttcttaactgggctggaatgactgaaatgacagaaatagaattcagaatatggataggaatgaagatcatcaagattcaggagaattcaaaacccaatccaaggaagctaataatcacaataaaacaatacaggagctgacagatgaaatagcctctataaaaaagaacccaactgatctgatacagctgaaaaacacactacaagaattgcacattctaactgcaagtattaacagcggaatagaccaagctgagtaaagaatcccagagcttgaagactagctctctgaaataacccattcagacaagaataaagaaaaaagaataaaaaagagtgaacaaaacctcagagaaatatgggattatgtaatgagatcaaatctatgactcatgggcatccctgaaagagacagggagaaagcaagcaacttggaaaacatattttaggataatgttcatgaaaatttcctgaagcttgttagagaggccaacattcaaatccaggaaatgcagagaaccctgagagatattactcaagaccatccccaagacacataatcgtcagattctccaaagtttacatgaaagaaaaaatgtcaaaggcagctagagagaaagggcaggttacctacaaagggaactccatcaggctaacagcagatctttcaacagaaaccctaaaagccagaagagactggtggcctatattcagcattcttttttttttttttttttttttgagacagagttttgctctgttgcccaggctgagtgcagtggcatgatctcagctcactgcaacctctacctcctgggttcaagtgattcttctgtctcagcctcccaagtagcagggattacaggcacccgccactatgaccagctaatttttgtatttttagtagagacagggttttgctgtgttggccaggctggtttcaaactcctgacctcaggtgatctgcctgcctcagcctcccaaagtgctgggattacaggtatgagccaccttacctggcctcatttcattcttaaagaagaaaatttccaactaagaatttcatatctggccaaactaagcttcatatgtgaaggagaaataagatgattttccgacaagcaaatgctgaggggatttttttttttccaccagatctgccttatgagcagtcctgagaggagtagcaaatatggatgggaaagaccatgactagccattacaaaaacacacttaactagacagactagtgacactataaatcaaccacactaacaagtctgcataataaccagctaacatgatgacaggatcaaatctgcacatatcaatactaaccttgaatgtaaatcagctaaatacctcaatcaaaaggcacagagtggcaagctggataaaaaagcaagacccaatagtatgctgtcttcaagagacccatctcacatgtaatgacatctataggctcaaaataaaaggatggagaaaaatctacaaagcaaacagaaaacagaaaaaaagcaggggttgcaatcataatttcagacaaaatggactttaacct

SEQ ID NO: 15286 - DNA, 10677 bp, Human
agaggcagagcatgattaattgtcaagattttcctgttcttggcttagactgagttagcaaagaccctgtggatgtagaaatcacattgaaaaaccttcctaaaagtatgccctctttataagaacggcacgatggactctgaggactcaggggaaagggtgcgaggtgggtgagggaaaagagactacgcactgggtacagcatacatgctcaggtgatgggtgcaccaaaatcttacaacgcattgggtacagcatacatgctcaggtgatgggtgcaccaaaatcttacaaatcaccactaaagaacttattcatgtaaccaaacaccacctgtcctccaaaacctattaaaataaaacacataggtcaggcgcgatggctcacacctgtaatcccagcactttgggaggccatggctggtggaccacaaggtcaggagtttgagaccagcctgaccaatatggtgaaaccccatctctactaaaaatacaaaaattagctggtcgtggtggtgcacgcacctgtaaacctagctactcaggagtctgaggcacgagaattacttgagcccatgaggtggaggttgcagtggactgagatcacgccactgcactccagcctgggcaacagagtgagactctgtctcaaaaagtaaaaaaaaaataaataaaaatgtaataagtaaataaaatgccctctttaaagacactcctacatctgggccagtacacagcccagcatgactgggcacttcccctaaacaagcaagcagactcctgaaatgcatcattatgtttcatttcttaataaattctttctacagccagttagcattctacttgttgccattatagactttcaaaaaacactataaactttcttatctgtcttcctgagtaagcaaagggaagacattattagaaaattcacactcaattaggaagagtggtttgaggtagaagttggtggttttttatttctttaaaaaaaaatattggccaggcacggtggttcatgcctgtagtaccagcagtatgggaggccagggtgagtggatcacttgagcccaggagttcaagaccagcttgggcaacatggcaaaaaccccatctctacaaaaaaataaattaaccaggtgtggtggcgtatgcctgtagtcccagctactcaggaggctgaggtgggaggatcgctaagcctgggaggcgaaggttgcagtaagccaatatcgcgccactgcactccagtctggctgacagagacagtgtcaaaaaaaaaaaatcttcgagaaaatccatttgaaacaaggaatgaaatttaaaatttgcatatataaacacgtatacatatacatatcatgtatatacataggattatgagaagtagtaatgttctaaaagtgagtatgcatatttttaaaaatttctgtaaagttgcacttgtaaggaaattcctaggtgttatttcctaagacgtaaaagcagtgtatacatccttgaagctaaacttttctgagatcttaaattctcccagtgtttgatatatgagtactcatgtctccagcaaattaacctgaacttaaagagcttcctgatagcttcttagttggggggtgggagtgcagagaataaaaggaaattcattgaagaataaaagataatttcttgagaaacctgctcatcgggaccctgttaacatccaaatatcccaaatatcatgccacactattcttcccagaattaattgtcaaggactgagaaggacaggagaacctaatgctatttcaggctctcttgacagaccaaggaacagtgaggcataaactggggtccccgtgggtcacaggcaagaggtggaacccaagattcaactcccttcttggaaccatctacctggggactccctctggttctgtggctgggaagagggatgcccatcagccttcccggaattccgggggcacccacaggcccttacctgcctggcagccaggcaccatgatgaacgtgagcagtccccacatcagcaggtatgaatccatcttcctgacccttgggaccagccggggcagtgaagcggaggtctttctctgcagaaggcccagttgccgtcagcctctttttggcatcgcgccggaggatgtgggatgggaagatcggtccgcctgggctgtcacccttgtgggtccatccagtctctatcggagtcaggagttgctctctttaagtattgggctggcgtgttcagccaggaaactgcctagcactctcttctctcatctcaaatataggaagtgtttttttttttttttttttttgatgacaatatagtttgcggtaatttttcaaaccaggttttttttttcaagttcaattgctggaggtgtgggctggggttgatgagaaggattgaacttcatttatgaatcctttcttcagctacgcccataaaaggagagggagattcccctgccgttgaaggtagggtgagcaagcacttcttggcagtggtctcacccagcacttcataagctgagtcctcccctcagggctgtaacgtcctcaggagtcagccgggaccacctgggatgaaggagcaaagtcctgacaagattctggtcaggcagcctccaatattcaaataatggagaaggatgcggcgaactgaaggatcctgagaattcataaataattccccaaggcttataacctgtactagccatcatcatttcaccacagtgccctgggctcctgaaagtgcattgtcattttataaggtgttttgcttccagatttctttctcttaaaggatcatgcaaaaagtgggctttggttttaaactttggattattttgtaaaattcagtcttgcttatttattgatcagagctctcttctgattattatgaaatggttgagtgtgttttgctccctggaaatttgtctaagacttaaagccattgcatagttagagcaaaacacaattttttaaatactagaaagcaagcaaagatattaacaaaaagaaaaccctccgggcaagccaaggaattcagggttccaaaacacatcacgttgactgggcctggtggctcatgcctgtaatccgagcactttggtagaccaaggtgggtggatcacctgaggtcaggagtttgagaccagcctggatgacatggtgaaaccaccgtctctactaaaaaaaaaaaaaaaaaaaaattagccaggcgcagtggcacacgcctgtaattccagcactttgggaggctgaggcaggcagatcacctgaggtcgggagtttgagaccagtctggccaacatggtaaaaccccatttctactaaaaatacaaaaattagccaggcgtagtggcgggcgcctgtaatcccagttactcaggaggctgagacaagagaatagctggaaccgaggaggtgcaggctgcagtgagctgagattgcgccactgcactccagcctgggcgacagagtgagacttccatctcaaaaaacttgtcaaaatatgacaagattctcttaaattccacagcaggtataacttcctctctaggaacgtttctcactctgcgggcaagtgctccagtagaaactcctagtactcccaccaaagtcacgctcctttcttcttgggcatgggagtagaatgcacttgctgcctctcctggaaaatagcttatgctttaagtagttaatgtggattgtcattataaaatatttaaatttatgttaatgtattttttttttttttttggagcgcaatggcacaatcttggctcactgcaacctctgcctcccaggttcaagtgattctcctgcgtcagcctcctgagtagctaggattacaggcacgcgtcaccacatccagctagtttttgtatttttagtagagacggagtttcaccatgttggtcaggctggtctcgaactcctgaccttaggcgattcacccacctcggcctcccaaagtgctgggattacaggtgtgagccaccacgcctggcaattacaagatttttttaaagccatatcacaaagcccccacaatttttctggtaaataagaggcccaactcttggttctgagatggaccatggttaaacaagtcattgaactggcttttctggttcaccttacggatgaacgctctgtcgtcgtttgctgatgctgaggtttccagttgatgctgcatggcacgatgcagggatgtgagaagaagttgggggtgcaaaagcagacccattttgtcacggattgcccaggatctcatactgaagctgtagcaaagcttttgcccttaatgagtttacaggtgaaatggaaagacacttgagtgtcccttcctccaggaggccttttccagtcctttctactccatcataacacctgccgtgctgcattgcaattcactgtttatatctctttctttcttctagttgctgttaatcttttttggattaaaaactcttttttgtttttaatttaagttccaggatacatgtgtagaacgtgcaggttggttacataggtataagtgcgccatggtggtctgctgcacctactcacctgtcttctaagttccctcccctcacaccccaccccccaccctgcagcaggccctggcgtgtgatgttcccctccctatgtctatgtgctgtcattgttcaactcccacttatgagtgagaacatgcggcatttggttttctgttcctgtgttagtttgctgaggataatggcttccagcttcatccatgtccctgccaaggacatgatctcattccttttcatggctgcatagtattccatggtgtatatgtatcacattttctttatctagtctcattgatgggcatttcagttggttccattttgctattgtaaatagtgctgcaataaacatacgggtgcatgtgactttatagtagaatgatttctattcctttgggtatatacccagtaataggattgctgggtcaaatggtatttctgattttagatgcttgaggaatcgccatactgtcttccacaatggtaaaaactcttttcttaatttgatagaacctttggtttccctccttggaaaaaatgcacatcagcacatactctggataaatccgtaggaagtttcaggagcattatgggcagtttgttttgttttgctctgttttgtttgagatggggtttctggagtgcagtgttgccatctcaactcactgcagcctctacctccttgactcaagtgatcctcccacttcagcctctcaagtaactgggaccacaggcatgcaccaccaggcctggctaattttttttgtaatttttgtagagatggggttttgtcatgttgcccaggctggtctcagactcctggactcaagcgatcctcccacctcagccctgcagagtactgggattacaagtgtgagccaccacacccagcggttgtgggcactctgaacttcaaaggtccaaggatctcaggttaaggtgtcaaactgtgggcctctagaggatagccctatgtccagtttatctgtgaacttacgtcacctaacaaagtgcataacacatatgggtgtccaaccactatgtatgaagccacatgtgcatacaaatataactagcatatactaaagcagtttcagacaaattctttgtgaggcaaattcaaagttttgtttcaaacctgctgcaaggaggtaatttccaataagtccggttcaaagatttctttcctagtagagggtttttttttttttttttttttttgaggaaagttatctagataacattggtagattaagttcaagaaaggaacaagttcaagaaaggaacatttggttaaaagtaactaggttcatccagggacagccggtcaacagtgcaagctgagtctcacttcatcaggaaattgctcaattctattatcagaaatgtttggtacttcctagaagaaactgctcagaacagcggacaacaaatttctgacctagactgccttcccttaggtttaagaccactttctttctagacgtacagtggggtgaatactaatgattatggtaagaagagcaattgaaatgtaggagggaaaagttgttgagctgatgtgatcaggaaaggcccacgtattgtccttgaaggatggatacggccttggtaggtggttcctgaggaagcagagtgtggtccatagttaaccagaagtagagaggggtagaagctaagggcagaaatatcagctggattcagagtcaggtggacctcgaaaaacagaataagatctatggacttcagccactgaagctgtctaacccaggcgggacatagccaagtgatgtgatgatgaggccgagctggtgtggtgtgcagggaagattgaggcatagagatgctgaaatactcttcaggaaggaaatcataaggactggaggaaggtgaaataaattggaatggcaaggaggcttgatgccagaatatcaggcaaagggaaaatgcagttggtaatgcctggatgtggggcaagaagcggggaacagaatttgtgagctttggcgaggagaaaattcactgatttgagctcatcaaatggattggcgaaattcaagtgtgtgaggctgaggttaggggatggcagagaggcagtagcatttgtgaacaggagttagttgttcacttgggttgttctcttgttcctacaatgttggacagtccttgaagacagcatttattatccagacaactctaaagcttgacttgccacccccctagccccaaccacaagaacgagttttcagcttgcaacaaaaatcatttctgtttattagagtctagattggggagcaggggcaaagagtagaggaaaaaaggggagaggtggtgaggaatcaatcacctttcattttcctttacttacccttggggcttgttaacggtcacttccacaatgcccatagaaccggccgagcacgatggctcacgcctgttatcccagcactttgggaggccgaggcaggcagatcacctgaggtcaggagtttgagaccagcctggccaacatggtgaaaccctgtctctactaaaaatacaaaaatttgccgggcttggtggcacatgcctgtaattccagctacttgggaggctaaggcaggagacttgcttgaacctaggaggtggagattgcagtgagccaagatcacaccgctgcacgccagcctgggggacaagggcaaaagtctgtctcaaaaaaaaaaaatgcctgtagaaccaagtggcacagatgcccgtatgaaatgaataaccatgaataattgaatgcagaaaaaaaaaggaaggaggaaggatgggataaggaagaaggtaggagagaagtgaacgcagagggaaatggtgagccccacttggtgatgggcaccatagcttgctcactttgactgttgaggacgtgtcactctggagactacaggctgccaagaggacctctgtgctgaatcccgtaaggactgttttcagggattaaaacactggtgctctgaggctcacttggtgtggtggtataacatgcaaatgagaggtgcccagggcaagaaaacttgctctatagaataaaagaaatgctggccgattagggagaagtcatgctgaggagagtggcagagaaaggacccagagtgggaagagcagggcagctctggagaaataataaagagcttggaagaaaattttaaaatcatttgaagataagagtttgcaatatgctttgcaatgttaactcttctccccaacagcccacaaaaatcttgagtaaaattcccattttgtcttcatgcattttggagttgaacgagctttgaggacatttgaaacatggagcatgacttcctctgtgagccaggactagtgggaagcctgtttagtccacgaataatggggtttctcccattttcctcctgttgctgtcctcttgactggttcattgtttaccagcatatctgccaggggagcacaaggaaaggaaaaggtgaagctgagcgtggtggcgcatgcctatagtcccagctactcaggaggccaagacgttgaggttcgcttgaccccaggaggtcaaggctgcaatgagctatgattgcaccactgcactccagccagggccacagagcaagacctcgcctctaaaaaaaaaaaaaaaaaaaaagaaaaaggagggagtgggggaaaggaaaagctgaaacccagatcaaagaatttcacctctgtcacataatccatcaataaacgttgactgcaattaatcaaagaattatgctagaacctgtgaggagagccaagaagctaaaacatagccctgcactgaggacgctcacagtctcctcaaagaggaaaagaaatgggccctcaaaaggggaagtgaccgctcacgtctgcagggatccgttcagcaatcaggcctgccctgcactatacgctggcaccacatgaaagcagcctcactctctcatcttagactttcttttctctagaggagtgatgtgctgagctgtggtctcagagccaaaatccgaacaggagataaccctttgctttctgggagcgtggcagtggaaggaccgaagcggttgcagagagcctgctgtttatgtactggatgttcttgttaggcttagtaggaggtcattttcccaggcctgtggtgtcccccaggattttctctcctttatcttgtacacatggacctgaaatgtccacatgaggtcccacaaattacattttacttagctcatgcactcttgggtgcaccctttagtataattcaattcagtgcatatcaacgtaggatccaggaatggggagctctgcccaggctctgggagaagcaaaaacaaacaaagaagggtttttgctccccaagagccagtgatccacctgtgggaatttggattggaagcagaaagcccccagttaattgcaagcacatctgtcaaagtgataatcccatcaaaagcaaatgaaccattgcaggatagcctggagcacgagggccttccatctttgcttgttaagtggatggcggttggatagatgttgctgagatcggtgcctcccatggccgagaggcaggcaagacacttcagattctgccccagttggcactatgcaaacagggttatttctctcaaactggtattgaaagaatgctgctgctaattctacgaaatctacaggtgcatcctgttattgcggcactgagttgaatttctgcagtttgtaatttccaccagattctactagacaagggcacaggggtcccgtggaaaaccaaaatccactatgaatcaaataacccaactctactcaaatgtctagttcccaagccactgttgacttgtgggttgtgccacccagaaaacactgggagagaacagttggtttgtatgaatcatgaactgagtcctccgtccctaacaattgaaaactgactttgttaacattttgtggcttgtggtgaccagtgctgttgggtcccacagatgttgtcagagggtcctctttccatttgagtggaggacgtgtttcctggggggatagcagcaaagctccctggccacttctgtcatgattttagttcagggatggataatagagtttatctctcaagccagcactgatgagttaccaatggcggcccaggacaaggattccaaaccccctttggagctcagtggtctgtggtctttgcagggaggtgaaggcatgcttgtgtcacattttgtctagacgtctgtacagcttttcagctggcttccctcactcaaatgtgtctctccactccaccattcttacccattgcttccagtttaatctttttttttttttgactgagtcttgctctgtcgcccactggaatgcagtggtgcaatcttggctcactgcaacctctgcctcccaggttcatgtgattctcctgcttcagcctcccaagtagctgagattacaggcacccaccaccatgcccggctaattttttttttcagtagagatggggcttcaccacgttggccaggctgatctcaaactcctgacctcaggtgatctgcccacttcgcctcccaaagtgctgggatcacaggcgtgagccaccgtgcccagccccaatttaatcttctggaagaatacttttcccttatctacaacgtaacattttaggagtgtccataatgtctttgaaattaagcccacatttcttagcccggtattcaaaatccttcataacctgccctggcctatctcttcagtattaattcttcgctatccttcatgctgtctttgccacaaaaatgttcccaagcagaccagagaacaaaataaaaatcatcaactgctcactgttcctgcaacaccgcctcctcttttcttggtttcctctgttaaatccataagcccaaagctcactcactccttaacacccagctccagtgctaccctgctgaaggaagtctcaccgcatccctccctctggaagtgctccccctcctctgggctgttcccttatctgcatcttaggaatattgaaaggaatcactagcactgactaggcccttactacatggcaagcactgtgctgagaatgttgcatgtctctgccgctgacttctcacagc

SEQ ID NO: 15287 - DNA, 8951 bp, Human
gattcaactgactgctccttttgcctggacactgtagggtcactgactggcctaatttcaatattgtgtctcaaggaattgagaggcctgaggagagagactgggaactgccagtcagtggagctgttagtacacacccaacttttaccaattaagttcactgtcttatatgagtgctattcatggtaacccaaaacattgatcacaggtcactataacagatgtaacaatgaaaaggtttggggctgggcatggtggctcatgcctgtaatcccagcactttgggaggccgaggcaggcggatcacttgaggtcaggcgttcgagaccagcctggccaatatggtgaaaccccgtctccactaaaaatacaaaaattaactgggtgtggtagtacatgcctgtaatcccagctactccggaggctgaggcaggagaatcacttgagcccagatggcagaggttacagtgagaccgagaacacgccagtgcactgcatcctgggtgacagagtgagattccacctcaaaaaaaaaaaaaaaaaaaagtgtgaaatattgtgaattacccaaacgtgacacaagagacacaaagtgagcacatgctgttggaaaaatggctggcatttacagacttgctcgatgaatccttgctataaaccttcaccttgcaaaaaaaaaaggcagtatttgcaaaacacaataaaatgagttatctcttattccctccatcctcacccagctacaggaggaccacgactgtttactgctgtattccaagcagaaaggttggcatacaggagacctcaaaaatacgctactttgatcttgaggagagtgaaaaatcttactcattttatgtacaaagcacagatgtgcatacattatataaaaagaaatagtttacgtatggcattaagatttcatgaagattagaaaaacaatgtttacaaaaggtccttacaaaggtagtaattcaagaaaagatcaataaacgatgtgttaaagtaagatttttggaagctcaaattcaggcaatacaaaagccagcaatatatcttgctactcgaatgcctctatttcacctcaaactcacagataaaactgaacccaatatgtccttgtccattaaaaagcaaatcaccaagaaagtaacaaaagattcccttcaatgtctcttttattgacagtggtcccaaaactcctggtcaatgaattcaaaacccaaatcttgcaggtaggacttaacctcatctgctgccaaatagctggctatgtgaccttgggcagaccacttcacttttctggacctcagtctccccagtcagttggacagtctaagccaggctccagagctgagaccctacgtctggctcaagaacttggtgcagaaacagaacgaagattattaagtttgtgaacgtctatgggaaccgacaagtgaaagacaaaagctgaaatccctaccaaaacggcttgcccaagctctatccttttccctcttccctcgatggatcaaaggcggaaaagcggtgtttactagcaactctgtttcgggtcgtgagaatcttcatacacctgtctataggcgcgccagagcggtgaagggcccgagcggtgcagggctgggccgcaagcctcacagtcgcacgttccaccaaccaccagccggggcccggaagcgcgcccggaaatcgaggccctactaagttttagactgcgacctcggcgcccccacggtcaggcccgcacccgtactcagatcctcccgacctacaaaaggccccgccacgcggcccacgcaccccggcaaactcgcaggccccacgatggcggggcggcggcgcgaacacacaaaggaggcgtcgtcagcggggaacaaaaaccctgcccgggtcttccccctaacagcacatcctgcccgactttccaagtgaccttgggggcgttcctgcccctcccagagtctcagtttcccttcctaggctaggaactaagccccatggccgcggccccccagggtgagccgagacccagacgcagacctcctaacttctgttgcccgcgccaagccgggctcggtgcgcccgcgcggacggtagtgcgagcgaccagagctggctcgaggtcccgggctgcaaagcctcggctgggtcaagccgcgcagcgcggctcccccaagaggcgcgggccgaggcctctgtaggccgcgaagctgcctaaacctcgcatctgcaaggccctgacttaccgctgctttcccgcaaagctcggcctaacctggagctagttaggtccgcaggcgccaccgccggcgcactccggagaagaagctccttcttcagccgcccaggagagctcctcgagaaagatgccgccgcctcaacagcaacccacttccgcttcggaggcctcggctccgccccccatcatgtccccattggccgcccgcctactctacttccgcggtcggccgggtaaggacaaattttttaatcctattggataagaaaaccatctgttaccactttaaaacgcgcctctttccgcccccgcccacaatcgagcgcactaactcgcaccttccggcaagagacggcgcgggcgcgccccgcccgcaaggcttttcgggagtcacggtctgagggcgacccgggcgacccggtcgcccgtgcccggctgccactgaccgctccaacgccgccagggacgacccgccagctgcctccggagccgagcaggccccgaaccttcccattcctagatttccagccgcacaacagccgcggtgcccctggctcgacgcagctggccggaggcgcggagctggtcgttcgtcccgcccgccgttccgcgcccctctcccggctcttgtttcctcgcctcttaacgaggcctttgtgaggaaggttgctgggccttgggactctgacgatcggctggaaaccaggcctggccctgtttcagcatccccgcgtgccaagccctgggccggcgtgcgggtccctgcccctgcgaggaagctgggacttttgcaggcctgggtggagacgtgtacataacagaggaagagtgtggaggattggaggactcagggcagcacggcagaggtgcatgcaggtccccggtcggactggagaatgggcggtgggtttcttgagctccagtccctgagctcgactttgacgtgggtttagcaaccaggaaaaaagcccaccttgtccctgctgcctgagaatacccagaccttagtccatggccagcatctctggtccctcggcaccctcaggcaacgtgaaggtcaccccaaatgccttgggttacattgtttccttacagtgagtttgtttgttttagtggcgcgatctcggctcactgcaagctctaacctcctgggttcacgtgattctcctgcctcagcctcccgaatagctgggattacaggcgcctgccaccacgcccggctaattttctttgtatttttagtagagatggagttccatcatgttggccaggctggtctcgagctcctgacctcaggtgatccaccctccttggcctccaaaagtgctgggattactggtgtgagccacctcgcccggccaccttacagtgagtttctaacctcgaaaatggagtcaaataacggaatgacaaggcagatagaaaccagagcattaacgtttttgtgttgcatttacaaacaatatgtgtttgctatttttcgtaattgtaaggaaatctggcatggtagagtatctgatagataaatgtaattctcatgtaaaatatctaagtatttgtgttttttgtttgtttgtttgtttgttttgagacggagtctcgctctgtctcccaggctggagtgcagtggcgcgatctcggctcactgcaagctccgcatcccgggttcacgccattctcctgcctcagcctcccaagtagctgggactacaggcgcccgccaccacgcctggctaattttttttttttgtattttttagtagagacggggtttcaccgtgttagccaggatggtctcgatctcctgacctcgtgatccacccgcctcggcctcccaaagtgctgggattacaggcgtgggccaccgcacccagtctttttttttttttttttttttgagacgaggtgtcactctgtcagccaggctggagtgcagtggcacaatcatgactcactcactgcagcctcgacctccccaggtttagatgatcaacccaccttggcctcctgagtagctgggaccacaggtgtgtgccaccatgcctggctaatttttttgtattttttttttgtagacactggctttcgccatgttgcccagtcttgtcttgaagccccgggctcaagttatctgctcacctcgacctcccaaagtgttgagattacaggcatgagccatcacaccctgccctaagtatttgatttttgatagcgactgtaagttgaaaggtataacattttccgaagtttgtgattataattggagcaaagagaacttaaaagtttaaaagaaatgaagacatttaatatatctatgagaattatttaaatattaatacttgataaggcagacaactgaaatgctaaaaaataaaattagattctacgtgtataaatgcagttgaaaatgtttaagagaatttcagttcataaatggggccgtacatgattaatcaaaatggtggttaaaaatgatcagatttagggcgggcatggtggctctcacctgtaatcttaacactttcggaggctgaggtgggaggattgcttgagctgaggagtttatagatgagcctgggtaacgtggtaaaaccccctctccacacacacacacacaaataataattagccgggtgtggtggcatgtccctgtggtcccagctactcaggaggctgaggcagcaggattacttgagcccaggaggtcatggctgcagtaagctgtgattgcacgtcagcttgattgacagaatgagaccctctctctctcaaaaaaaaaaaatcagatttagaaaaagtaatattagtaatttgtattttacagcctaaggaaaagttagggttttctgtttgtaactgtaatatattgaagatgtgatgttgaaaaagtctctataaataccagtttcatgctcaaagactgccttcagccagggcaacatagtgagacctcatctctactaaaaataaaaaattagctgggtatggtggtaagtgcatgcagtcccagctagtagggaggatgaggcaagaggatcacttgagcccgggagtttaaggctgtatgagctatcatcacgtcactgcactccagcctgggtgacaaagcgagaccctgcctcaaaaacaaaaacaaaagctgctttcaagtcttctccaagcctcacttgcactgaacttgttccttcacaaatagcgcttcccttgggccctgaacgcctgcagcttagagaaaagaccggcaccttggtgctcccatagtcccacaagtcgaaaccagctgaatgcaggttcctgggcctcacaccagctactaaatctgtttcttcactatttccaaagaaagcccctgcccaagtgggtctcagatgctatcaacaaggatcttctgactagcctgtactcaggcaaaatgtccactccccaggcagtccagccaggaaaggttcagagagggattgtcagcactagctgggccatatctcactctggctggccccctttgggggagtagcttgattctctgtaaagagcctatgcagggagggaaggcaggggcccctagtgtgaaggccctgggctcttaagggtgttgccccttaagctgcctgtgcagggaggggaggcaggggccctcagtgtgaaggccctgggctcttaagggtgtgccccttagctgcctgtgcagggaggggaggcaggggcccccagtgtgaaggccctgggctcttaagggtgtgccccttagctgcctgtgcagggaggggaggcaggggcccccagtgtgaaggccctgggctcttaagggtgtgccccttagctgttgctctggaacaaaccaccccaaagcttgatactttgaacgacagacatttattgttgctcatgaatctataagacagcagggttgggggaggttcttgtccggctgcgctctcattttgtgctctgctagtctaggatggcctctgagatggtgtcctccacatggtgtctgatcccagcaggccaccctagtcatgctcacatggggcctggcgaaggttccaagagaacaagtgggagctccaaggccacctgaggcccagactcagaactggcacgtggtcacttctgttgcaccctattagccaaagaaagtcactaggccagaccagatgcaagggctgggggaatagactccacctctcgatgggaggtgtaaagtcacaaggcaaggggcagggatacacagacattttgccatcactctatcacacaatgcctactcccaggccacaactttagggaatggtccgaggcctgctcccacctaggtttgtatgaggagaggccccacgtgctctcaagctagctctaagcggctgctcagtccaggagggggcaggggaagaccttgttacctgccaaccaacagtgttgccaatagtaccctcaatttgttagctgccacatctcccctctgctccagaggccaaccttctaggtgaagggtaattcccctgccttgccacagtgcttgcttcaggcacccatgcagaccttccctcactgcaggaactggctcagcccaagtatgttcaattcaggccaatgagactggggcaactgttctttgttcctcaggctggaactgctaccagagtggagactgagctcctggatcgggtacatcctgaagtctgctgcctttggattggcattatgagagctaataaatccccctttgaaacccccagagctcagaggggctttctaggccaggcatcatcaatgtattccatcaatatcaaattaaatgggtttggatcacacaacacgggatatgagcaatgtttatttctttttttttgagatggagtttgactcttgtcaccaggctggagtggtgcgatctcagctcactgcaacctccgtctcctgggttcaagcgactccattctcttgcctcagcttcccgagtaactgggattacaggcgccggccactacgcccagctaatttttgtatttttagtagcgacggggtttcaccatgttggccaggctggtcttaaactcctgacctcaggtgatccacctgcctcagcctcccaaagtgctgggattacaggtttgagcccccttgcctggccaatgtttatttctttaaatgaaatttaatctgctcccagctgcaattctacagagatgtggaaattcttctccttacctacctgggtggtaaaatcctggggttctcacaaactcagaatattggagtagggctcttgtcctttagcctgttcttgtcactgctgagatgcctgccttcctggtctgagtgtaccctgggactcagcctcctcatctgaggcaccatctcctctgcaggcccaaggaggatattgggagttggggaaggaaatatatctcccctggacatctagcttatctgtcagtttccactccccaaccccttactgctctgctcaccaccccacggacttgacgcttttctctctttcctgggaagaaggtggcttaatgtactttcttcttgaggctgtcaccagcaggcgttcactcagcaagcctgtcctcaaggtggagccttctgtagcccacggagtcccgggacactgcagaaccaatccatcttggtccctgccttgggtgaagtcctgcctccattggccctgatcttgttggatctgggctgcttctgatgctagagaaaggggaggagggggtgctcccaggcgcagctctgggttttggccttctaggccggtcacatcgcctctttgagcacctgtggcttcatcagcagaacaggggcaggccagttcctacgtccctggaccgtagtgaggatggtggaggcgcgtgaagggccagtgcaacgttggcgctcaagaatcctggccacttccccagccaaacgtacactcacagtcgccactcagtctcgggggttccctaggtgaagccacctggatgccggcaaagggtgggtgttccaaatttccacatctgaaggggttctgggagtttcgaaggggtgcgcaccaggaatgccttatgctaggctgtagggaagtgctaggacctgggccggggtggccagatttcgcttataaaaatgcaggatgcccagttcagttgaattcccgataaggagaggatacatttttagcctaagtttgtccccacgcagtaactgggcgtcctgccttttatccggcaatgcttttctgggcagacgggggctaggaagggagaggggtgcggtcggggtgcggaggcaggggggccggggccgaggggggcccggccaaggaagaggaggcgcgcaccgcgggccgcactctttattggggcggcgggtgtagggggtggcccgcaagcgggtggggcgcgctcggcccggctcaggcggcctccaggcggcgcgcgggcccgggtcctgagcctccctgctgcagcgcctgcagcctgcgctcgcggctccgctccagctccagccagtgctgcgcctctagctgcgcctgcaggccggggaacgcgtcggcgcgggcagggacgcccccaccgcctcccgcgcccgccgctgcgtatctcccggccgcggaccggacccgatctccccgccatccccgccccgggacgccggtccctgcgcgccgcgcccgccatccccacccggccccggctttcagtcgcccggg

SEQ ID NO: 15288 - DNA, 15478 bp, Human
gctggtctagaactcctggcctcaagttatctgcccgcctcagcctcccaaagcgctgagattacaggcatgagtcactgcacctagccaatcattttattctactgcatgaaaggatcatctgattttttttctttcatcttttatgttctgaaaaacatcctggtcaggtatggaatcgcagttttgttagccccatatcaggaattgttgaatatgctttttttacttttacataacaatttataattaattgaaagtttgaaattatttcttcttttaatatatgtggtagatcaatggtaaaaccttctggtccagaattttccatacaaaagtatgttttagtactacttcaattatatttagttactgggtagttcagtattttgtttctttctgagttcatttttttaagttagctgtttaattaaattgtctattttatataaattttctaatctattatcataaaattgttcttaatatcttcctgttatctttataatttctgctccctttatatgttcctttttcattcctgatggtgaccttcaatctaatcagatatatgacactttgatttatttattttctccaaagtgtgctttgtacttctttcctttctattttcatctttattattttttaccttagcatttactttcctttgccttctctaaaattataagatgagaactttacttaatattgtaccttttacttttctgacataagtatttaatggtattcaatttttctagaagtaactttagctactttccacacgtttgataaataacttaagatgccattttcattaaaataccccggtgttttcggtatctgtctgtcatcataactcttatgatttctagtctgttttaaaattgcattcccaagaagagaaagcctatttctccacacacagtaataaagtgagaaattttcaaaatacaaagtagtgttttagtcgtgagcaaaacaaactaatgactaacagagagtttagagagctgaaccaagacttgaactctgtagatctaaattctgtaaaggaatgtgggttttgtcttaaatgagctttgtgaacgctgaatataaggggcttcccctttaacttgcctctcattcttctccttcccgccaccatatgaagaaggacatgtttgctttttccttccaccacgattgtaagttttctaaggcctccccagtcctgcagaactgtgagtcggttaagtcttttataatttctctttcctttataaattatccagtctcagctctttcttcatggaagcatgagaacgggctaatacaagacccaattaatacaaattaattaagcatttatataatctattttccctaattctgaccaactctcctcttattcagtggtgccttcagttgttaaaaaaaaaaaaatccaattgatcctgctagagcatcttggcccacccagattatcagggctcacccctggaatgcagttttctaagaggagaaggaagaataggaggataaagggacttggaggaggtattgctgggaatgtgactcttggattccagctgagctccaggcacagcttcaggtagggctacctcctccatcaggacagcaggtcccaggattctccagggctcatagtgttgccttagaggagattttatatgaaattattgaccatggttactgagagacaaagtcaccacactcaacagcttgaaaatagttatctattaataattttattactacctggtcctcaaatgccatgccatttactgctatataatccaagtggcttcagagaacaaaagcaacagttttatatgatacctaaagcatactccttttgtttttttaggatattttttaaaatttagttttgtagtctaaaatttgagtggcagctattcactcaaattttgagtgaatagctgaaataatttgattgctgaaataatcaagccagttgtggtctcatctaggagactataatccgtgtggacagccacctagaagcaaacttctggccatggtagcacagactgtgtcatcattccaggttctgtggccaagccccccaaacaggaatcacgtagtgaagttcaaagaaacttccaaaaggtgcagcaaaagaaagaaaagaaaaacataagagaaaacatcaagataatagagacccaatgcagaagatctaacttccagtcaatagaaatttcagaaatagagaaagaaaaaaatagatgctatgaaatcaattttaaaaaatcctaggtaattacctggatctaaaagacacaaggattccagatgagaagcccaattgactgccagtgcatgttttaaaaatgactcattaaatgtgaaattttgaagcaacatgtaaagaaacaattccaaatcttctgaggaagcttctttaaaaataaaaactggcagtgttcaatacctaagtataatggaacagaaatcttcaaagattagacacaaaaaggatttcaatccaaaattcaaatgttacagtagaatagagccactctccgatatgaaaggactcaaaaacatgtttcagctgtcctttcttaagtaatacaggaaaatcaggagataaaccaagaaggaagaaaatacaagaaccaacaaaaagtggcttcaacccatattaaagaaaaaacaaatattccaggttgacagttatgcaggaggtcaaggagcaaccagtctggatttatctagggggaagctgtccttcagtagggaagagtccaggaaaaatgagtcaatcaaaatatttaatatcattttaaatacatttttaacaattcagagcaatttaaggaagaaatataaaataaggcaagagaaaaggagaaagaaagtgatagagaaaaggaaatatagtcactaactggcctgtcagtgaataatatttagaagccataataattaaaaaactgtattgatcctcaactttacaatgaacctatagactaagcatgataatagaatacaatatttgtattttaagctagactactatagctgaacaatactgaaataccaaaaagaaaaaacttctcagtggcttacagtaacaaagactgatttctcattcacgtatgtcttttgtgaattcattgcaattcttttacagattgtctctattcagaatctaatcaaaggagctgggtctatctgatacatgctattctcacggcagaggagacagagagcactttcccaaccccttgaatcagagctggcctgtgactttctgtggccaagagaaggtggtggatatgatgtgtgccagtagaagcccaagcccttgcaaacttctgccctctctccaaatctcaccaccatggaaacatgtggagactaaagtgtggaattaggagaagccacatggagaagagctttaacacctggaggccatccaggaccagctgatcacaagtgcatgagggggttgggctgagatcagctactgaggccagactggtacagcagaccttccagctaacactaagacctgtgagcaaaaataaatgcttattgataaatgctgctgtgatttgttggttatttgtaatgcggtattaatatggtgatagatatctgatacttgtgatagcaagaattaaagatattctaaaattaataaatcaaaaccagaaatagatatgttatttagctgtatggaactaataatcaaaataactaaatgtaaaacaaaaacgaaaaaattaggagtatttcctactgggaagcagaactgaatatgagaaaaactattgctgtttttctctgtgggcacgtctgaataattttttttctgacttttcaaggtctagacttttatttattttagactgtttttcaaaatatctttaatttgtataacaactttacaattaaaacccaagacaaacggagtgacatcatttacgtggtggattagattattctggccttcataactccacagaaacaccaattttgatcgccttccatagacataaatatttctttgagaatccaggagtccagtggagagattccagcatcacactgaaaaaaaaatttgagaatagtgaataattttgttaatataaccatctaataccttttaaaaattcagagatttggagggcttcaagcgatttggctgactagtggcagctggtactcacctctcccatgaagaagaaccaaaatagctagtatataatcacacttcaaatagatcatctaagacagaacattggaattcaaatagagaagtgacaagaaacctttaaagcaggaaagagagagaagtgcggtaacctgctcagtcaggatggctgggagcctgaagagaattctcaacccaaaaaaagggtaatggagagatccccagggattcacatcccttctgcagactcctgcaatcctagccatgggagaacctctcaatgccctcaggccctgagactaacgtagggagctgcctggagaccatgaaacagcaccactccagagatgaatctcacactgtatcccacacacccccaagtcataagcagctaagcaaggcaccatagtgagagtctagtcccccctagactacctcctaccctcaggcccaaccacccctgcatctccacctccctggagtcccattgacatgcttcatctagagccatgactgcagttgcctgcagccaccatagctgaaacacaagccattggcaatgacacactgccccagcagcagcactgccatgcatttttacatgccccaaagtcagactcccctgcctgcagtgaccaccactgctggctgcctccactgaagcatgggccactggccgtgactccactgcctccagtactggaattgccatgcattcaaaagtgtcttgaggaaagaatctctcacccacaactaccatctggggcaaaagtgcacacttttgagccagctacctacagttgttgccacagaaagcagcccagccctccccagtagcagggctatagcacattccaccagggacctgagaatcacctcgcccctgtgcaccacagctagcatgtacatggactaccagggagcctgaggacatgtccttctcacctagctccaccctgtcccccgtgtggctaagcatgccttccaggaacctggaggtcacccagccctatgtaccactgttgcctcctgaatactcctcccaggggcctgagaatggggcagccaaacctgccattaccaccacagctgacacatacctgcacacaccaactacaggcattggaactgggccaccagggccatcacagccaccaccaagagtagaccagttgggaaccagagggtggttctgccactgctactggcattgcccatgccacactggttacctagagccccaacgatctgcccaacctcctggcctactgctgccactattagcaccggagaaagttgcctggagacccaaaaattggcccccctgtacctactaccatgggtgccatcatatgctaccctggggcccaaggacaggtatgctcagccccccactgccaccactagaaaccaagaactggctcacctggcatccctttacctgcaaaacttctccacagattacactaacacccttagccactgaggaaatcacagacaccaatgacactgttcacagcttaagaatcacaaggagacaacatttctgtatgtacccagaatcaaagccaaaatctctacccaaccaatatcatacatcttcagaaaaaaagttgtttcctaccaaagcaaattcaaaaatttaggagaagcaactgttagatcagatgaacagatatcaatgtaaggacataagaaataagaaatagcaatgatatattatacctccaaaaaaatgataattctccagcagcagattccattggggaaaaattatgaaatattataaaataaaacaaaataatgatattaaagaagctcagtgaagccagtgtggttgcacattcctgtagtcccagctatgccagaggttgagaagcagggattacttgagcccaagaggtcaagtctaccttgggcaacatagtgagacacggtatctaataataataataaaagttcagtgagatacgagagaacacagataaacaacacaaagaaatcaaaaaagaaattcagaatataaatgtgaaatttaccaaagaaattggtataataatatagaacaaaaaagaaattctacaactaaagaattcattgaatgaaagaaagtaaatattgttgaaagttttgacaatagactaggccaagtagaataaagaatttcaggaatttaatgtaggtcttttgaaataacccagtcagataaacatttttttaagaattttttttaaaaagagaacaaaacctatgtggcatataggaaacataaagcaaccaaatattcaggttttcaatgtctcagaaggtgaagaggaaacaaaagtggtagaaaacctatttaacagaacaataaccgaaaatgtctggaatgtagcaaaagatgcagacatccagttacaggaaactcagaaataaatagatacaatttcaaaagatcttcttcacaatgaattatcattaaattatcaaaggacaaagataaagagagaattctaaaaacagcaagagaaaaggatctagtcacttataaggcaatccccatgaaagtaacagtggattgctcagcagaaaccttacaggcaagaagacagaggatgatatattcaaagtgctggggaaaagaaacaaggatactataccccctaaagttatcctttataaatgaaggagaaataaagtctttctcagacaatcaaaaactgagggacttcatcatcactagcccagtcctacaagaaatattaaagggagtcatgcctggaagaaaaaaaaatggtatccatgacgatgacaacacacgggagtataaaacccactggtagagcaaacacagaagagaaagaactgaaatgttaccactatagaaaatcaccaaattacaatgataaacaataagagacaaagataggaccaaagatacacaaaataaccaaaaaccaattaataaaatgacactaataagccctcacatctcaataatgaccttgaatgtaaatggattaaactttccacttaaaatacatagactggctgaatggataaaaagcatgacacaactatatgcatccaaaaagaaacttatctaatctgtaaagacacatatagactgaaattataaaagcatagaaaaagatataacaattataaatccaggcacacccaatactacagcacctagatattcaagacaattattattagatctaagggagagagagaatccaatataataataattagaaacttgaatgatccactctcagtattagagagatcatctagacagaaaattaagaaagaaactttaaactgcacatttaacaaaatggacctaacagatatttgcagaatatttcatccaacaaccacagaatgtacattcttctcatcagcacatgaaaacttctccaggacagaacatacgttaggatgccaaacaagtctaaaaaaagttttaaatattgaaatcatatcaagtatcttcttggaataaaaccagaaactgatcacaatgggataaaactataaatcaataatgaggaattttggaaaccgtacaaatacatggaaatagaacaacatgctcatgaatgaccgttaggtcatgaaaaaaaataaaagaaggaaataaaaaaatttcttaaaacaaatgactattgaagctatggattacataaaaacagtgctaagtgagaattttacagcattaaatgcttacatcaaaaaagcagaaagattttaaataaacaatgtcacccaagaaactaggaaagcaagagcaaaccaaacccaaaattggagaagaaaagaaataatgaagaccagagcaaaactaaacaaattagatactaaaaaaaaaaaaaaaacaacaacaacaacaacaaaaccacacacacaaagaaataatgaacaaaaagtgaaataatgaacaaaaagttggtttgttaggagataaataaaactgctagctaaaataaccaaggcggggggaagaaaagacacaaatgaacaaaaacaaagaaaaaagaaaaaaatcacaattgaaaccacagaaatacaaaagatcttactataataaacaatgatatactaaaaaactggaaaatgtagaggaaacagataaattcctgaatacatacaacctaccacaattgaatcaggaagaaatagaacacttgtacggtgtaatgagattggccagtaatgaaaagtctcccaacaaagaaaagtccaggaacagatgccttcattgctcaattctgccgaactttcaaagaaaaactaacataaattcttcctcaaagtattcaaaaaaattgaagagaagggaattcttcctaaatcattcaatgaggtaagcattactctgacaccaacatcagacaaggacacacacacacaaaaagaaaactatagaccaatttccctgatgaacatacatacaaaaatcttcagaaaattactatcaaactgaaatcaacaaaacatccaaagattatataccatgattaagggggatttatcccagggacacaaggatggtttaatacacagaaacctataaacataaatcaccacatcaataccataaaggaaaaaacatacaattattttgatagatgaagaaaaagcatttgataaaattcaacatctcttcatgatacaaacactcaacaaactaagcacagaagaaacatacttcaatgtgataaagtccatgtatgggaaacacacagtcaacatcattctaaatgaggaaaacctgaaaacctttcctctaagaactgaaacaagacaaggatgcccacgttcatcactcctgttcaataaggtactagaagttctagtcagaacattcagacaagagaaaaccatccaaattggaaaagaagaggtcagatttttactctttgcagatgacatgatcttgtatctagaaaagcagaaagacaccaccaaaaaactcttagattttataaataaattcagtagttacaagatacaacatcaaaataaacatcaatagcatttctatacaccaataatgcattagctaaggaagaaattataaaggcaatcccatttacaacacctacaaaaaagaagaatacccaagaataaatttaactaaggagatgaaaagttttagaaggaaaactacaaaacactgataaaaaaaattaaagaacactaaaacaaattgaaagatattccatactcatgaagcagaagaactactattgttaaaatgaccatactgcccaaagcaatctacagattaaatgaatccatatcaaaataccagtgtcattcttcacagaaatagaaaaaaaaaattctaaaattcatttggaaccaaaaaacaccctgaatagccagagcaatcctgagcaaaaagagcaaagctggaggcatcacactacctgacttcaaaatatgttacaaggctatggtcaacaaaataacatgctattatataaaagcagatacataaaccaaaggaaaacaataaagaacccaaaaataaacctccatatttacaaccaactgaatttgacaaagatgccaagaatatacattggggaaaggacaaatttatcaataaattgttcagaaaaaaatggaattcatacgcagaagaatgaaacatgggcttatatctctcatcatatacaagagccaactcaatatggattaaagacttaaatgtaagacctgaaactatagaactactagaagaacacacaggaaacatactctatgatgtaagagtatgcaaggggttttcgggtaagacttcaaaagcacaggtaataatagcaatttcacaaaaaatactaaaaatagaactaccattcaattcagcaatctaactactgtgtgtgtatacaaaggaaaataaatcagtatatcaaagggatgcctgaacttccatggttatttcagcactattcacaatagcaaagatgtgtaatcaacctaagtgcccatcaacctaagtgtccatcaacgaatgaatggaaaaagaaaatatagtatatatatacaatgaaatactacttggttgcaaaaaagaatgaaatcatgtcgtttgcaacaacatagatgaaactggaggtcattatcttaagtgaaataagtcaagcacaggaaggcaaacatctcatgttctcactcatataaagctagaaaagtcaatatcatggagatagatatcatggagaatagaatgataagatacctgaggcagggaaaggtatttgtgggggatgggggggatgttggttaatgggtacaaacaaaaagatacaaggaataagttttaatattcaacagtagagtagggtgactagtttacaacaatgtattctatatttcacaatagctaggagagaaaaattaaaatgttcctaacaaagaaaaatgataaataccccaggcgatggatagtctaaatttcctgatatcctgacttgatcattacacattctattcatgtaacaagatatcatatgtaccccgtaattgtatacaagtattatgaattcttaaaaaatagcaatagagactcttcttatttcctgtattagttatatccaagctactctcttgctggagcaactatggtggtggttgtagtggtgtagtgatgctggtgatgatgataatgatgatgatgatgaagacaaggatgatatattcctgctaataaacctcaattaaatgactgctaattatgtgtcaagcattctgccaaccaaatttcagatagtaattcaattttatgccttagactagctttgttatgtaaatgttattttgctcactttgcagtaaagagactgacatttggggaagttgaataatatgttccttgaatcaatcaaaacactaactaaggaaaataaaacgggtttaaaatcacacagaaataatctttagtatgacccaaaattcctacaataatcatgagagcctggtcctggggaccaacgaaagatagaaataaatccaaatgatcatatgatattgttaataaagtaggtttaaacagaaatgaaatatccattcacaaaaatataggcatagctactttattcagggagtgaaagaaaagtgacaattgcacagatagtagaagctcatgccaggtgacagacagagacagaagacatcaaaataattctttgatggcacccaaagagaagctctgaaaggccggtacagctgaggacttcctttgctcagtctccacctggacagtggcagcatggcagcctcagaaaggaaacattttgctgtcggggatcatcatgggcagatcacaggctaaggggaaagaagctccctgtgtatccctggatggctttgatgagaagatgcaggtggagctgtggaacgaggtgagccaattatccctatcctttcgtggtcctgatgaattccgaagctgttacttgctcttgggtggacactttggctggcagggtggggaaggtgtcaccagaggatatttctgctggcactgctgaggtgggcagggctgtggacactttggtggtgggcagggctcagggcacttcaggggtggacatggctctggacgctttggcaggcggcacacaggaggtggctggcagggctgcttacattgctactgttgataagacatcctgctggagtctcagaatctgaaagaaattatataacagggttcacaggaagggactcctacaaagaaaagccaacgtttatgtaataccatgggctatttctccagtctccaaaaaattatttaaactcctaattcccttttcatgactctctggtttctcctttccactttagcaaattgctttatcaaccctgggaaatcctgtgttttctcatgcaatttttctaaagaaaatatctctgttataaagaatcaagcatgaaaataaccacttcatgaaaggcagtcacaagttcagatactctgggcaatctcagaagctattcctatcatcattatctgttgtaaagccccagtgggctgatgggcaaagagcaaagggctgtttgggaagaattgcaggctctcacacctgctaaaacacaaatgtttgaaaaggacaccagaaagatatagaaaaaaggaaaaacactttgcttttacctcttcctcaaatcaaagccttcctattaacttcgctgttcatatgaacaccaagctacttacaaaaaaaagctaaaacaatgtgtcattatgatctaatcctaaggttccatccactaagtagtgtcaaaactgtcatcagaggtttggatcaaccatactttctgtcttcagattaaattcaacttttgagggcccaaagaacagagaaattcaagtaagcagactcaccaggttctccgaagcagatcggtgctcaagtaccaggagtttaggagtcatgaggctgagaacctcttcacagggcctgctgccccacccagggggaaacggaactgcctaaaatgggctggtccagtaatgtcccatccaaaatgcaaatttatccataactggtatgacagggaatctcaaaaaaggaaatatcctgttctgaggtctcccgctggattaagtgctcatgactcacagaggccctgccttagctctcagtttcagtgacttatggcagagagaaaattgggggattctctaactggtggtccaaggctgtctttcttgattgggggaaaggatccctttctatcttaacctttccctgaattgtaaaacttcctgctctgatccactttagctgatttctatattgttgtacatgaactcaactctacctctactcccttagtataatttgccaatttgctagaagtaatgagaaactgaacatagttctatcattggcaagtcctgtgatcacaggtaggtcacttctcctccctgggtttgagtctttctgtgttcacaggagagaataatacctggctctgggttggagactgtccacattgtgctatttgtagactcttcttcaagcctgaaattttttcctctcttttttttttcctatataatcctgggtttgacctatattctttgtgtttttagagctgtcttttccacccaatccatagaggcatttctctgctaggacagattccacagtggaatcaagtcccctcggtgtttttcctccttgctgccctcaaagatgtgtactacagaccttttaaggaattaaaaaatgtactcttaatcgccaaattaaagaaaggagagaagtgaacaaaaaccacaaggagtcacctaaaacctatttattgaaccatgcctgagacaatggggttttctagatatacaatcatgtcatctgcaaaccgggacaatttgacttcctcttttcctaactgaataccctttatttccttctcctgcctaattgccctagccagaacttccaacactctgttgaataggagtggtgagagagggcatccctgtcttgtgccagttttcaaagggaatgcttccagtttttgcccattcactatgatattggctgtgggtttgtcagagatagctcttattattttgagatacgtcccatcaatacctaatttattgagagtttttagcatgaaggttgttgaattttgtcaaaggtcttttctgcatctattgagataatcatatggtttttgtctttggttctgtttatatgctggattacatttattgatttgcttatattgaaccagccttgcatcccagggattaagcccacttgatcgtggtggataagccttttcatgtgctgctggattcggtttgccagtattttattgaggatttttgcatcaatgttcaccaaggatattggtctaaaattctcctttttggttgtgtctctgcccggctttggtatcaggatgatgctggcctcataaaatgagttagggaggattccctcttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctttgaaccatgcctatgtggttcctcacagcagagaacaagatgcgtagactcacaccatcacatgtaaattctggagactggagatacacacaaggctcttcccactgctgcttctacttttatattcctcactgctccataaatcagttccagtgctggggagggttaaggccttcccccatggcctggattgccaggttacctggtggtgtatatcctggaggcagtccatcccccctcatactctgaaaaactctgttttctgcctggctcacagtgtaggttgcagcctgcagcttctttcaaaggatgtatggggttttgtttttttgtgtgtggggtcttttttttttttttcagttttcctgttaagttcctgcattacttcctgggaaaaagttcacagtgtggatctctacacactattttgtctttccaagtgagagaggcatgctaacaatgtctccaatccactatcttggaaaaataaaaacaaacttcactcagaattttaaggcctttatccgttgactcctagcagcctgtattgctgataaagtgatgctaaggattacctggaaaaggaatttctttataaatctggaggtggacttgaagatccaactaaagaggatcttttaacttcaggggacaaaggagccaaaagtcctcttgattgggtatgagagttgattaggaaagaaagagaaacagagtagaatgatgagggaaacctcaatgtgttttttttctcttagctgcacaaattgtggaaggtagctgaatcctgcatctgctttgagacacttatttctcccacacattctttattagggaattaca

SEQ ID NO: 15289 - DNA, 4957 bp, Human
cttagcaactcaattttcctagatcatatctaaataaaaataattatgctttctgcagtagaacaaggtcattctgacctcctcaactctcttttagctggaaattaggcaaaggatttttacagtcttacaaaaaagaggtattgataactccataaagtatggtaagatgaatcaaactgaagcctcctacatttcttttttaaatttctactttttttttttttttttttgagagagagtcttgctgtgtcacctaggctggagcacagtggcacaatctcggctcactgcaacctctgcctcccgggttcaagtgattcttgtgcctcagcctccctagctgggattacaggcacgtgccaccatgcccagataatttttgtatttttagtagagatggggttttgccatgttggccagcctggtctcgattcctggcctcaagtgatcctcttgccttggcctcccaaagtgctgagattacacgtgtgcatggcactcggccactgcttcaggttaactctagaaaataactcctcactcttccaggttcctttttggaaaataaatcaacatttgcctatgtgaccaatcactttcagtgtcagagtttctgttttcatattctcagtctgcacatcattccagcagttaccaacagtagctgtcttccatgacttatagaagaattactaaaggaacagactaaatacttacttaaaataacatacagaaggactaaattagcggcaagaattattatttctcaggcatgcacctgcaatcccagctacttaggaggaagggaggatccattgagcccagaagttcaagacaagcctgggcaacacagggagactatgtctctaaaaacaaacaaaaattgtttcctgttttatgacagtcacaaagacttattatttctcagaataagagacttcatttgacagttttagttgttatattagaattatcaagcaccttatgagctgagattatggactcaatttctgaatacaggacagggaaaatctgacacaaatgaggaaagcctcaaactttttcagaccacatgttgcataaagaatttatagctgttttatttagttggttacacactgagtagctactgtgaagagaagcattatgccaaacagataaattcacagacccagcattgaattttacagcctggaacaacctataccaagtggtatgagtaaatattctcataaaatagcccaaaacatctctactggttccataactgattactgatttccacattacaaagattatttttttctaatacctaactcttattagagacccggatatttattactgaggcaggagaatagggtctggaggcaggaaacttaagggcaattcatgctgaatcaaggaaaaacaccaaggtttgggggcagggaatctgaggtcaacttacgttaactttctaaaagagaaaacaccaaggtctgggggcaaggaatctaaggccaattcgtgctgacttcccaaaaggaaccccctgggtttgggggcagggaacctaaggccaattaaggccaacttcctaaagctaaaccaaaaggaaaaaacccatctgcccacgcccgagtggcaaaggatcaaaggctactatccctgcaaccctccccatccaccacgtctcacatggaaagggagagtgccttagactggccgcaggccaagcagggaccatccgttcatctgcacaggacgccaattcacctcggcctttaattagccacagaccaaatccttcatccagataaggggtaacccataggaaccataaaaggagcacttaaaatccagaaaactttgtaagtgggctcttgagccccttgctccggcccactcacaccctgtggggtgctttctcgctttaataaattcctgctttcgctgcttcgtttgtgtttcattcctttgttattttgtgcgttttgtccaattatttgttcaaaatgccaagaacctcgacaacctacactcaagggcctcctaccggtaacattacgggaaacaccatttcctcatcacatttcagatttgctcccagtgaggtacgtgggcacttgaacacatccctttaaaaaggagaaagctttctgatctatgtagtgatttatctggcagtgccttctgtccaccagcctctggcctgattttcctagagatcagaagaatcaacataacttttgtaaactaagatccagaaagggcctttggttattatcggtaaatgctgggctaaagaaagaactggtgggcgggtcaccaccccaggctagtccacataacgctattcatcttagaagcagtaagacgggggaaaggtctgcatcccattcgcttattccgtcctactgaatctgccttggcaggacacgacctgcaaaataaccccgtggatccgtggagtgtcaccacactgcagggtcaaaggacggcgtcggcggttctcggctgttagggagctagccgacgaaggcaccacaaccctcattctttactcttcccgcctgggggccgggaagccaagctctaccgcttcgagcacatccagggtccccggggcccggactgctgacaccgaggcaaggtctcaccgggcccactctgcccaacctccccgattctcgcttagcctctcttccctttcggggtgccctcccgcctgctaccccgaggggtgcaaactcacgaccaccgcggcgccggtgaaaatgtcctccccctcggtgtcgctgtccccagcctcgggttctgatcccccggccgccccctcggactccggctccaggccggggaagggcggaggcagtctctccgaagcgctacagccaccaccacccgacgccatcttcttccacccgcggcggaagccgcaacaacaactttatcgagagatagcgccgtgagcaaagcgatccaacggtgcgaggagtgggagggccgcaagggaccccgtgggatccgaggggcggagacctaggggcggggcttaggcgctgggggcgggggggcacccggccagctgaggctgcgcagcaaatccgaggcctggttcgcgatgctgagatattaacgagtggggccaaaggggcagaaaagtaggagttaggggctgctcaggtttctagggccctttgtgctctggatagctttatccaacaggcttctaagagttcgtctgaatgaaggagtgtcactaaaatgtttgaaaacctctacatgccatctacccatgccaagcacaatgccctcacagagagtcaataaatatttcgattgaggtatctgaacaagactagaagaaagcttcaccacttattccttgagcaacattcagttaattcattaagaaatacagatactgagcatctactgtatgcctggcaccttgctgtgagtttcagatacagaaatcaggtatttaatcgacagttcgacatgttcaatgctatggtgccctgtgggagcacagggaaagagataatcaattctgcttggagaagtagggaggcctcacagatgaagtgaggcctcagtgtcctagatttggctggaaaaatgttaggattatcctctcaattgctgtggagtaagtggagtggaatagacggcagggaaattattgaaccctgaccaaaatttccttgggacctaagcaattcattgtctggtgatcctaaggcctacattaactagacaaacaagactggagtttaaagataaatgggcatgttagcatgggacaattctgcaagataatcctatcttctcaatagaaatggcatttgtcaccaactttgacaagaggtttagttagtttggttgtaactgcaaattcagggatggactccctcacaggtcatgtgagctgtttgaaggcgggggcagcgttttatctttgtatcttccatgcctatggatcacctatggcaaattagtacctacaaatttgatcggagggatggatggataaaataaaatcgattttgttactggcatccatcacacccacgaacaccagagggcttaagatacactttttttttttttttttttttgagggaagtctcgctcttctcccccaggcttgagtgcaatggctcgatcttggttcactgcaacctctgcctcctgagttcaaacgattctcctgcctctgcctcccaagtagctgggattaaggcccctgccaccacgcccagctaatttttgtattttttagtagagacggggtttgcccatgttggccaggctggtctcgaactcctgacctcaggtgatccgcccgcctcggcctcccaaagtgctgggattataggcgtgagccatcgcgcccggccaagatacacttttaaggatggcgatctccattatgtcaccactgtacacattagacacgggaaaacttatgttctaagttgtctttggaggccattagcagaaatattcgttcaaaggtgggaagctgtgctggactgagtcccttaggagacgagaaagccaaaaagccctccccatgccatacctgactacctcactggcttcccatgacatcccttttcacagcaactgaaacctacttcctgtccgatcaggaagtaagaaagacgttggctgtcagcggatcccgcggagaaataattgtaaagagtctccgtgctggagaactcaagatctcctttcccctaccccttcaggattcatctttaacttatcacggatactgagtgagtcagtcgcggttaacagaccgttacatccacttctaccaggcggacactacaagtcccagaatacaattcgctgccttccgaagaaaatagctcacgcatcccagcatgcaatgtgctgacgagccgcgaagattgtttttgtcccgccgaaatcgagcaaagcacgctggaac

SEQ ID NO: 15290 - DNA, 27600 bp, Human
  misc_feature (1)...(27600): n = A,T,C or G
gtaaatttctgtcaaatgaatgaataaaataccaccaccttttcctgagaccattttggaccaaggctggcatgggcatctctgttcctccctctaacttaagaattccatctcttagaggcagatgctgcctgttttctgcaaattttattattcacctttctatatttggaaaaacaagttggtgtggcttacttaggaatctcatatccaggaaatgagctaaaaatgttgtatcaaagattatgcataggatccacaaactaagaagcaagcagatgagagcggttagagacatcgtggtatattttccggaagaaatggtccatggattaaaaattgtcattatgatgagtctgcagtaacacagaaaccacgtagtgcgaatcagaaaatgaaaagcacagccattgactatgattacaaaccaaaactttataccaattacctgttggaatttatgctgcatgaaggcaggatattttgcttgtcctgttcactggacagtacttggcataaaggatgtgcttatgaatattttctgggaaactaaatataacattcacctgtgaaaacacatctgggccaggcgcagtggctcacgcctgtaatcccaacactttgggagcccgaggcgggtggatcatgggaggtcaggagctggagatcagcctggccaacatggtgaaaacctgtctctaataaaaatacaaaaattagctgggcgtggtggcgggcacttgtaatcccagctactcaagaggctgaggcaggagaattgcttgaacctgggaggcggaggttacagtgagccgagatcgcgccactgcactccagactggacaagagtgaaactccgtctcaaaaaaaaaaagaaaaagaaaaagaaaaaacgtatctgaagggaatgaacaaatacacatgcggaaaattgtattcatggggtagaacggtggctgtttccccccctttcactattttctctcctaaagttgtgatagcattttctcagtggaaaggatgaccacagaattatctcccctgggctgcaactaaggaagtatttggagtgagaatgcgaccaggcttcaaatccaggaggggtattttacagggcgtgtggctctcacccagggctcacaggacacctgatatttaggctgttccccaagaggctaaggacagcgcggccccagctcccccaaccacagctgcccaagtttaggagcccgcactcgtgagcgatggctactccgcacagccccggggtcctctacggaaatccctggcacctatcagtacccctaagggaggtcgctcgttacccctcacttgaactctgtcccaaatgggaggtcactctctcttcgcggaccccatcttccccgaaagggtctcttgttctctctggccctcctgagaaggtcattactccccaactcgccttttttgttgttttttggtttctggtttaatgaggcagggtctcgcttcgtctcccagactggagtgcagtggcgcgatcacagctcacacggcagcctctacctcctgggctcaagcgatcctctcacctcagcctccctgggactacaggcgagcgccactacgcccgctttttttttttttttttttttttttttgtatttttgatagagacgaggtctcgctatgttgtccaggctggtctctaactcaagattcctctcacctcggcctccgcaagtgctgggatgacaggtgtgagccaccgcccccggcccctcgcccgccttttgaaggagcctttcgtcctcaagggcgaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgacccgcgccgtgcaactgctcatcctggcctacgtcatcgggtgagcgtggggccgcgcggggggcgcggcgggtgctgccctcgcgtccgcgccgtgcggcggctcatcctggcctcggtcacctgggcgagtccgggagcggcgagccgaggcggtgacaccttccctgggccccagccgccgcgccggggccccgggggcgggaggctgcttgctgctgttttaaagccacagcctgggccaggcgcggtggcgcaagcctgtaatccgagcactttgggagcccgaggcgggaccatcgcctgagcccaggagttcgaaaccaatttgggcaacatcgtgggaccccgtctctgcaaaaaattaaaaatcatccgggcctggtggcgcgcgcctggggtcccagctactcaggaggctgaggtgggaggatcgcttgagcccaagaggctgaggctgcagtgagctatgatcacaccacttaactcgagcctgggagacagtccgagacccgtctgtttacaaaataaataaaggcaaagcctggctaggctgttaccctctcctgcctgaccccccatagtgccccttggctgtaggggcttcgccctgaacgtctcaatcttcgctctccacttcccatcctgctgatttgctgacaaaaccaaagcttggaatttccgcttggttccttctgggtgggtggcttttggtcatttcttttgatcactatgcggtgtcactatgtggtagtagcgaggtcagactgtagcgagtgtttaaagtttgcttcctttgttttctgggcttgtggggctttttgtggtacctgccctagcctagtcagtcattccccatgctgcccccttaggctagagatgccctaccgccctcaggcctcgctgaatgtgccattgtacttgaaggcacctgttacttttttaatttttttatttttttgagacggaatttctctcttgtcgcccgggctggagtgcaatggcacgatctcggctcactgcaacctctgcctcccgggttcaagcaattctcctgtctcagtctcctgagtggctgggattacaagtgcccgccaccacgcccggccaatttttgtattttttagtagagacggggtttcaggctggtcctgaactgacctcaggtgatccgcccacctcagcctcccaaaatgctgggattacaggcgtgagcccccacgcggggctggcacctgttacaattgaatacaacgcgagagagaagatgataattaccttgccacctggggccactttaaaggcttacctggggtgttctggtgtctacagctgctgggctgacacgtattgcctagtgcagtggtctccaaactgcacattggaaccatctggaaatctttggctcccatccccagacccttttttatttttttgatggagtctccctctgtcgcccaggctggagtgcagtggtgcaatcttggctcgctgcaacctccacctccctggttcaagcgattctcctgcctcagcctcctgagtagctgggattacaggcacccaccaccatgcccggctaatttttgtatttttagtagggacagggtttcgccatgttggccaggctggtctcgaactcctggcctcaggtgatccacccgccgcagcctcccagagtgctgggattacaggcgtgagccaccgcgcccagacgcatccccagaccttctgatttaattgctgcagagtatgatcggctgcccaggtgattctcatgttcagcaacgtttcggaaccaatgaactgtgtttcccaagtttacctgatcatggaagactcatctgaggaattgtttaaaagtaacagatccccccgtctttggggtgaggtttggaatcttaacactgcccaagggaagcccaagcaggtttggcttccaatatctgtcagcagcagcagtagatacagacagtattcaagaggatggctttccaggtgcagactcaacatcagaaccacctggcccacacccagatttggactcattggctcacacctgtagtcccagtgctttgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcactgctagccagttaactgaactcacatccctggttggacctgaagcatttgggggcaggagctcccctgcagctttttgcttttggcgtttgctgctagtgggaggatcagtgcacatctaccttagggtacctgtaaaattacaactgcggaaaatatccatagtggtgttgcactgtatggtagccactagtaacttgcacctgttgaacacttaaccgttcctactctacactgagatgtgctataaccttaaaatacacactggatttcaaagacatagtacagaaaaagaggctgggcacagtggctcatgcctgaaatcacagtactttgggaggctgaggtgggaagatcgcttgagctcaagagtttgagacaaacctgggcaacatagcgagaccttgcctctacaaaaaaatacaaaaattagcctggcatggtggcacacgcctataggcctacctatttgggaggttgaggcagaaggactgcttgaacctgggaggttgaggccacagagagctgtgatcacaccaccctccagcctgggcaacagagcaagacactgtctcaaaaaaacaaagagtaccactatcacatgaaaacattttttattgatgacatgttaaaatattttggatatattgggttacacagaatatatcattacaattaatttttcctgtctcttttttctttttttctttttaaacggcgccttgctttgtcacccagactggagtgcaatgcactgcaacctctgcctcccaggctcaagtgattctaccatctcagcctctggaattatgggactacaggtgcacaccaccatgactggctaattattgtgtttttgtttgtttgtttgtacagatgagaaatctcatctctacaatcatgaggtttccatgttgcccaggctggtctcgaactcctgagctctagcaatctgtctgcctcggcctcccaaagtgctgggattacaggcatgagccaccgtgcccagccctttctatttctttttactttttgacatggctactagaaacttttaaattacagggtcttgccctgtggtagctcacgcctgtaatcccaatactttgggaggctgaggcaagtggatcccttgagcttaggaattttgagaccagcctgggcaacgtagtgaaaccccatctctaccaaaaatacgaaaaattagcttggcatagtggcgcacacctgtggacccagctacttgggaggctgaggtgggaggattgctgtagcctgggaggcggaggttgcagtgagccaagattgtgccactgcacttcagcctgggcgacagagcgagagcctgtctcaaaaaaaaaaatatgtggctcgcgttatgtttttatgggacagcgcagctctgtaggattccttatgacgcattcactatctcggtcatgagaatctttaaagcagtaaatgctttgcttttgtccgtcttgctataatcaaaactgactcaggacctgcattaaggctctttttttttttaacctcatctcttaactttttgatgcaactcatcttagtgaaattgtggtctcctcctacagcaaccctccctcaaaaaaagaccgaacacgcaattctcatctatctaactctgttaacaatcatatgaggaggaaataatcacatgataatgagtggcatgaaaccctgtgtctctaaattaagcaactcactgtacttgatgagtacatcagtcttcctgccccaagcttttgtgtgtcagactggaattaaatggaagcttacactgcagctgaattcctagaagccctggacttgtcaggggaaaagcccatggggggaaagcccatctctaggctgggcaatgaacttggagactgctcgatcacacacactcataagtaacaaaaccattaatttcttttcttttttttggtggagggacagagtctcactcttgcccaggctggagtgcagtggcatgatctcagcccactgcaatctccacctcccgggttcaagtgattctcctgcctcagcctcccgagtatgtgggactacaggcacccaccaccacacccagctaattttgtgtatttttagtagagtcggggtttcacaatgttggccaggctggtcttggactcctgacctcaacaaaaccagtgaatttctgaagtctcagcatctaggacttagaagaaggagaagcctagcatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaatgaggttaagcaccttggccaaagttatgcctcgtgaatggtggagctgagccatgaaccaagacctctgcctccagtctgtcctaacccctataagctaatgcctgtagatggttttttttttttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggattccttatgacgtattcactgtctcagtcacgagaatctttaaagcagtaaatgctttgcttttgtccatcttgctataatcaaaactgaccatgcccggctaattttttattttttgtagagatccctatgttgcccaggcttgtctcgagctcttgggcacaaatgatcttccccccttgacctcccaaagttctgggattacaggcgtgagccactgtacccagcccctttggatttttaattgttcaaactggtagtcatagtcccacttcagaggagagaaccatatatgtgaccagaattcttgggggaaaagtaagaaactactcttaaaagttccttaaagggtagaattctcttttctagaaagagtagcctagggttgtccaatcttttggctttcgtgggccacactggaaggagaaattatcttgggccacacattaaatatgctaacactaacaatagctgatgagctaaaaaacaaactttttttgatcacacaaaaaaaaatctcataacgttttaagaaagtttacgaatttgtgttgggcctcattcaaagccatcctgggccgcatgcggcctgtgtgctatgggttagacaagcttagagtagagcatagtgggtgagagaagaggcttcagatgcttctggcttgagttcaaatcctgactctgccactcactagctgtgtgacctttggcaagtgacttaacctctctgtgtttccatttcctcctctgtaaaatggaaataataataatgatacctgtctcataaagtggtcaggattaaatgagttaatacatataaagagcttagatcagtgcctggtgcctataaacactccagtggtaactgttataatttgtattatctcttggtgattcccataggtcacaggcattgaaagtgctcaaagggccaggtgcagtggctcacgcctgtaatcccagcactttgggaggtcgaggtgggtggatcacctgaggtcaggagttcgagaccagcctggccaacatggtgaaaccccgtctctactaaaaatacaaaattagccaggcgtgttggcgcatgcctgtaatcccagctacttgggaagctgaggcaggagaattgcctgaacccgggaggcggaggttgcagtgagccaagatcacaccattgcactccagcttaggcaacaagagcgaaacatcgtctcaaaaaaaaaaaaagagaaaatgctcaaatgtaataaagacagtattcatcgagcgttttctctgtgccatcagtgtgctgagtgctttacctgcaccatctcatttatttcccgcaaaccctcctgtggtttaggtgctaccatccccatttggcagaagtggaaatggagtcccctagaaggtacgtagcttgtagaaagtcatgtaattagtcaacatcgtacttccagccactggccagcagaagcttccccatcaattcaaatccattgaatcctaatggcaatttaagaggcctgttttattttataggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggtgtgtctcccactgtgtcttctgtctaacactgacaccttgctctttactgactttgcacacttgattaatgattgacgtggcctgagtcctgacatcaccaatgcccagaatgattgttttagtccaagaaaacggtgcagccagatctcttttcagcttaggatctaacagagtgtatccaggcagctgtggttcctcagcttgaaagcatggcaggctgaaagccctgaaagatgagaaaacaaatgtcttaaatcctgatagaaattcaagtggaaatatcacctttccacattttgggtttgcattattgtcccaaatacacgaggtaaatcttttcagacagtgtaaaaactttaggccgggcacagtagctcacgtgtgtaatcccagcactttgggaggctggggcgggcagataccttgagcccaggagtttgagaccagcctgggcaatgtggtgaaaccccatctctataaaaaaaaaaaaaaagaaaaaaaaagaaaagaattagagaccattagagaccaaaacccaaacaagaaggaaacagagacagcagcacaggactccatcgggagcgaaaggaagggaagacattgtttactgctgcatactagtcttcaggctgttaatctgcaaagctccaagttaaacattgactctttagtcctggtaacagctctgcaccacacagtcaaacccgacatagccctccagatggcctatgtgctaagggaccgagggcgaccagtagagataagctgccaactcttggctcagagctcttgccagggaaaacaagaactccagaaactctttcttcaggtgtgttcttccccctgccttctcaagagaagggtcttgtggggtccccagagaggagaccgagctaatgagccataaaagtcaggaggaagggccaggtgcggtggctcatgcctgtaatcccagcactttgggaggccgaggtcggtgtatcatgaggtcaagagattgagaccatcctggctaacatggtgaaaccctgtctactaaaaatacaaaaattagtggggtgtggtggtgggtgcctgtagtcccagctactagggaggctgaggcaggagaatctcttgaacctgggaggcggaggttgtagtgagccgagatagtgccactgcactccagcctggtgacagagcaagactccgtctcaaaaaaaaagatcaagtggaacaggggatttgcagttggctggagggggcagtcctgttagcatgtacctgtctcagcagagagacggttgcctcctgtgcaggcatagccttgtcccggtgagctctgggaatgtcatgctcggtgtgtttactgggcagatgaggaagggcacaagccccgcttttgtcccttggtggaaaggagcaccccacaactcagccttccgtggtggatctgggcgggggccgtgtgagttccccagggctttcctcatgagctttcacgacgtctgtgttctttgtagatggaacacagtcatctatttgcagccccttggctcatctccagactgaaattacccttaatttgaagtagataagtgataggaaacaggccagatgtggtggttcatgcctgtaatctcaacacttttggaggccgaggcagaaggatcacttgagcccaggagtttgaggctgaagtgaactgtgatcacgccactgcactccagctagggcaacagagcaagaccccaactctaaaagagagagaaagaaggagagataggaaacgaaaagtagaccatactggattgttccaagtataactcaggagagtcgtaggagcggccttctctaacaccaaatgcagagtgtgtttgtacattgaacacctgggaacgtgacaggtggcgggagagaggctgcagctcatgccacatcctcacgcctcctcctgtggccttctccttgtctcccaacatagtttgccctaggcctttggaggacgccagctatttctagagcttccaccacttgtcagaccgtggggttggggatgtctacagactggttggtttctgagttgccctgatccccaagatggctcccactactgactgttatcctcaggagtgtgaaatgctaaaagctttgggcatctccttttaaaatgcctgggcccagccaggcgcagtggcttacgcctgtagtcccagcacttttggaggccaaggcaggaggatcacttgagctcaggattcaagaccagcctgggcaatatagtgagaccccatcttgattggatgggtggtggatggatggatggatggatggatggatggatggatggatggatagatagatagatagatagatagatagatagatggaaagaaagaaagaatagataaatgataggataggagaaagaaagggaaagaaagaaaagagaagagaaaagaaagaaaagggataggatagatgacagatgataggatagattagataggtgatagataatcgataaatagaaaacagatgatagatataggatagattagatagatagatagatagatagatagatagacagataatagatagattagattagatggatggacaccagcccccaatgagaggaggatccaactagaatcttttggggtctttgccttttattccttatatgaggaggtcattatcagcaattcttcagtctcatccctagcaaattgctttccagaaactctaaatcaattatttggcacctttatacatataaggaggaaacagaaccttttcaaagagaaatgtcacttgctgaccctgaccgagtcttctctagaatgtttgatttataatttcagttaggaaagaaaaccagccagatttgagccccatgaggcctcatgtttttattcctctgagataatctggttggcagggaatgtttttagcacttgttggctctttccctcagtaagtcaagtttgattgagaaaccattgtttcagtttgcagacccccccctttttttaactgcagtcaaattcacttatagaaactaaccattttaagtcgggcacagtggctcatgcttgtaatcccagcactttgggaggctgaggcaggtagatcacttgaggccaggagttggagaccagcctagccaacatggtgaaatcctatctctactaaagatacaaaaattagccaggtgtggtgatgtacacctgtagtcccagctactcaggagggtgaggctggagaatcgcttgaacccaggaggcggagattgcagtaagccaagatcgtgccactgccctgcagcctgggcgacagagcaaggctctgtctcaaataaataaataaataagaaagaaattaaccattttaaaatgaaaaattcagcacatttagtgcattcacagtgttatgcaagcatcacctctatctagttcaaaacatttccatcaccccaaagggaagcctcgtatgttacacaaccactccccattccccacttctctcactccctggcaacccgtaagtgctttgtctctatggacttgactgttctggaaatttcacatcaatgtaatggtatcctgtgtggcctttgtgtctggcttctttcactcagcatcatgtttttggggttcatccatgttgtagcctgtatcagtgctttattcctttattttattttttgagatgaaatctcactctgtcacccaggctggagtgcactggcgtgatctcggctcactgcaacctccacctcccaggttccagtgattctcctggctcagcctcctgagtagctgggattacaggtgcccgccaccacacccggctccttttgtgtgtgcgtgtgtgtgtgtgtgtttgtgtgtgtgtgtgtgtgtgtgtgtttagtacaaagtttcaccatgttggccaggctaatctggaattcttgacctcaggtgatcctcctgcctcagcctcccaaagtgctggaattacaggtgtgagccaccatgcctggacccttcattcctttttattcatggctgaatcacattccatcatgtgactagactaggacagacatttgggctgtttccaccattttttttttttttttgagacagagtctcgtgtcatccaggctggagtgcagtggcgcgatgtcggctcgctgcaacctccgactcccgggttcaagcaattctcctgcctcagcctcccaagtagctgggactacaggtgcccgccatcacacccggctaatttttgtatttttagtagagacgggagtttcactgtgttgaccaggctggtcttgaactcctgacctcgtgatccgcccgcctcagcctcccaaagtgctgggattacaggcttgagccaccgcgcccgacctgtttccaccttttggctcttgtgaaaagtgttgctctgaatatttatgtacaaggacttgtttgagtcactgttttccattgggttataaactttgatgggagagagcgggagagcacgcggtcagtgtttgagttgtcctcttcagtcagcgtctgcctttcttggctctccgtgagtcctctgagcgtggcttgcccgtgctgtctcccctctgcaggaggaaaactccctcttcgtcatgaccaacgtgatcctcaccatgaaccagacacagggcctgtgccccgaggtaggaggcccccgggaagagccccaggccccacacccctctccacgcctgtccacctgtgtgtggggccgggccacgtggactttcttttcgctccttctttttccagattccagatgcgaccactgtgtgtaaatcagatgccagctgtactgccggctctgccggcacccacagcaacggtacgagcttgtggcctcctggggagggcggcccctgagcagatcgcccccactgtggagcgtctctgatagagaaatcttcccaattccttcacatgaccctgggtgagccaggtgccgaggctggggtcctggagcccctctacattcactgctgtcattggagccccacaagccatcccagctcttgccctactgtttttttttttgttgttgttgttgttttttcttgttttttttgttttgttttgtttttttgtttttttgagccagagtctcgctctgtcacccaaactggagtgcaatggcatgatctcggctcactgcaacctccacctcccagtttcaaacaattctcctgcctcagcctcccgagtagctgggattacaggcatgcaccaccacgcccagctaatttttgtacttttggtagagatgggttttaccatgttggccaggctggtctcgaactcctgacctcaggtgatccacccgcctcagcctcccaaagtgctaggattacaggcatgacccactgtgcctggcctcttgtcccattctttagcttggcatcaccctggctgagatgtggctggcacacaggtaactgtcttcctccgattctaactcctggacagtgacactgtctaaatcccagatttgcacagctcaagactggctgcatgggaggctggatggggctctcactccctactccaaaaaggtagaaaataggagacccctgtggacatgggacccccctgccacccttgtgcttgtaggagtctcaacaggcaggtgcgtagctttcaacgggtctgtcaagacgtgtgaggtggcggcctggtgcccggtggaggatgacacacacgtgccacagtgagtccagccctagggaaggaagtgcctttttgttttgttttgttttagacacagtttcactctgtatcccaggttggagtgcagtggtgcgatcttggctcaccacaacctccacctcccgtgttcaagtgattttctgtgcctcagcctcccgagtagctgagattataggcacccaccaccacgcccaactaattttttgtatttttagtagagacggggttttgccatgttggccacgctggtctccaactcctgacctcaagtgatccacctgccttggcctcccaaagtgctaggattacaggcgggagccaccacacccagccagaagccaccacacccagccggaagcaccttcaactctgcgtgtcagccttgaacagaggtggtcaaggagttacacctgtgtgttgtggctttttgtgtgtttctggtgtctgtatgaagtcaggctgccctaggatggctgctctcaaccacaaggcagcgaccatcagtggcaagatgggccacaagtagtctgtcactcacgagaagggtgcaggtgactgacttccttgtatgttaggactctgtcagttgcaaataactgacaggaaacagttctcagtgccttaagcacatgtgcacaaacacatacacacatacacatgcgtgcacagcgggggggcagtgtattgtccggctgaccaaaaagatccagcgtggccaggagaatctcgtgccaggctgaggcagaagaatctcttgaacctgggaggaggaggttgctgagctgagatggtgccactgcactccctcctgggcgacagaggccactgcactcctgcctgggcgacagagtgagagacaaaggacaacaccctagtctcccttcctggctctgcatcccgccgtgccagcttcactcgcaggacccacagcatagcccgggaggcagcgctgcacttacagccccccaagtctgagtctccctttccagctgtccctggagattctagacctgtccatcatcgtatcaatggccatatctctcaacccatctctgtggctggggaatgggttttgcttatcagcttgggcctgggtcacatgcccacctctgcagctggggctagagtcagacccacccaagtgacataggcaagcattggggagatatggcttccaaaggacatttggggttctgttaccagaaaagctgggagcagatgctgggaagaaaacaacggatgtttgctacagtgtattttaaactaaactagacaggttcatcctggcgcggtggctcatgctgtaatcctaacactttgggaggctgaggcagtcggatcatctgaggccaggagttcaagaccagcctggccaacatggagaaaccccgtctccactaaaaatacaaaaattagggttagggtggcgctcgtctgtaatcccagctacttgggaggctgaggtaggagaattgcttgaacccgggaagtggaggttgcagtgagctgagatcgctcttctgcactctagcttgggcgacagagagagactctgtctcaaaaaataaaaatttaaaaaaataaataaataaaaatttaaaaatcaactaaactagccaggttcaaggttgctctagaataacattcttcgtggttgtaattggctgtgcttcatggggtggagtccgggcagcgctctgagaagtgcgtgcagcctagggcctttctcaccgagagctcagaccgaggtctccatgagccccggggagcaggaagccactgaacctcatcctgggtgtgttgagacagaaggaaaggctgagaactgcagatttagagattgctaaggcaaaggaaggagatagaaaaagaaaaggaatcctagcatcttagagctggagaggatctcacagagctgtgctctccaacacaggagactctggccacgcgtggctattgaaaattgaaatatggctgggtccgaaaggagatgggctgtccataggaagtgcacttatcatcaaattggattttttttttttttttttgagacgaagtctcgctctgtcgcccaggctggagtacagtggcgtgatcttggctcaccacaacctctgcctcccgggttcaagtgattctcctgcctcagcctcctgagtagctgggattataggcaccccccaccacaccttgctaatttttgtatttttagtagagatgcaggtttcaccatgttggccaggctggtctcgaactcctgacctcaggttatccacctgcctcagcctcccaaagtgctgggattataggtgtgagccactgcacccagcccgattctgtttattatttatttattttttatttatttgtatttatttatttatttgagatggagtctcgctctgtcgcccaggctggagtgcagtggcgccatctctgttcactgcaagctccgcctcctgcgctcacgccattctcctgcctcagcctccccagtagctgggactacaggcgcccaccaccacacccagctaatttttttgtatttttagtagagagggggtttcactgtgttagccaggatggtctcgatctcctgacctcgtgatccacctgccttggcctcccaaagtgctgggattgcacgcgtgagtcaccacgcccggccctgaatatttattatgaaaaaaagaatgtataatatctcattgatttttgtatgttggttacatgttgaagtaatattttgggttactgtataaaattttacttgtttcttttactttgtagtgtggctattaggaaactttaagttggagtgtggcttgtagttgtgtctcataagatactttttttttgacacaggatcttgctctgtcacccagtgcagtgataacgatcatggctcactgcagcttcgaactcctggactcaagtgatcttcccgcctcatcctcctgtgtagctgggaccacaggggcgcaccaccatgcccagccaacttattttttgtagagacagggtctcaccatgttgcccaggctggtcttgaactcctgggctcaagcaacccacctgccttagcctcccaaagtgctgggattacagcgtgagccaccacacctggcctcacaatatacttttattggacatcactgttgcagatctaatgcggtgtaaaatgatttttaagtgcacactgatataagaaataacattggccaggcacagtggctcatgcctataatcccagcactttgggaggcagagacgggtggatcacttgaggccaggagttcaaaaccagcctggccaacatggtgaaaccccctctctactaaaaatataaaaattagccaggcgtggtggtgcgcacctgtaatcccactactcaggaggctgaggcacgagaattgcttgaacccgggagatagaagttgcagtgagccaagatcatgccactgcgctccagcccgggtgacagaataagaccctgtctcaaaaacagaacaaagactaaaacgttttggaactagacagaggtgatgattgcacaacattatgaatgtactaaatgccacagaattgtccagtttaaaatggttaattttatgttatgtgaatttcatctcaatttctctaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagattgcggcattgcactccagcctgagcaacaggagcaagactccatctcaaaaaaaaaaaaaacctgagagaagccccttggtcccagcctttctctgacagcagtggtgacaggctcagctctccttccgagtgcagccctgtcactgaccttgctcctgtctcagggctgggaagactgttgatgttgtcattccaaagatcccacctggatcaggggaacatcccccacagaagggttagccatacagtgccagattctccaggagaaattcaccaaagaaatggagtccccttggggacagattcaacttgtattgtcagccaggagctgacgtggcacttctgagaagaggccggcgcacctgctggcgggtgctttgtgcacttttcagacaggtcaggatccagcctgtaggcaaatttacttttgctttgacctgtaaaaccggatctgcccagccttcattctctccctggagaacgcctgcggccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcatgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggtggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaaaaaaaaatatatatatatatatacacacacacacacacagacacacacacacaatacatatatatatgtgtgtatatatatatatataacatggttatgtgagtatttgtatgtattttattaacagtaatgttatcattgtttttcagacctgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgctggcatctcggtgtcctggggcagatgtaagcgagtcccacaaacagtggcttgcaactacaggacttgattctctcacagttctcacagttctagaggccacaacctaaaatccaggcatcagcagggctgtgctcgctctgaaggctctggagagagtccttacttgtctctcctggcttctggtagcccacggtgttccttggcttgtggatgcatcactccagtctctgcctctcctgtcatgaggccttctgccttgtatgtgtctctgtgtcttttcttcttgtaaggatatcagtcactgaatttagggcccaccctactctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccatctctactaaaaaaaatacaaaaattagctgggcatggtggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgtaattgtgggatctgctgtccttttgaaccttctggctcactgagtaaagcagatatttgaatttttcttttctagcagttagatttgtgttattccatctctactgtcacacacttcttgtggaaacctcaagcttaggtcagagccctaaaacggaaagaactcaggacgcctatcccccaacctcgggcagcaccaggccctgcctgtgtctcccaggcctggcccatggcgtggaagttgtgggccagatagagcatggagctagggtgcgggccgaggctcctgatggatccctggagaacatggggcagcagatggtatgtcttgacggttcttcaccaaccatccatcccctgctcatgcgtgtgcgctctctcgcgtgctcgctctctctctctctcatatatgtatatgtatatatgtgtatatatatatatatatagccattatatatatagccattatatatatatatatttttttttcttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattggccagggtggtctcgagctcctcacctcaagtgatccacctgcctcggcctcccaaagtgccggaattacaggtgtgagccaccgcacccagccatatatttttaaatggtcttactgagatgcaattcacatgccataccgttcacacatttgaagtgcagaattcatagttttcactatattcacagataagtgcaggcttcaccacagtcgattttagaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccatcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgagcgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaatccctgtctgttgtctcatagcatgtgctagaactttccttcctacccttttacgacaaccagtaaatccactattccggctcactgtgctcagaaaaggtccatgggatggtctgtttctggcacttatgcacattttcccctacttctttatttatttattttatttttgaggcagagtctcactctgtcgcccaggctggagcgcagtggtgcaatctcggctcattgcaacctctgcctcccgggttcaagcgattctcctgcctcagcctcccgagtagctgggattacaggtgcatgccaccatgcccggctaatttttgtatttttagtagagacagggtttcaccacattggccagccaggctggtctcgaactcctgacctcaaatgatccatctgccttagcctctcaaagtgattggattacaggtgtgcgccaccacacctggcctatttattttttttattacccaggctggagtgcagtggcgcaatcactgctcactgcagtctccacctcctgggcttaagcgatcctcctacctcagcctcccatagtgctgggattacaagcatgagccactgcacccagctgcctactttttaaagcctaataatttgtcattagcttgtcttcctgcacagttcacaggacactttttctctagtgacatcttacctgtgcctccattttgacataaaattacaattctatgctgtgggtaacacaatttttggtaacatggaagtggcttcctctcccttccctgtttgcttcccaaaagtctccaaccaaaagcagcagcacgcatacctagctccgcacaggttcgaaatgttcatgaagctatttccagctgcagcttcacaccaactaaatgtttgtgtttttttgtttttgagacagagtcttgccctattgcccaggctggagtgcagtggcatgatctcggctcactgcaacctctgcctcctgggttcaagcaattctcctgcctcagcctcccaagtagctgggattacaggcatctgccaccacacccagctaatttttgtatttttagtagagacagaggttcaccatgttggccaggctggtctggaactcctgacctcatgatccaccgcctcagcctcccaaagtgctgggattacaggcgtgagccactgcacccagccacacaccagctgaattctgcatcaggtattcagaatccccctagaggaagcagtttgcccttcgcctctgccatgaattcacttccaagtactgagaggaaccattattttacaaatactctgcttctgctggataaatggccaacctgggcttttcttgcttttggaaaaaaaaaaaaaagtttaccaactccctttattgaagctctggttcatgctgccttttaaaaaaaaatgcttgttgcctgtaatcccaggactttgggaggccaaggtggatcacttaagcgtaggcattcaagaccagcccagtcaacatggtgagaccctatctctacaaaaaattaaattagccgggtgtggcggtatatatctgtagtcccagctacttgggtggctgaggccggaggatcacttgagcccaggaggttgaggctgcagtgagctatgatgg

SEQ ID NO: 15291 - DNA, 20728 bp, Human
  misc_feature (1)...(20728): n = A,T,C or G
tgaggtggagatggagaagaaaggattattggaaatgggagcagagggagaaaggaaggagcttagaaaggaagaggccaagtttccagcttggatgactgggaggcaagtggcacctttgattaaaatagatcatacaatgaggaggagaagatttaggtgacttgatgagctcagagttgcacttgctgagtttgaggtgtctcaagcatctcagcggcagtgagaggtccagcaatcaataggtagatggaactgaagttcaagggagtagcgaaagctggggatacggattcagaactcaccagcctggagatggtatgtgaaaccatgagataacttgatacctcccagggagagtttatgacgtgaaaagaaaaatgggacctaaccagcattcttagagacaggatcttgtagcaacagagcagaaatctccaggtagaaacaggagaatcaagaaaatatgaacatgcggagtcaaggaaatgcaaggtacccggaacaagcagtaggcaaatccaatcacaaaggagcagaaacaaactacccagtggatttggctataaagttgtagctacatggttcagattggaatggagaagccagaagagggatggaggaactgactttgaaaaggaggaacatcgccttatcagaagttggagggggaaggggtggaggatggagaccagtatttatatgtttataggggaaggagcaaggtcaggtgttgtggcctaaattgtttttgaagtagggtaccagatatctgctgagaaaggtggtgtgagtgggtgataatagctgcagagaccatttaagaggaatgggaaggttaagagtggccactggggagactgggatgggcacctggccagactgaatggatcagtgggtgatttagtgggcccagttgtcacaagttccacattttagagactatttattctccagttgctctgggagtagagaaggtggcttgtagcaccttttctttttccaggttgaggttttgtagaaggtgttaccaatgccaagaccctcctgctcccttgactccagttgccttggctccttaaggagtcccagagtgacagagaagaagcagtggccattttttctgcaaaagctttggctcttttatgaagtccatgatttctaccatgtcatgaaagccaggtccaagcctggagttaataagtccaagatcctctacagcctcttctcagtctcatgccttccaatctctagggcagcctacatatcaaaagggatttacaggggctactctggtgcttcttttgtccaagaacctttgtctgtcctttgccattccaaaatccatcatcaccaaattagccattccaaaactgctcagcattagaaatccggagttgggtagattctatggaccaataaatggaatttttcgaaacatccacactcccttctttcctttcctatgtgtcctcttagtctaactggccccaagctcagtggccttcagacagaagcagaaatgttccaagatgattagctaggaacacaaggtacaactgaaaatccattgtgcaaacaagtgcctgtttgattttctcttcacttccctttgggtattaagcttcctttcaattcgtgtttggtttctggtaataaatatggcaccagtttcattgattgattatgaagattaaatgtgagaagtcaagaacgcaaagcagtgcccagcatgttcagcattcagcacacagcactattgtttgtaggaagcattcgcacaatgctgagacagctggaagggttgacattgtgaggggagggcccttctttcaccatcctttgcgtaaatggcttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggaggtaagtcctgctttaagccccaggaggcttcctcctaatcctgggaaatcttgatccactggacatgctaggattctttgtttctggaaatttttagaacccagcaagtagtttggaccctggccattgtcaagtgctccaggtaccactctatgtccaactcagtcatgcttccagtcatctgcgatgctccaggcctacggacgccaccctcttccttgtcccagatattcccaccagggaactaggtctctattgggatctcatctctaagaatcaccaatcctgggtgcttccctatccctgctgtctcatagcatactcatggtatccctgcccgaaaccgatctctattttccactgaagtcttccagaggttgtaggaagttatccaaagatttggccatttagggaaagtatttcccagaaaagtaaatgccatccaaatgctggcaggcttttttgcagctctttctttctgcctcgccaccgcccccaacccccattgatttatttattcatccttaatcctctactgagtactccttgtgtgccagattctgtactaggagcaaggaacatggggctcggtttggcatggttccacagtcacagaaatctacatccatagaggacatttcagggggctcttagcagcacccaatgcataaaactaagaaagggcagccattacttttgtgtgcaggtattcacaggtaccatatccctttttctctatccaatctccaaagagcctctacttccacctgagcagggaccatcctgagacctttctaggacattctgcagtactagccagctctaagcttgcctttggtttgcttactgtcaattttatcacccattatctcgctctatctgtccataagtcacacctactttgaaacaatgcagctctttatgaaggaagtcaacggatctgtttctaagaacatagacctatgccctaatcttatcttggtcttttctttcccatagctgcatgggaagtctgcatacagcaaagtgacctgcatgcctcaccttatggaaaggatggtgggctctggcctcctgtggctggccttggtctcctgcattctgacccaggcatctgcagtgcagcgaggtaagtattctgctcacctggcatctcagatgtcaaggaagacctagcaagtgaggatagaagtgcagagaaggtggctcaggtaaggaagaggaattggcagttctaaagcaaaaactcagagctagaagtcaagggaaacataatgagaaacaatggaaatcaagtcacaatctctcaaagagcctaatcagaaattcctctgaaagggcagtgggagccagttaacataatttcccatgcccatatctttgggagattagagaccccagattaaagaagatcaagaaatacataactcagtcaccttgtgctggcaagtgccttctccttttcctgaaagggctagattaagtgatctctttatgaagtgggcaattcagatacttgcagaaaggagtctcaggcttagaattagagtgcaaatttcagcccctggaggagggtgggagagggtactgagctcattggaggcctccagtggaaaaatacaatctaagaataacaaatgcagtgattccttgtcttaaaataagtacatgcatgagcaaagtttgaaaatctttttttctgaaaggcccttctaatgtgtattataagcatgtgcaaagcttgaaaatctcttttttttagaaagcccctttaatgtgtattgtaagcacatgatcctgtgtgtgcacttagctccttcttcaggcatctacagcattcaacaaaatagaactagagaagacaattagcttgaccctggtgctgtgcttggcattttacacatattatcacatttaatcctctaacaatcgtttaaggctttctttccccaaatgaggtgtatatattccaagatggttctgggggtgcctggcaaactcttaacaagtttttaatggctgtatgtttattttttatgcacatctaaaaaatataactagcacatgatatctatgttatcacagatattattctttaagatgaaactaattcttaaaagataatcattgaaagaaacattttaagtcaataataggacaggcaaacacatgtatgacaaaggtcatgacccaaagcataggaacggataaagtttgagaaccactggttcacaggtgtggttttgccaatgagtctcaggggacttaagtcacctgccaaggtcacccagccagcaggtgtagaattggatttaaactcagcctgaccagcctgtggtcttcctccttcacttctctgcctcttcatacatcacagtttctaaaactgtttttaaaaatggtagatcaacaatcagaaatggtcttgttagatcagtggttctcaactgggggcgatgccccccaagaagacatttggcaatgcctggagaccactttggggcatgctggtgggatctggtaggtagaggtcaaggatactcctaaacattctataatgcacaggatggctcctccagtgaagaatgacctagccaaaatgtcaatagtgccaaggttgggagttcttgcaatagactgtgctactggtatggaaaaatgtctatgttatattaagtaaaaaatgcaagtggaaaaaaagatgttgcacagaattaaacttatttttatttttaagaaagcaatatattttaaacttgcctaagaagaaggctatattacaaatttattgttacttctggggatgagatgggcttatgacaactttcatttctgctttattaattttaatgatgtttgaggttctttttcagtgagcctgtattacatttataatgagaaaaacaaatattggtcaaacaaggctgctgtgtgcatgatgcacaggaaagaactttgttactctgaggcagggagggaggctgtgcaggacggtagccctgctgtcctcaatgcctgtaaaataccacagaaggtcctcactgattattctgcccccaaggtgatgaagttgatgtttaattaatggaccgtgtgtgtattgtcctcattggagtccttagcacagccaaaatagagcatggaggggaaaaaatcctgtaggttctggcattgctcagtaaacccaactgcactctgtcactttcccaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagatgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacaggtgagcagcagagccctggaggaggcagctacacagccaatgagatgcctcccaggctcagtagagtgagtggagcaagtcaagaggagacaggagaggatgcagagcagcctcgactcagctcctgcccagtgagaactcaacacaggggttgagaccttccaacatttcaagccagaaattcccattcaagggtgaaatttcctagtttataaatgtgtgtagcataaaatccagaactcatgctcgttccgattttggctccatttgagaagtttaatttgcctccctgagcctcagtgttctgatctgaaaaaaaggggggggggtaacagcaaaaataacagctaatacataatgctcacaatgtccttgttgctatcctaagtacttcaaatgtattaactcatttgatcctctccccagttccacgaggtaagtgctacctaattaccccaattaggggcacagagagattaaggggctctcctagtatcacagagctggagcatggtacagctgggatttgaacttggcattctagctccagcatccatggccttaaccaccatgctgtcctttctcattttgattgaataggctaatacattccttgtccttagaatagagtcttgcctgtagtaagtgttcaggtggcagctttagggctctcacttatcccattggactgggagtcaggcttgatgcttccactaagtatcacacaaccttggcaagattcttgtgccccggtgaaatgaaagggttggacttgggggcctcaagtccagcccgcactgcatcctgatcttctctctccatgccccatcacctagacccatccactgtggaggacaagtgtgagaaggcctgccgccccgaggaggagtgccttgccctcaacagcacctggggctgtttctgcagacaggacctcaatagttctggtgagctgctcactgggcaagtaactaccatcctgagggggcagggcaggagggagggagctttagagggtcaagataaggtataaagcagagtcaggggcatggacctgaggtcaagggaatgtgggctctccaatccatttgctgtaaagccagtgggtttgcaaggataggagggcagggttggagcaaatttccaggtcagctgctgggccgtggcctcaggaaatggttctgacatgggcaggcttgacccctgagggatgaagacactgaagatgataattctgctaatgtaggagctatgttttcatagccacagggtcttcatgtcagggacatgggcagacttctggggacaagtcactactgtctctgagcctgaatgtcctcatctgtaaaatgaggataaggtaataataatacccaccatacagggctattgtgagaactaaatcagagcagtccaattgggcaggctcaggaggtgatgaatttctcgtcccaggaggtaagcaagcagagtgagatgtcccatgggtagggatgtcatagacaaacaagcactaagccctggacaggggatggatgagcctcccactgagattatttccctccatcactgaactctaacaagggcctttgatcttgcctttggcacaagcatgccttcctctgagcacactacaagtccctatggaagagagagtgttctaggcagcaggacaagaaggagcatgacacatttggaaaacggagccacagtgtgaacagggcgatgcttagatgtgcccagcagaagcaccctgggaaatgaggggtagggaacaaccaacaaccttgatctccttgaagactctttctgctcattgagtggataaggccccagagattcagtgtggttttctggggtttgggcccatcacagagtcagattttgggctttaaggaggccctccctgtacctggatgggctccaaggacagtctcagctgactgagtgagcaggtggcctgcctcaagtcttcatcagtggccagcacaatgatgagtgtccagtgggccccattgcttgcagacacatccctctgtgctctgactttcacttccatctccttctcccacaccctgctctcattttaggttcctgcgcctctgaactctgaaattccacaaatgcaccattccctctatcccatctccatgcttttgcctctcctgttcccttagcctgggatgcgttcacttgctttactgacttgcaaaactcctacccacgtttcaaatttcataccactgtgaatccttccctgacttcaccaagagactcagatagaccttcttctctgctccccctccatctgtacatacttctgtctgtatctttatcatattgaagtataataaactgttgatatgttggtgtttacacaagaccaagaaatcctcatgggccaagtccatgccttatttacttcatgttgaatgcacctagcatttgagaaggtggttggtaaagtggctcatgcctgtaatcccaacagtttgggaggctgaggccggcagatcgcttgaggtcaggagtttgaaaccagcctggccaatatggcaaaaccccatctttataaaaatacagaaattagccaggtgtggtggctcatgcctgtaatcccatgcctgtaatcccagccttgggaggctgaggcaggagaatcacttgaatccaggaggcagaggttgcagtgaactgagattggaccactgcactccagcctgggcaacacagcaaaactctgtctaaaaaaaaaaaaaaaaaagagagacagagagagagataatgtggttggtaaatatatattgaatcaatgcattaatgaatgcaatagaaactgtcttcctattagtttactatttgtctcccctattcaactgttagctctataagagtgggaattttttcagttttgataagtgttgtagccccagtgcctggcagatagtagattctcaagaagttgtgtgttgaataaatgttgagttaaaatatgatagctctgaacttggtcagatgtgctgactcaacaaggtagcatatatctaactttgattctagtatggaatgcaagtccatcctgcctccccaaataacacaatccccaagaggaactagactaaaaaaccttagcaagcctgcacataggacacttggaaatcttgaatgaggggccccctttgccagtcccacctactgccagcctaggcatgaattccatctggatcccagggaccttctagtctacataatcttctgggtcatggagatgttaccaaagagtagggaaagtgggcttccagactcatgtccattctacttgccttcatctctgctttgcagatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggaggtaagtggctttcacaccactgctgccagaaggtatgtgttgggctgatgggacctatcatagtagctctgagatcttggacaagccacttagcttccctgagcccccagggttgtgtgagagtgcacaagttggtttacataaagagcttagtataagtctgacatgtgagtttcataaacgtaagctacaattatgataatttcaattagggatggtgggggagggatgcacagagaagcaagcttgttggttcctgactcttcccaagggtcaataatttatcgttctagttttttgcctggtttcctcattcgccttcccataaagtgtcagtaacactgaaggaagaggtcccttgacctccatgagctcagaaggtagggtggctgcatggttaagcaaattgactctggaaatcagatctggatttgagatacacctacatacacatacacataaacatctgtatggttttgtttttttgccaaagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaaggtatggcattgacccttgccctttgacccataaccctggcaatagtcacatcacacttacttcaagtgcagactatgatgtccacaccatactgccagcctcctccaggagcctccagtcattcagtcattcattccacaagtattcattgattgtatattaaagatgttcagcatgaacaaggcagacatagactattccgtggctattaaagattgttataactaggcaatgcagcaacatgaaacagtgcttactaaatgtgctagaaaacaaaaacacaggacaagttcaaagttcattcaccttgaggaacaaaggtattaaacaactaattaaaccaataattacttataagcaagatgagtacaatgtaaaagaaatgtggggtgctttgggagcagggaacaggggttccagacccctgttggtggtgggtttgatggggacagaacagcttccctgcagacgtgagatttaagcagagaccagcttttatcggataaacaggcacccccgtccccagcagaaatagcatcagatagcaatttgggcaggggcttttctctgttttgttgtgtttctgtgctgaaatggggccctgttgaatcagttccttagcatccctagacttgctaggggactttctgagatgtcaaaaatccagagtgcccgtctcattccctattgctccctgggatcacaaagcaacaggatcagaaggattagacattttctaattcagtggtttccagatggtttggtgctggggctcctggttcataaaaaatcaaaatgaaagccatttatcttgttaaaattggtgtttcactgaagactgtggaatgcagggaagagatctgttgctaaaaaatgtgaacacacagaactggttctcagccccactctgcaggtgagaagatggaggtatacactcagttattccttcagcaagggagatatgtgtaacctgtcctgcagggaggatcggtggaaatcccagagacagacttgtctgtcaagtttagtgcctagaagctaataaatgctcagtttaaacgactgattgactagttcacttaaggatccaagatgtgtgtccttgccttcgtaagtgtgttaagtaagtgcagggcttgatttatgttgttctctgaggtttccactcttgtggctttctttttctcagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacaggtaacgagcaattctggaattatcatttggccttactaacgtttacaggaaagtgttcatctcatccatccccagcagacgtgtaagttgtactacatatcataaccacaatctttgacccagaaatatcactcctgagattttagcctaaaatattaatactaaacaggtgggcagggtaaataaatgtcaatattttccatttcaatatcgttgataactttggcaacaggctgattgttcaaaaatagggaatcaatttggtagtgatggattattacacagaagtgaacactggtcaatatgaaaacaatatgataaatgttgtggggtgaaatatcattaaacatgcccggctgacaaaaacaagggaaaaatgcatttctatagatcatgatttaaattatagtaataatcctagctaatatttgtcattgagctatggcacattagctatgtgccaagcaatatgtggattatctgattaaatgctcacatcagtctcataaagtgtatattactgtctccactttacagataagaaaagtaaggttcagtaaggatgagtaacctgcccataatcacttagctagaacgtgggtcaggctacagtataaaaccagtctgtttcactccagagactgtgccctcaaataatttaagccatgtgcgcttatggataacatcttggaggaaacagaggaacagaaaaagtccacgttatcatgatggagggaacccgagggactctttaattttctccactgctgtttttagaagttacacctttgcccctgtcaccctcccagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagcctgtgagtgtctctttgaactgaactcttcagagcctggcatggagcctggtacctgataggctttccatatatatttattggaattataaacgcagggagggtgggagggaggggaaagggagggacaggaagagaagggtaaaggggaaggggaaagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagggagaaaggaatacaggagggatggagaaaggaatacaggagtgatggaggaggaaaggagggacagggaaggagagaaggaaggaagcaggatgaagagacggaacgagataggtaggtgtatggatgggagggagggaaaaacgaacaataaatagatagactctagatctcctaaaggcccatatctaagcaatttttgtgtccccaggaggcagatttgataaagaaatctgtctactagattccattggcatcttttaaatgattataatcatagatgacttttttagtgcttgcactttgtcaagcactatgctaaaacttctgcatacattttttaatgtaagtctcagaacaaccctgtaagtagattattttgcctactccactgtgaggttcagagaagtccttgcccacagggccacacacaattagaaaatatcagagccagggtgtgccccagccgagaggtggctccagtgcccctgctcttgcctgcatttggaactgcctgtgaatagttggcattttccgagtgcttactttgtgcccatgtgttgcagacacatctcattttcatcttcacaaccaggtaggtattatttagttattgtagaaaggcaaagtcattggccccaaattatatagctaaaagaaagtctctacttgatgagattcaaacccagatttgtttggcatgacagtgataattttctagattgagataaccacagcatcggaattagggccatagcgtgaaccagttctggacacagttcttggtccagagctgcccattgtaggagcagtctagatagaatccaggcatttaaattttgatataataaaagttcatcatccctacagtcttgctcaagaagtcaagtccgcagtgaagtaccggccatcgacctagcccgggttctagatttggggcccatcactcggagaggtaagtggccaaatcccagtgacaagaccagctggctgagtgttgacagttaaccacagatgcctggggtcaccaactcaacttctcagggctcttgtaccacctcagtctgacccttactgaaaaacctattctttgagatgctttgggtaataatgacaatattgtcatttggacctcctgtgtgcttagagaccaggctaagctcttgcatccatcaattcacttaatcctcccatgcctatgtccattttacaggtgagaaactaagactcagagagattaagtgactcgcccaagatccccctactcatgagtggctagagttaggattgaacccagctcagtctgattccaaaacatgtggccttttccttattccacctgcttccaggtccccataattcagttccttatgggtgaggcgtaagtcctaaatcccgtctaaatgcaactttgttttctggtgaatgactgttttccaaaattcatttacagtattctggagtataatataggggaggctttccaatgactcctcatattttcatccatcctactcatgggtttacagtagtgtttagttagtgtttttatttccaccaggatggagaagtgaaagaatgaaagccttttttttcccctaaaggaattaagatgcagtaatgttggtaataataatactttctttgtgcctggcactttgtcaaatgcctttatatgcatgatcactttgaaggctcacagcaggtgagggaggtaagcattatcaccatttccattctccagagcaaatggaggctgtctcatgaagtaggctctgccctgagttttcctaccatttcactgagctctcaacttgaagcctcaggtggcatcacagggtaacttggtggaggttaggaacttccacttttgaatcagacatactggggtttgaatcccagctctgctactgactggcaaggtcaacttggcaagtcccttaacatcactgagctccagtcttctcatctgtcaaatggggatgagaatactttcctcacaaatctgttaggaggattaagtctaagatgcacgcaaagtgtctagaaaggtgcctgtgccagattctagatgcccccacaatgtggccacaaacttgctggtggttgcgatggccaggtctaggaggatgtgaagcagttatggccacagtgttgcagtcactggagcatgactgaggaaacccaccccttctgttcttgttcacaggtgcacagtctcccggtgtcatgaatggaacccctagcactgcaggtacatcattttctcatgcctttcccacagctttcccaactctcctttctcttttcaattctgccccttttatggcccagaccctatgctagggacactgacattaatcagacctaagattggcctttgagatgcccacagtatagtggaggaggtagtcctttaacaagaaatatatactgagtgcccactgtgtgccaggccttcttctaggcactgaagatgtgatggcaaacaaaacagcccaggtgcctaccctcatagagcttatgcaccagtgtggaaagtagaaaataaaaaagtaaacatggtactttagaaataaaagaaagtgatgtgatagataatgccttaaaaaaaaaagaaattcatttctttttttttcaaactcaagaacttttttttttttttaattcattttactttaagttctgggatacatgagcagaacgtgcaggtttgttacataggtatatatgtgccatggtggtttgctgcacccaccaacctgtcatctaggttttaagtcccgcatgcattaggtatttgtcctaatgctctccctccccttgccccccatcccctggaaggccctggtgtgtgatgttcccctccctgtgtccatgtgttctcattgtatagacattcatttctgtcacacataaatgaagcttagaggcaagctgtccaaggctagcggggcagcaccataaagctgtcaaagacccaggctccttccaactcatgcctccaccatctttgaggtgtggccatcatcttcatgttccaagatggcagccagagctccaacctttgtatccaggcagcaggatggagggaacaaggaagaagccaatgagtgttaaaagacattcccgaaagctggcaccttatatctccacttacatctcattggccagtgcttggtcacatgccacacattgctgtgaagaaagctaggaaatgtaatctttactctgggtgggccatgtgcctaaccaatgtttgatggctttattagcaaggtaggaaggaagaatgactatcagaatggataagtggtcagaaaaactttcagagtaagtgatgttgaagccaattgagaaaaatgagtcggaggtgcaaatgttaggggaatgagccccatatgcatgggaacatcaataattcattgcacaagtgagacagacacttgagcaaataaatgacaagcaagtagatagtacagaaagagtacataaaaggctaaataactgtattggataaggtctggaaagaatttcaccaggtagtaacatctgaatggggttttgatgaatgacttggagctaaacaagctaactaataaaagaaatatcacactcacacacacacacgcagagagagagagagagagacagagagacagagagagagagagaacatttttacatttttttacatatttatagggtactagaaatatgtcttggacaaaatggaaagcacatactattaagatttgctttcccacaaaatgacttatattggtgaacccaaacatgaaaaggttctttccatcctcaaagcccaaacttaggtggcagtttttaaatttcccaaataagtccaagatggactctctatgttccgtgctagcattcagaaaatgctaagaaaagtcacgctcattgagaggagtggttagagctcattctaaaagcagcttaggccaggtgcggtggctcatgcttgtaatcccagcactttgggaggccaagacaggcagaccacctgacgtcaggagttcgagaccagcctgaccaacatggagaaaccctgactctactaaaaatacaaaattagatgggcatggtggtgcatgcctgtaatcccagctacttgggaggctgaagcaggagaatcacttgaacccgggaggaggaggtttcggtgagctgagattgcaccattgcattccagcctgggcaacaaaagcaaaactccatcaaaaaaaaaaaaagcagcttgaagtcaagaacctcaagtctcattcctttctgccagtccttctggttagcccagtgcctggaacagtgtggtttcccagtagagtttgccaaattgactaatttctagaatgggtggtagattttggacgcttctggacaaggaggggatcagtctgatgttgagacagcctacccactacaagagggcacttgtggttttcattgtctgctatcacaatcatctttgatgttttagaattaattgaacatcaacctgtttttataattataactttttgtcatgtactgttctgaaatttatgatatttctctcctcacttctaggacatcagccagttactttgaaattggggtaatggggagattttacaatttggtagtatggcaggaaggctcacatatttctcctaggccctctgatacaagaccattatcatctgggatccacgtccttcactgaaactgagtacacagtgatgtgccaaagagatacaatcccagcagaactagatcttagagtctagcttttaaaaccaacatttatatagtgtttaccatgtgccaggcaatggtctcaatgcttaatatgaactcactcatttaagccttacaaaaatccagtgaagtcacagctgctattaatatttctctttggcatacaggaaaatacaggcagagaggtttaataacttttctgggactgcccagctaggtgtagagctgagattctaagctaagtaatcaggcatcagaggcagtgctttttaacctctgtgtctttctgccccttcagtattagtcagcataaataatgctagctgctgtaacaaacagtccccagtcttctgtgtctttagacgacagtattgtttcccactaaatcactgggggaggggatgcagttctgctccatgtagtcgttaggagctcaggcttctactaccttctggtaacttctggtaactccactatcccctgcaagtcctatcttggatcctctgcatctgctccctagatggttgatgagagagcaacaggatatataggaggctttaaggatcagacctagaaatggcacagatgacttctatgcacattttattgaccagattcggtcacatggccccacctagttgcaaaggacactgggaaaaattgcattcctgtgtgtccagaggaaaatgaaaaaaatggttggtgattagattgcctctaccatgtgagtcccagagactataactaggccagatatcaaagatgctttgcctttctcatccttgtgttgtgaaagacaaagaggccaacttatgtttgctcctgactcccaaagcccaacacttgacagtcatatttcttgtatttcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcactcgacacagatgcagcaaatagggcatcacacatacacaggcattaatactcacgggcatatagatgctgacatgtgtacactgacttacgcccttcccacagctacagataagggctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatctttgcatcgcttttgttttctttttatgtctctgaagccagcttttcctgttcactcatcccttgattaaatatggacattctagcttcacatcacttcctaattcagggaccaacagagactggttagcatgttgctatcccacctccaaattgcatcagggaatttgattttgctgcttgggtcagggtccagtagtctgggccaggggactgggaccatctagcacatagccaaaggggctgacctaatggggcaggtctgacacaaatggggtcatttcttggacagacatcccaagggccactatgatagtagcttctctaaaagacgggttcctgagaagaattgcattctgtttcccagtgagttagcggagtcatacttactacatcccaaggcaggtggcatggtagaaacaggcctgaaagagaggtcaggttctaaccttctcccctctctgaggctcagctgctcccttctgtagaataaaaggggttggtctgtaacaagattttcaaaaatttatagtagtgaaactttacaattcgacttggacaaccagagattaaaagcaaatagattcttgttgatgtcaggtggggagcttagctctcccattctgtgattccttcctctgaaggccctcaaagcaactccataataactcacagagctgccagagccgatgttttggagcaccctgagacatatgaactctaatataacttccaggagaaagtacataggattccacttagagccaatctcagctgtctatctgtctagctacctgtcatctatctatccatgtatctatctatgtatctatctatgtatgtatgtatctatctatctatcatcatctacctcctatctacctatcgtctacatacctacctactc

SEQ ID NO: 15292 - DNA, 20728 bp, Human; identical to SEQ ID NO: 15291
  misc_feature (1)...(20728): n = A,T,C or G

SEQ ID NO: 15293 - DNA, 22686 bp, Human; identical to SEQ ID NO: 12279

SEQ ID NO: 15294 - DNA, 6771 bp, Human
  misc_feature (1)...(6771): n = A,T,C or G
acgcccagctcttaaatttttcatttttgagacggaggcttaactctgtcacccaggctggagtgcagtggtgcagtctcgactcactgtaacctctgcctcctgggttcaagtgattcccctgtcctactctctggagtagctaggattacaggtgtacacaaccacacatggctaatttttgtatttttagtagaggcgggattttgccatgttggctaggccggtctccaactcctgacctcaggtgatccacccgcctcggcctcccaaagtgctgggatttacaggcatgagccaccgtgcctggcctgtgaaatacttttttttctttttgagactgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgggcgtcgcccgttcgccgtcggcccagataccggtactcgcgcgcgttagcccgcaagacaggactcggccgcggcccgcgcagcggctgaagcgccggggcagtaacggcggacgtcaagcaagtccggccgtcggttactcagggcccaggaatcacggccgccccgccgcattctcagcggcaacatgtctgcgacggcggccctagggctgccgggagagccgcggcgacgtcagttcctcctttcggggctctgattggtcagagcgcccggcgcttctggttggccggccctgctatcatcccagagtgcattgcggggccgcttcctttccgctcggctgttttcctgcgcaggaggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctgccccgcccgtggttcacaggtagataactgtctcgtgcgtgttgcgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtaagtgaacacttactcaaatccaggcttcagacgagatcagtgggtgaacacgtgggtatctgagatgcgggtgatgggggtcaggcttaagaacgttaatagtggcagttgtgggtgtggaggtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccgggttctcctgacgcttggttgttcccttgccctttggtgcatgtgggtttaacaacctgtctttctcttctaggtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtgacacacgcctgtaatcccagctacttggtaggcttgaacccaggaggcagagattgcagtgagccgagctgcaccactgtgctccagcctgggtgacagcgagactcagtctcaaaaaaagttgtacaaggtggatggttggaagcttgagcctaggctcgaatccctctcacgtgagagggcctgaagatttctggtggattccaacctggctgaagactggccgtggggggtgcaggggtctccagcgctctgccctccagcctgcttcctccctgcccacaccgcactaggggaagggcctttcctgctgcctgcggggccgcacctggagtaggtaatgccatgtggtgacgtgaatggagcagaggtctgtgccccatcacaccgccttgctgtttttactgtgggacaaaagcactctgatctgcgtgttccgggggccctcctaccagccgacttgacgggaagtcagggttcaggtatcatctgtgcacctggggcggggtagtctgcactgaacctgccagagtcccctcctcatttcactgaaagtcacagtctccagggctgtgttgctaaccttacgttctctccgtttgcttaatctattaagagccctaacaggagaggatgggctttctctgttgtctggggccctgctgttggccggtgctcttagcaagaggtcatttttctaggttgcgctgggacattgtgagtttggtgagggtcatggatgtgggctgggctgggctgggctgggccgggctgcctgctgcctgctgctcccctacctgaaatgcagctagtgcggctctgcccttcctggggctgaggaaggcttctgcaggatagctggggggctgggcaggtgggtgaggcagcctccctgctgacactc

SEQ ID NO: 15295 - DNA, 6830 bp, Human
  misc_feature (1)...(6830): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcgggctgggggcggggcgggccggggccccacgtgtccctgcccggcgggccaatgggtgcccggctttcggaaagatcgccatatatggacatgttctggggccgcgcgcgccgccgggccgcgcgggcgcgccgcttccgcttaaataacggcgggggaggccgcggtcggtctcagtcgccgctgccaactctcgcactctgttcttccgccgctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggctgccccgcgggagggcattaggtggctgtggggaggggaccgtgttacagacgcgcccgcctgagtccatccttttccgggcaggtcgcaatggaagaagagatcgccgcgctggtcattgacaatggctccggcatgtgcaaagctggttttgctggggacgacgctccccgagccgtgtttccttccatcgtcgggcgccccagacaccaggtgagtggatggcgccgcggggctcctgggttctgcgttgcggggtgggttcggtgtcgccggcgaggctgacgggtcgtcccctgcagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggtgaggctcggccgacgcccgtgctcctcccgtcctttccccagtcattttctgcccggcttgatttctgacatttaagtgtttctttcgctgttccaggctctgttcctctcccggcatttcctccctgaagcctccaggtttctcatttggtttctgcctgcgttcttttcttttctccacacatcacactggcatgcagcatgttgtggcgtgtgagcatggggtggccgtgggtctctgtccctgactaagccgccccttgtcccttctcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtaggtgttgtgagctaaaggtttctactcttacatcctcggtgacacagcatcactaagggagggctctgtcccctaggtatggaatcttgcggcatccacgagaccaccttcaactccatcatgaagtgtgacgtggacatccgcaaagacctgtacgccaacacggtgctgtcgggcggcaccaccatgtatccgggcattgctgacaggatgcagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaatgaatggctcctgtttggggaagtagcaagtgggctgggaaagacagaccaacctggaagtattgggtagtcttgggggtgggggcggtgggtgctgctcagcttggcttcgtgggctggtgagaaaacggcttaacaataaactgagcagttcgatttcttccaaatcgaaagtgcaagaacaaggcagcctagtgggtttgggtgttggagataactgaagcaacatcataagcaggctgggagggaagtcctgagacggctttttccattatttaggaaaaactagatgacttgacatcttgggtaaatatttggcataaaataaccacctgaatcagcaggggcctgccttagtttccccccagccctcaggtggacgtgggatatgagatagttttactttgtgtaaagagcgcagcagtcatggagttggctagttactgaatcctggaactcagtatctaccaataacgagggcctcacctggtgtaagaggctcagccagtgccctttgtacttcagcttttctccccgcaggtgccaggggagagcctctgtagatgggattgggagtccaatgcatagctcctctgaactgcttacagctgcagaagtcatttggaggttgggacagggaaggaagatctctaccagttgaaaagagatttggaactatttcatgttaagtcgggtcaagggatcgttctgctgttggaagagattttactcaagcagaggtggtggtgcttcctagctccccctcccatatggggatgggggagaggaggctcaagcttggtgggggtcggggtggaggcaaacataaattgcagagagcttactgagctccaggctcccaccctacctgttgtgtgaggggatcttctagagaaggacgtgggtttttagcaagcagtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15296 - DNA, 23669 bp, Human
accttgcacttagtgaggtcggaaattattaaattggggcttccacactacacccagactacaccaggagaaacagaatcatagttcacaacgcaaacgaatgccaggaatggtcagtgagtcaaaggaccagtcaaaaacaatcacacttgtgactagactcgtggctgcattaaacattgactcattggggttccaggggccaaaagactggcctttctgcctccctgggactgtgcttgaaaacgtctatttgccacttcagaaagcacagtatgaggtcagcatctgggcccagggcagctgcctcattcaggtggtggcagtgtaaggaggagtcgtgtaacgcgtgtcatcagattccagttcagttcctgggcatacaaatatgaagacttcattcctgccttcattgtaacaagtattcattgcagttgggagacagggtggggtgtgagacacacagccactgaatttcaaagcaacgtgataatgctagattatctgtaccttttcaaacgtgtatgcctagaacccaggactgtgcctcgcaaataaaaagtgttcaacaaatactggctgaatgaataaagacagagttgtatagacatagagagggcaactagagcactctgggagttgtaaaaagccttaaagaggagataactgtttgaacttttggaagaattagtttaattcccaggcgaaggaggaataaagacatccctgaatttatatctctcttttccaagaaatccatactcattgttctttatccagccgggattcagacagcaagtcccacttgccaagagtgggtttatcaagcatcaaacgggcccgctggggcaactatgaaaagtgtagttcacttggtgcaaactcacctccactgtaaaagactttgcttctgaataaattatatgtaatgtttccatcttttcacatctttcatgactcaatttttttttgctggtgcaattttcctccttggttcttcaagacgactgcaacggatgatacagcctgggttagggggtaggtaggagggaaggtaggagtggttagaagtccaccggggtggccgggcgcagtggctcacacctgtaatcccagcactttgggaggccgaggcgggtgaatcacccgaggtcagaagttcgagaccagcctcatcaatatggagaaaccccgtctctactaaaaatacaaaattagctgggcgtggtggtccatgcctttaattctagatactgggaggcaggagaatcgcttgaacacgggaggcaaaagttgcggtgccaaggtcgtgccattgcactccagcctgggcaacaagagcaaaactccatctcaaaaaacaaaaaccaaaccaaaccaaaacaaaaaaaactccaatggggtgtatgggtgggtccagggaagcttctggttcaacgatgagagtggttgattttcttaggtcacagcgtctgacctgtggagccgggtatgtatacaccctaaggcataattagctcaagtgttgtggtagtttattctagcaaaaacatctttaaagcttacgttcccatttatggatctaatgaggttctgctgggattcaggaatgagagcgttaatctttgcagcattttctcgtcacccggcacacccgctctcaagacgcctaccgaatagtctactctcgcgagagtcagaaaaaagtcaagctttttattaacaccgcccccagccctattagttaccaagcaacagtgccaccaggctcctcggcgctgggaaactcaggagcttgtgatctctctggttccgacttccagccgccttcccgagccagttaggcgattgcgaccctgccccgccccctgggtcctgcaggcgcccgattggtggatgattctctccaggtgaggacctacgcgcgagggggcggggccagacgggctcacatgatttgccggcgactgtagcgccggtcccggccacaagctgtcggctcggttcggtcgcgttacagggcaggcgccggggccaaggcagggagggatcttaggagagatcgtagggtgagccacagctgcgcagccccgggtagggtctagcggggcgggatgtgggggctgcgtgcccccggatgaagtgcggggagaggtgctggtccccaggcatggcaggcagcgcggacgttctgggaccgggagccacagtctgtgtttgggttggaggatttgtgtggtcagtaaaggaatcgtgtaaggctcttgaaggcgcaggatcttccgtcctcaccagccccctgttgtctgaattgggggcatgagctcaggactttcccactccagtttgaatcagggcttacccctcttcctgaggtgaccttggggaagtcatttaccacctcagcgctccggcgttctttagactgagtcccgggggtaactagggagagggtgcggagcagggcttgagaatgcactagaggagaaatgacgacgtgctagggctgtcttggggtccagttactgtttttccttcagggaatatgttcgagattttcccacgtccctcacttttttcttttctttctttctttttcatttttcattttttttttttttttttttgacagagtctcgctctgtcgctaggctggagtgcagtggcgggatcttggctcactgcaacctccgcctcccgggttcaagcgattctcctgcctcagcctcccgagtagctgggactacaggcgcgcaccaccaggcccggctaatttttgtatttttagtagagacgaggtttcaccatgttggccaggatggtctctatctcttgacctcttgatccgcccgcctcagcctccccaagtgttggaattccaggagtgagccaccgtgcccggcctcactgtttgcaaaactgagtcctaccgttagattggagttaatttcctggtaatgtacttcgtctatacataacccaccccaccccaactgctgccactactctgcccagattcttaaaactagaatctgaggtcatgaaaccttgagcaggacacttaattcgatgaatctcaaattttcaatctgtaaaatgagaagaaataatggtggcaaaatctgcctaattacaagattattgttaggactgaagaagataacgtctgtaaatgtagactcgtaagtcagaagataaatgtaaggttctagtgcaactctttttataggtgaggaaacagagggctagagaagtagctgctaactgggagaaacaggactgaacctgcctcttggcccagggtgtttttacttataccacacggatccaatgcactgactttttttaagttatgtcttctttcttccccttcccttttttacattctacttctctgtttcagacatctgaagagctgccatgtctggggcatcttcctcagaacagaacaacaacagctatgaaaccaaaaccccaaatcttcgaatgtcagagaagaaatgttgtgagttctggcagagaggagggactgctctctctcagcattttatcttgggaatatagttataatcctggactctgctgcttggtgggagtgataaataattatttgacatggaaatttaatgcaaagtctccagggtagaatgtcctgtctaaaacaagtagacttagtgaaatgtctgttcttggggcttgactactggtgtagtccagcagtttcttactgctttcttaaactgaatctctgtctcctgggatgtttgcacactggcttgctgatggaagttagaactaacattattgtacacacaatgagtaaggcacagttgcaggtgcaggaattacttggagctggtaatgttaccagctttatctgttgggctaagttttgggagagtgctgctcattgtagaaattgcagatgggagccagtgctgcttggtttccttcctacaggcctgaggggaatgagccctgacacttggcttctcacagtgtcttgggcatcttactttctcacaggtttagcctttgtactttgtaaactattttccctataggttcatttttttgaggacagctttcacatgagcattttcatttctatgcctgtcttttagatagaaacagcaggagggtttgcgaggagatgaagcatcatttcctgtccccaagcatctgtatttctaagcatcataggctgcatagcttcccaaaagatctgggactctgttccccacatattttggggaacttcaaggaatgctaactcttgcctctgcttctggatggcaccattcctgcagaatcctgtcagtcagttcttctcacttcagtggttatatatatatatatatatatagccagttagtcaaggaatatatatatctcagcaggtggaaacagccgaccagcatgagaccaggaattatctcatgttcaaagcttttcccagagcctcgaccttgatgtcatgcccttgtcagtttcatgattgacaatgataatctctcttcacctagcacccatggagcctgctggacagaagcagctggctggatgtgatactggggttggcagagttagggtctacaattagggtctcttttctctgccagggcaagaagccaggtgctaagggcagaataccccatgagagataactagtatagcatgatgtttgagtatagcctctggagtcagactgcctgagtttgaatcccgggtttatgacttcttagctcttgaacaagttgcttgttctctccatgcctcagtttactccttttaaaagtgggaatactaacagtgtctcccccaagagtgatgtgaggattaaatgactaaatgtaggaaggcgcttagaagagtgttgggcatatatctaatgtgtgttatttttcacaggtgactcaatctgcctgttgtatttattcctgaaatgtttatattgaatcatactcaaatgctgtattggaagctcactatttaaaagagggctgtgaataattattttttcagtaaaaaatgttttcttctcttatttgacaatattgtaacccagatttggggatctaggatgcacctcttacagggaggtacactaatgttactagggtgcttgatccaaaagagagctggggctggggggcaggatcgataattgtgggagtctctgactacacgatgccatgtgtcagtccttctagctttgcttttttctccatggtaggaatctcttctacctgctttcctaactcttctgtagttcctttgccttgagggctttcaagtcagggaagcagtaatccctggtttctttcctgtcttctagactctaattcctgctctgggctctaatctctttttttccatactctagtttctctaaatgcctttttcttctctaagaagaagaaggtgtcctaaagccactgtgatttatttaccctattctctcctcacgtcacagtcgggctgtgagactgttgcagacatagtcaaaggagaaaataaagttatgagtatatgtgttaacttacttccttttcctctgctatagagctgtactttggagctggttcacctggcagcttagtgttcacatcagcggctgctttattaatagcttaaccgttgttcccttgctgctcattacacctgtgttggctaactttgactccgggaagtgactgggcttgaggatttcagggctgaagaatgactttagggagccaaaacctccgaaggagcattactgggacttcaactgctccagggatggggcgaagaggggctactggccgaggtgcctttacggtgctcagaggactggtttcagggcttatgaaagcagaaatggagggccgggtgtggtggctcacgcctgtaatcccagcactttgggaggccgaggagggtggatcatgaggtcaggagatcaagaccatcctggctaacatggtgaaaccccgtctttactaaaaatacaaaaaaactacaaaaaaaaaaaaaaaaaaaaaaaaaactagccgggcatggtggcgggcgcctgtagtcccagctactcgggaagctgaggcaggagaatggcttgaacccgggaggcggagcttgcagtgagccgagatcgcgccactgcactacagcctgggtgacaaagtgagactccatctcagggggaaaaaaaaaaagcagaaatggagaaatctacatgctttttttttttctttttaatttttttttttgagtagttctggaacagacaaattcttccatgtacctttccctaaatacaaaagcaatgtatgttcataaaaaattcaaactacagaaaggatttagaaagcgaaaagtaaaagactcctgtttcttccaaatttgattcttttagacatcttattctggtatatcctattaataaaggtaggttcatattgttcatattctgttcagctgccatttccttttttatttttttaaataagttactgtcttgtggacatccttttaatgttgataaatgcagatttacctcattctgcattgtatggatatgccagctttccacggataggtatttaaattgtttccagtttttcatcatcacaaagagtgctgcagtgaccattcttacacgtacacctttgcacatttgtgacagcaacttttcctacagaaataatagaaaagatagacacattggaaatgttcatcagtattactaatttgctctcctaagaagttctatattgtaagctgttttcaatattttaagatatttgatggaaattgggcagcatcaactatagccatagtggttaactgaaacatcagctttcttagtgtttgaccgtagttatacgaacttggttatttcatgcctgtcaactggcaggagataatcagcagttctgacttctgatgaataaagataaaatgtcactaatgaaacatgctttatgggcagcatatttctaaatattaggcctctttagagccaataaaagaagacgtcctgggtcctgaaaaggctgggaaccattgctctcctagaccatccttcaggattagaatggagagcaagttgtgtttaccgtgagggaacctttgtcaagtgctgacatgaggcacaggagctggcagctgggactgaatgggcagtcatgagatcaggagactggtcagaaccctgaccttgactgtctattgtgggaccatgggcaaagctcttaatttctccaggcttgagtttttccatttacacgagggaagttatcaagtcctcattttttttgtaaatcttttttttaaaatacatttatttatttattttgagaccgggttatgagactggctaatttttatatttttagtagagatagtgtttcaccatgttgccaaggctggtctcaaactcctgggttcaggcgatccacccaacttggcctcccaaagtgaggattacaggcataagccactgcgcccagcctcaagtcttcattttatctaagcaagtttatgaaaggaaaatgagtttaagtttaagaaaaggagttgaacctggcttaaagaaggtggaagagaatttcaggattgaaacagttttccattgtctatcaagagatgggttacattgtctctgaaattaatcaggtggcagtggcaggtggttttgttttttaacaggcaggacagaatgttcctacttttgccagtgtggtaatttgagataggaagtgtggtttagttttgtactccagaaaatgagaagccctggttgtagcaggtgtgcttaagtgtattctggacagaggcgagaggtgcgttgctggagggctcttgggaggtcccagtggatgcagttttttgttgttgttgttcttagcattctctgtccacatgggtaaacaagagcagctggttccctggttgccttcagagcagctcccaagtatcagttcattttaaactttagggagggtaataggaccttcgggggaagtgcctaatgggctggaaggtgcggacaaagcaggcctagaagtgcaggtaatgagccaaatcatgggggattgagagcaggcattgagccgagctggagaaagtgaagactcaggggattttactacttaaacctgagacagctgatcccatgcagaggctatctgcttgttaggggccagtgatcagggattaatgccagctgaggcttcagggtacagtttgcttgcctttaagctccctatttgaacacagatgaaaatcacttatgttgctcctttacctaccttggaggggctcctgctgagactcaggaattttccatgtgtgcagtgggtaaaggactaaaagccaagccctctgaccccaggtctgggcctccatttctccctcctcaccactagggtcactctgagtacttcttgccaaacacccttaggaaacttttccttccgagggtggttctctacctgggcccctcctcccacttctccattgagatctttctacatttatttctcaaaaaatgaaagtcatatttcccatccaagtacctccattttacagaactgtttcttaatcttacaaggtcccttagtaccaggcagaggggcagccgcaacttgcagggcaccttctgggaagcagtggtgggaagtgggaggtgaaggtgtttcttcctttttcccccatcctgtgcagggccttccctcattggagccggcagagcctgagctatcccagatgacctcagtgtggtttttggccccgggacagtggctggcagcagttcaggtccttctcccacctctcctctgcagcaagatgggccgggaggagccagcccctgtgagcaaagtgatgaggaacctctttttatggagaaaagctgcaaggaagcacaagatctgtgttctagtgccagctgtacccttgactcattatgtgtccctagacaagtcacctgtcccctgaacatgtagtttgccctgcctgtccagtgagacttatctctgcaaatgagcattcctgaagtaagttaatttactaaggaagggtagactgaggactgttaatgcttctcaattgtcttgcttttacgtgggccatggtggcagattggccctgatgccctttgtgggctggctctaccctgaagcttcctgaggtctattcagaatgtgtatcaagtaagctttgccaactcaatctcactatggtttagaaattctggcttaaagaggagctcatgacctgagtgaaaaggccaaaacagcttgaggcagggctttttgcagtgggcaagctaattcttgcccatggttctgaagggatgagtgggatcctggagacagaaactctgttggacctattataggagccagctcagttctgcactggtagaatctccaagcattagaccttccttcacagctctgtcatttttatatttctaggcattcttatgttaaggatgatgtcattgttacttttctttctttctttctttttttgagacgaagtcttgctctgtcgcccaggctggagtgcagtgacgggatcatggctcactgcaaccttgaactcctgagctcaagcaatcctcctgagtagctgggactataggtgcacactcccacatctggctaagttaaatatatatatctatatatctatatatctatatatatctatatcttaaatattatatatttaagatatatataaatatcttaaatatatatattttatatatatctttatatatatctttatatatctttatatatatctttatatatatctatatatctttatatatatctttatatatatctttatatatatttatatatatctttatatatatatatatatatattataatatatatattttaagagacaagggtctctctatgttgcccaggcttatcttgaactcctggcctcaagtgatcctcccacctcattctcccaaattgatgggattacaggcatgagctgtcatgtctggctgcagcatggttattttctttcttagccttgctacttttttcctctttccaccttgggtactgcagtgaagacctcagacatgtgggaaagacgtatcttggtttgggcattttctggaagcctgcataaccttttaactctatttcaggaggcctgcctgatatctccttatttgtcttcccagacttgctgaacctttgctccacaggtttatgaagataaaatgagattatgactatgaagttcgtagctcagtgtataaaccttactagaccccagcggggctgggcgcctcacgcctgtaatcccagcactttgggaggctgaggtgggtggatcatgaggtcaagaaattgagaccatcctggccaacatggtgaaaccccatctctactgaaaatacaaaaattagctgggcatggtggagggcgcctgtagtcccaggtattcggaaggctgaggcgggagaatcacttgaacctgggaggcggaggttgcaatgagctgagatcacgccactgtactccagcctggtgacagagtgagactccgtctcaaaaaaacaaacaccaaaaaaccttactaggactctagtcatttcgttttattttgtttcatttccttctagcatgggcctcctacatgaccaactccccgactctgatcgttatgattggtttgccagcccggggtaaaacctacgtgtccaagaaactaacacgctacctcaactggattggagtccccaccaaaggtaagtgtggctcattccctaggaaagacaattattagttcctgggcctcacaggtctctgggagacttattcttcctggcatcaatgctatagggtgcttttggcagaaatagcagttgctttctggtttactggagttattctctattcccagacttgtctcctcctggcgtgggtggattggcctagttttgagggaatgcctttgataggactgttaagatttagatgagcatagggctgtaccttttcagaagccttacatggacatcatcttatataaccctagcagtgtctctgtgaaatagacagagtggctgaggaaattgaaacctcagacagcttaagacttgtccaaggtctagaaagtcagggcttgaacccaactcttttgactcttaatctgatattgttcccaacctaccatgctgccgcttttttcatccccttggtcactccgacattaggccaagaaacaagtcccatttggtggggccatcatattattttgctgctgaaggatttgggtgtcttctacagtgtttaatcttggggtgtatcggcgtgaagcagtcaagtcctataagtcctacgacttctttcggcatgacaatgaggaggccatgaagatccgcaagtgagtcttgtttaaggcctgatctccaggtcagctctttcttggccgtcatgagacttggtgtgacagggcttggtttcatctcagtaaatatcttaaggggaagttaaatggaagttatctgatgggcaagtgaccttgggcttgggtggtcagaagaacagggctcagggtgattgatacctgtgtgcttgtaggagaagtctaaagagggctaagatctgtgcattggggcaggggcaggaaggggttataggatggtgtgaaaaccctcagtgagaaagttgaaagatctagttagagaaaggttttgaacagtgggaaactaagtgggcagggatgtgacttctgtagccacccgaatgtttgtgtctctgactgtttgagcttagctctccttgctggtttcatttgctcttatggcagacagtgtgctctggtggcgctggaagatgttaaggcgtatctcactgaggagaatggtcagattgcggtaagctttatctgctgcttcttctttctggtccccacccttgcagcagcctggctacccagccccaccttgagtctgccctggtggggttctgtttctctgttcctgctcatttaccttgtgtactttcttcacaggtgtttgatgccaccaatacaacccgggagaggagggacatgattttgaactttgctgaacagaattccttcaaggtaggatctgactccatgttggaggaaaagggatgagtagaggtggggagtcaggctacaggcatggatctctcactctagtgggtgaggacaggatgggatatctgaatctcttctctcagagcattcccccagtccttgagtgttttcattcaggtcctttctcagactgttagcctgtatgtttgaggcccaggggctgtggtaagagctatgaggaggacttgagggccactttcatgaagaaaatcctgggagatgtggtggctgggtggggtagatgagcatgtgctcttaattaacagcctggcatttttgacttgcttatcactgccttctctccatggccaggtattctttgtggaatccgtctgtgatgatcctgatgtcattgctgccaatattctggttggtgacacccctacatatcatctcctcttcaccttttgtgctgtgtgtgttgtggggtgtgtgtgtgtgtgtgtgtgtgtgtgttgttggggaggggtgttttcgtaatgaaagagagaaatagacatgtttaacatcacaaagagatcttttctatctgccagagccccatctggtacttctacactcttctcttgggagaggaaactgaggctttaaggaatcaagtaagaattagctgttgaattgaaaccagggtttaggttgtaggattcttggccctgtgctctaggtattatctggatgttgagacctagatgttggaatagatcagccgggcacggtggctcatgcttgtaggctcagcactttgggaggccgaggcaagtggattgcttgaacccagaaggatcaccttagcctgggaggttgaggccacagtgagccgtgattgtgccactgcagtccagtcttggtgacagagtgagaacatgtccagggaggttgaggctgcagtgagccatgattgtgccactgcagtccagtcttggtaacagagtgagaacatgtctcaaaaaagaaaaaaaaaaaagaatagatcagactcttcgtttcaggacttacctacaggaaggttatctccccagcaattgtccaaagttctcgtcagtgttctatacattgagctccttattccctgtggggtcacaatgtaagccagtccccattggatgggttgtgctctgctggaccgagtagatatctgaacatggtcttatgcaggtgctctcccagccgtaggaacttgggatcatctgaggaagagccatctggtcccaagtcaggcactggggtcatgcaccctattctgagtggtaatagggaaacattggagcctgttctgttttctcaggaaagtacataaagggattggggcccaggagcagctttggctgcgtgactgcctctgtccttcagccaagtgcaggcacatgactccccagttgtcttaacttttttggttgccagggtcacaggacggggcggggcggggcggggggtactcaatgagtggagtgccaatgttccagtgaaaggcgacatttatggacttctttttcttttttttagcagtggctatttgtaggaggactgttacgggcagacctctgatgaggcctttactggttcctatgatttcaggaggttaaggtatcaagccctgactatcctgaaaggaacagagagaacgtgatggaggacttcctgaagagaattgaatgctacaaagttacctaccgacctcttgacccagacaactatgacaagtaaggtttaaggccatggtttgaagggcccaaggcaaaggtctcatctgggaaaataacctttctccctgagttctctaacttccttctgataatctagatctacagtgttaacatcatcccagagaaataaggtatggatttgtggcttttatgtggattgcatcttgtacatgaaaaattgaagtggttggttttgttttgttttgagacagggtctcactctgtcacccaggctggagtgcagtggcaaaatcagggcccactgcaactgctgcccccggggctcaggtgatcctcccacctcagcctcctgagtagctgggaccacaggtgtgcgccaccatgcccggctatttttttttttttttagtaaagatagagtttccccatgttggccaggctggtcttgaactcctgagctcaagtaatccacccgcctcggcctcccaaagtgctgggattacaggtatgagtcactgcgcctggctggaagtgttttttatcatcaattttttctctccagtctctagagcatgatttcctcaatctcagtattattggcactttgaactgggtaattctttgttgtaggacctgtcctgtgcattgtaggatgttcagcagcttccctgggctttgcccactagatgccagtaacacctccaacctgtgacaaccaaaatgtctccagacatgtcagaggttccccggggggcacagttatccctggttgagaatcactgctccatatctgaatgggggtgttgtaggataccctttggagatgtgtcatcagtttttaaagtttatatatattatatgatattttacatatattaatgcttgtgtgtatatcatgcatattatagcataacatatatattacatattgcatatttttatatctatctctctctatatataacatgcaaagccctcaagaacatgcctgactcagagaaatgtctgatcaatgccagctgttgttactatggaagcatttgttggcagtatggtgtagactatagattaacttgtcatgtgtgaggtatatgagccataacaaaaccaagtctatgttgaagaaagatggtgtacacatggaaatctgcaagaatgtggcctcatgaaagagcatgcattcagggcagttaacagctctattcacataatacagacctgcagccaagcaaatggcacatttaatgtgcatggcacacttaatacagtggtctgtttaatgttttgagcctttcagttccttcaagtgggtttcccagaatccccttaattcagaggctgaaaaccacctctagatatggcataaaagtattcttcagttggaacaaagtcccacctagaaaaacatacagaagatctacatatatatacatgtgtatgtttgtatatgttatctctggtagtagggtgatgcgtgatttgcatccttccatcattttttctgattttttgatttaaaataagcacttatgactttttttttgagatggagtctctcgctcttgttgcccaggctggagtgcagtggcacgatctcggctcactgcaacctcccccttcctgggttcaagcaattctcctgcctcagcctcctgagtagctgggattacaggcacccgccaccacgcccggctaatttttttatttttagtagagatggggattcaccatgttggccaggctgttctcaaactcctgatctcctgatctacccaccttggcctcccaaagtgctaggattacaggcatgagctaccgcatccagccacacttatgacttttataaagagaacaatctcatgttggcctcaaagcaagcaatgtctgaaagtgtctttgagagaagcatgattaggtagatgcagggagtatatagacatttctgtctgtgcttctgctgcctcttcccttcccctcgttgctcgtcgtgccatattctggccaggtcttaactgcctcaaaaggggcctattcttctcaccaaattttgggcttagcaaaatcttcaggtcacctagtctagcccctgatgggaaggctgaattctgtttatcctatttatctacattacttgtcacactacaggcactgaggaaatggtacaaacttactagaagttcaggaaattgtacttcatcttggttttaaggagtaattaatctcctaccatttggttccataaacgtgggtgtgacagaggaggggaggaagagcagctgtgagcctgcaagtccctgtagaaatccttttccctctgattcttattctcagatcttcttacctagggaattttttttttcctttcctgtcccagggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcaggtgagtaattattcagcacactggattttctaggcttagagttagaagggcatgactgaggtcatatattttatctccttacttaaatcccatttggacgtaggctgtggtttcatagtcaggcaagtgctcaaggtgtgttcttgctcactgcgtctagctctgtgttaaagagtagataactttgacccatttctgctgtgatcattcaaccatcagatattcattgggcacaacttgtgtacttagcaatgtacagggtgctccagttaaagttcatttccttttgggtttatattaactatgtagcaccttatggattttgaccatggttatgcacgttgtcccttacagaccaagttagcaggctttgtgtatgtgtgtgttgagtgtgtgtgtgtgtgtgtgtgtctgtgtgttttctttttacccttaattttcatttttaaaccccagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctgtgagtaggaagctctgaaggcccagaaaagccaacaagagttcaggcaggaactctcagaagtcactatttagacagttttatctaggaaactacaaccaacaagtaaaaactctgaggaagctgactctatggccagcccgggggatcagggaggacaattgtacccctaatcaggggtttcctgcctgattcagtacctgtgccaatcatgggacccaaaccaatttttgagccagcctttctggcacctggggaaagtagggctaacaaggactcattttgttcctttgtatatttgcctcctgggaaaaataaatagctaacaacccacttctttgctttctgcttagatcatttggtcagctattcaggaaaagtttttcccaaaatttctcttggctttctctcttcttgagtacaaaagtagacatttctttctttttttttttttgtgacacggagtctcgctctgtggcccaggctggagtgcagtggcgtgatcctggctcactgcaacctctgcctcctgggttcaagcaattctctccctcagcctcccgagtagctgggattataggcacctgccaccacgcctggctaatttttgtagttttaggggagatggggtttcaccatcttggccaggctggtcttgaactcctgaccttgtgatccacccgccttggccacccaaagtgttgggattacaggcatgagccaccgtgcccggccgacatttctttttctttccttccttctacccttttatttttcatgcaaggtctccagtcccttcagtttccctccttctctgcttcctgttccttttagcctcttgactttcttgacctgtaagttccccccagtagtaggagaatgtggtagcttgagctagagaagttgcctctttccggcagtggtcctcacccggtgagtcacagacactctgtgacactctggtcacaggcagctgcaatacatgaaaggacccagcacagtgcctggcacgtactaagaaactagcattcttcaatgtcatcttccttatttgggatggggctggtgtggtacagtctatctcttcaagccagcttcaagtggctttttgcagggtgtgtgtgaagagatgacctatgcagagattgagaaacggtacccagaagagtttgcacttcgagatcaagagaagtatctgtatcgatatcctggtggggaggtaagacgcccctgtcatgtaaagtgactgcctagacccttgctgagtgtttaactttaatttgggggaaggattgaatgtgatttggagggtctaggcatcatttatcttccttcccttgggtcattttggtttcattcagcttagacaatcgaatgcctcattaattgttaagattcccagggataagggtgacaaggcatcctctgttcagtatgttttagaatcaacacaatcatttttacttctttttttccttgtactctctgaatcccacccccacataagtaagtggagtcaccaagtaaatatatgggataggaattatttccctgtcatcttgagtgttttaggctatttccttgtctaagtggcttccatactctagggatgtgtgaggcaaaagtaaataaaactgaatggcagaggtacaggaaacccctaggagtctcttgtctcactgcctgtattaatctgtgggaagaaaaaacacaacacacacaggttgaactcacacttcctcttcttaacctgtagttttcttggtctaaatattgcttttgaaagatctgagttttctcaagagataccagggctgggggcagttagcaggtgatgtaaactcactgagcctccaggaggaaagccagctgaggaagaagaagtggcccttagtctccaaggtccagccactgacttggctgccagcttgcacctgggctcctgccagcctgccccatttccctccacagtcataccaggacctggtgcagcggctggagcctgtcatcatggagctggaacgtcagggcaatgtcctcgtcatctcccaccaggctgtcatgcgctgcctcctggcctacttcttggataagggcgcaggtgcctttgagggaggggctgggagacacatccagtgggagagggctggacttgcagtggcaccaggattcctgggaaacagacctccctgtctccgctcaaattagagtactttctccagacagcagtgtggggctcccagcagccactgagtcaatgacttgctgagttcactctgctgctacgaaagcttccaatggagagtggctgctgctggtgctccttgatcctgcctggctcaagggccagtgtcatgctgacactcctggcagcatcaggacagtggttgaatattcccagcctgccacgctgcctactaggagggtggtatcttaggagcagcagttgtttctgggtaagggcagtaagaaggtgccgttgccttcttccatacttcgcttcccgatcttcgggagctcctgggaagcctgcattgtggatgctgagctcagcatcctgagctgcttggaagctgttgtggtcagaccttattggcctttgctgtacccaggtgacccccttccattgggctctctggctacaatacttcctgtttttgcctgcgtggaaggatctaagatggccttatttccttccttagccactcagaaggttgggtggctttgtggtctggggtttaagggaggagttgtacaactctaagaggtggtcaaagtaagggaaactcattatgagctctgtagattctttcttccactaacttgaccttactccataatactaagagacttccctcgcctggtctttctgttttcagatgagctaccatacttgagatgccctctccataccatcttcaaacttactcctgtggcctatggtaactatgcacataggggctggcaggagctgggaattgaggaaggtcagaattttctctgaagtttgtctagagttcagcttcattatccctatataccagggaagctccatcagtgccttctgttttgaaagggatgtatgcatgactgtgtgtattgcagaatgcgtacattcctttgtggtatactttcccataactaaggaattttccattgaacctttttctttaagtcctctctttcctctgttttctcagggtgcaaagtggaaacaattaaacttaacgtggaggctgtgaacacgcaccgtgacaagccaactgtaagtattttcccacgatgaacacaccagtttccctgccaccttgagtctctgaagctttgacatcaagagactggggtttcttttatgtacaaaagggaaacagattcagaacttacgtccaaacgtagtttgctacgtctgaaactgatgttggaattattttttttttaaattagtacccctttcatgagtcttaaccttgaatgttggctcctggaaatccaattaaatatggaaagtgtttggctgaagtgaaatgcaaattactacccccctccaaccccaagtgtccctttagaaagcagagtccagaggagcctataaggtgggggtcaagaggtgtaggtttgttcctaggtctgtcactggtaatctgtgtggtcttcaataagccccttcctttctttgggtctttttcctgctttggaatgttatgctcaaggagcttctcccttttagccccctgatgctaggaggccaggccatgggccatgccctgtgagggaccctgtgtgcagaggagcaggagtgagggaagctgttgtggttacaagcgcattattaacctgtatgagtgagcttttggcttggctttcatttgtgtggtgtcactccatttccaatcagaacaacttccccaagaaccaaacccctgtaaggatgagaaggaacagctttacgcctctgtccagttcgaatacaataaggcgtccaagaaattacagtgttgggagccggcccctcaagcccctcagccctctccgtgcccaggacatgcaagaaggggccgactagccgaagacccaagtcagcattccggtggtgtaactgtgtgtttccctccagccctggcctcctgcccttgtcactaatcaccaaggagtcattaacttcctccctctatgcccacccctgacacttcaccattaatcttaacacagaacatgaggttatgtgtttataggacaacttaagctgttcttcagtttgaaacatcttttcacccaggggcaagttagcaaattgagtcttttaggacagattctcagatgggatgatctggaggaggaggaaaaagatacactcccttggggctgagcatgccccacactcttggatcttctctctgttccctggtgtcttcactaatgtcctcatgttggtgaagtgttgggggatggagggcgggtgagcagtcgggggacaaaaagtctatttttccttcacttttgtctcttcaatgtgtgttttcctcacactccttacttgactgctttcttcccccactttcatgtcccctctggattgtccagtgtaatgcatggcattgtggtgtctgtctaggaaggaaggggtgattgacaagagacaagtctggcccagttaatgctttctgcagtgggtctaaatggatctggactggaggagtctttcctttcctttctcccttcctctccagccaggtcctgtaagggccagcccagactacaggacatccacagaatattctggagcttgcaagtagacatagggtgagagttcttgcctcctttcatgagaaacagttctaagtcttcgatgccctgggagaatctggctctgagcatgtgggaaatgtcttggtttttatttttaatttagagtcaggcctgggtcttttgaggtctgcagagtggggtttaggagagtagggtgggctctagctcttgcagggctcttagagagcagtcatgtcttttctcccatgactctcaggttctttgccaatcacagcaacttttcctgccaaagccagtatcctctggggctgtttagaagggcagttagattcaggagtcaccactgatgtttgagttgctcaaggcaagaggcagagaagagttcactaaaactgcttatttttgaataatttcagcacactgtccttaagaagaaagaaacatcaaaacaaaatagtttttacatgaccatttttttcccaaatgtggaaaagcttgatgatgaatttaatctctctcattggagtattcttttgttcataaagagaaactatctcatcttgatgtccagagaagtccttggaaccctgtgggatctagctcgtaactgtttgtatttctctattcacttctgtcatttcattttctttgtagggttaaacagaaaatgtttagggaagaaattcttagccccttgatgaccatgatggcttattctctttcccaattttgcatgcaaaatgtacgaatatatgtatgtttttctgagaggcaagtttagggttctcatgggattttaaaaagagataggtgactccccaccttaaagttatctgctggtcttttagaggtaaccagtgagaaggagttagctattttccaagggtgttttcatttggtaatggaagactttttgctgtggttctcatccaggagtattccttagaattgcctttaggattgttgaatcataaacatgcctgtgtccaccttatgcttaatactgactcagaatctctgggatctgggtctggacatgcatgtatttaagtagcttcccggatgattctgattcatagctcgggttaagaactccaccttaggaagttaggtggaaaaatactggatagtagtttctcagacaaaagtgtcagcctaggaattctgaattcctcatagtcctgaaaggacagttctttgggtttgatgtttgagcagatcataatgttaaatgatataaccccctggaaggcaggctgctgtgttttagagggttattctaggttctagtcccatctttaaccctttacattgctgagtgatgtggaacaaatcactgaattaaataattgtctctagagagcagctggggattttaagcaccctggagagaggtgcagaccctgccaggatgataaaggttgtcatcactggcaactgactcctgaccccgggtcctttactcgtatgtcccaagtaggataccataggcagcttctaaaggctgcttacctagattcttctcaaaattgtgtccaagatgttaagtaacctgctattcctgtttagtggttacataacatgtacttagtgtctttgtggagctttgggctggtaggggcagggataggggaaagctaaacagaagtagaagaaaaggtccttgtccagaggaaggttattttaagagacaggacatgtaatttataacaaatggacatttgcaatatagcaacagtctgagtctagaagtgttcaaccatcacatcgcttctcctgacttttctgttgtcctatggctatgagactacaggggttgggggatggggatgcccccaccaccaccagtgtgagaatgagatatggttggggaggcgtgtttggcactttta

SEQ ID NO: 15297 - DNA, 11865 bp, Human
  misc_feature (1)...(11865): n = A,T,C or G
ggaagccagaacgcctttgtccattcatttgctctcaaagtggacattacaggccactggtgatgctcagagcagcagggctgcgctgagggtgggagggtgagtctgacacaggctcccagggagacaggtggggagtatcagacccttgaatagggagcgcctgggtnnnnnnnnnnnnnnnnnnnnnnnnnnnnnnnnnnnnnnnnnnnnnnnnnnnnngccaagcttgcatccagtgatcacggccgcccaagccattgccgccaccttcctctcaggggctgcctgttcccaggctctgtggttctctgtcccccctgtgacagaagcagtgcccagggcagggggctcgcagctggcaggggcggctgtgcctgcaggagctgcgtgtgggtgtcaccactcaggcgctttaccttctgaccaggacccacaggaagggcgggggcacaccgctaccctcctgtgtccggccctacagatgctgggcacaggatgaggcgctgccattcctggtgacctgacatggatttctatccccaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattactgcctccggcctccgccgtttttctgtttcgtaaaccagcatcccggggttcctgctctgagtgaccctggcacctgtcagggagtccaggtgtgccccatgagggcctgggggaggggcaggctgggcagagccacagaggggctcccctcaaaccccacattggctcaggtgggaccctcaggagcaaccccaggtctaaagtcttcccatgggcgctgggctcaccacccccacgccagcccctgcctcccgtacccaggccggacgtgacggggccgtccctgcattctgtgctttcccagttgtacacatcctgtcccctccctcgagtctcagtcacagttcagtgacctggtgacgggaggccccctgcagtgtctgacccaggccacgcctgtgccagcccagagccagggggaggaaatgggggctgggcctctggtccccatggggaggccacccttgtccttggtagcatcagggtgcagaggtgttcccgggctgtaggggtgactccccccaccccccaaggctctggagaggccgatttgctcaggaagccgaccttcacaccttgtcctgctattaatagacgcctggttgacacgggaccctcggttgggtccggagcattgggcaggggcacttgtcagtgtttgagagctgaagtttgggaagccctggggaagcgcaggaactccccgcctgggctggggctgccgggcagggcccctcctatgcctcggcgtggctagagagggcgggggcagaaggctccgggacagccctgcaccctacagatgcgggtctccgcccagccgcggtcacctggggggctgggggcggggcctgggcggggcggggttcggccgggagcgcaggggcggcagtgcgcgcctagcagtgtcccagccgggttcgtgtcgccatggggcagatcgagtgggccatgtgggccaacgaacaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgccgccaccactcccctggggctctgagcgccctccctgttgtctggagggtgcgtggcagctggagtgggagcagagacctcagggtgggagggctggaggacggggccctgcagcctgtcctgtgcccaggaaagtgaccgcctgcttcgagtcagcggccaagaagtcggtgggtcagttcagacagctctccccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagctgggctcaaaccaaggataggaaatcttccaacaagaccatgtggagacaaaaacagaatggctggcagggcaaggtggctacacctgtaatcctagcactttgggaggccaaggcgggcggatcacgaggtcaggagatcgagaccatcctggctaacacagtgaaaccccgtctctactaaaaatacaaaaaattagccgggtatggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtctcgaaaaaaaaaaaaaacagtaagggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttgggggtcccagagcccactggggcctgcaggtcgggctgtccttggccactcctgggacccagagcccgggcatgtccagcaccccctccgccagcccgtgcgccacaggctctgctcttcaccagtgcagaggggtgcctcctgggggtgtccccgaccctgtcactgtgctgtggggatgggtagggggcagctctgggtggcctggtggcccacagtaggtagagaaggggggtggcccaggcccccgggacaggagccccacagtgcctgacccacttctccccgcagtcctcatcaccgggggcatcgtggccacagctgggcgcttcacccagtggtactttggtgcctactccatgtatccttccacctgaggctggggtgggcggggaacgcccagggcagagctggggagccacttcacagtgagctgtttgcctccgctccccaccaccgcagccaggctgggacacagggtgggctgtgcacgggttgggcagcccaggccccagcagccaggcccctcgccaggaccatgtggcgatcagcggcagacccgccagtctaagtcctggtgagtggtgggcagggggtgtcaccagagggccagggccagcactgaggcctccctgttggactgctgggatcccctctgcccgctcctgtcagtcatcccccttgaccggcccctctacctcctctgccccatctcagccctgccgcccagccggaccttgcgacaaggagcactgggcagggtggtgggagggagggcgtgggcagccccgagtgccagacctgttggaacctcccgtggctgcctcctggctctgtgacctcaggcagtggctgcccccgaccttttttgagacagggtctcgctctgtcccccaggctgcagtgcagtggtgcagctgtgactcatggcagcctccacctgggctcaggccaccctcttacctcagcctctggagtagctgggaccacaggcacacaccactgcacctggcttttaaattttttgtagagatgagggtctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggaagaagggctccaccatggagcgctggtgagtctcctcctgctctggggtctctccgggggttgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagcacatgaccgccgtggtgaagctgttcgggccctttaccaggaattactatgttcgggccgtcctgcatctcctgtgagtccccgtcccgcaccccctctagggctcaggagggcttggagccgaccctccccactgtcccaccggccgggctgcctggacaggagccacccccacttacctcagtgtttttccaaacaaaaattcgggtccctggctctggcagggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctccgagcaagtgcaccagagccgctagtgtccacatcaaggctgagaacacccaggaccgaaacaagccccggtccgcgcacgtcccctgggtctgcagtctgccttgtcctgagactttgtggccttggcccccagacctggggctccgttcccctttctgagtgcccttctgtgtccctgcctctcacccgctgtcccccaggctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaaactttagacactggggatgccttcatgctttctggtgagggtctgttaacttggcccgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccgccaggtgcacccacctgcaataaatgcagcgaagccgggagcgcgtgagcctctgcctggggccggtgggcggggctggggtagcgatggttcccgaggcctgggcaggcaccccgtttcctgccagccgggccgcattccagtttcattaacatcagcatcgccttccttctcagcagcacacgaaatcccgggtaccgtatattccacgaaatatagtacctggattccaggtgtgtgcctccctagaaaggtcctcccgggcctggaggaggcagcagagtcctcccttgacagctcctgcaggccctgcaggccctccacacctaacgcctccctaaggggcttggattccagaggaggccgctggcgttaagtgaaaagggaacagggtcggagccacgtggtgagcctctaccctgcgcctcttttccgtagaagctggggtgaagctggtggcggatgtggccttgtttgcccccacactgatgctggggggccccccagctgcccaggacgctcaggccaagttgcaggggcttctggccaccccttcccctcacttgtgcggaggctgtggctggctgcacacacacctgcccacaggtcctcaccaccaccccagcccggtgcccccaaagctttgcccggcgtcagccacgtcccccacctttgggctctcgccaaggcacccactcccctgaggccggagaagcccttgcctgctgcttgtccacctgctctcccagcaactcacacttcagagccagggtcctctgttcctgggggccttcagaatccaccccccaccagccaacactcggcaccatacagacgtctcaatccagcctcatctcagccgtccccccaggtcaccaagcttcaggtcacccttgaaacccccacacccccacatccaatcctggcccaaatccagaccccagctacatgggccatccccacccaggccacctgccgcctcccgctctgccctcatcccctgaaaccatcctgatgctgccattgaaacccaaagcctcaccccagtgcctccggctcagaatccgcaggctcagaacccacaggctcagctacctccagtgacagccacaagcttctgatggccccagggcagacatgatctgcacccccagcgccctgccctgcccctgcggtccccctctcacctggcatcagccacgcaggccactctctgacccttggacacacgcagcatgtgtcttctcagggcctttgcatgggctcttcctgctgcctggagctgttccctgcatggctgcctggctccttcctcctccccttcaggtcttcgaggcctccctgaccctctgcttagaactgcagccccttggccgggcgcggtggctcacgcctgtaatcccagcactttgggaggccgaggcgggcagatcatgaggtcaggagatcgagaccatcctggctaacacggtgaaaccccgtctctactaaaaatacaaaaaattagccgggcgtggtggcgggcgcctgtagtcccagctactcaggaggctgaggcaggagaatggcgtgaacccgggaggcggagcttgcagtgagccgagatcgcaccattgcactccagcctgggccagagcgagactcctcaaaaaaaaaaaaaagaactgcagcccctcccccagagcctctgtcctggactcactcacagactacacaccacttgtttcattagtcaccgtggaggcaggaagggttttcaccattttgttctcggcctgttcccagtgccaggtgcttagtagaaactcatatggctgggtgcggtggctcacgcctgtaatcccagcactctgggaggccgaggtgggaggatcacttgagctcaggagttcgagaccaacctggccaacatggcgaaaccccgcctccactaaaaatacaaatatgagttgggtgtggtggtgcacgcctgtactgggaagctgagctgggaggatcgcttgaactcagaaggtgggggtggcagtgagctgaagtcata

SEQ ID NO: 15298 - DNA, 11865 bp, Human; identical to SEQ ID NO: 15297
  misc_feature (1)...(11865): n = A,T,C or G

SEQ ID NO: 15299 - DNA, 7987 bp, Human
cagcttaaaacatatcatttacatgtgcctggcagatacccagcctgtcactgctttgtgttcccatagtagtgcaaactcccctctgctacagtgttcatcattttttcctatacacatcttggtgtttgtgggtgggatctggactatgcttaaggaaatagaaagatgtaatccttgtgtccctgaatgctggatttcttcgaagcataggaaggcatgtcaagtactctatctctgatggtaattttgtgttcactttcttcaactttttcttatgaagctattttagtcatatacagaagtagctaatagcacgagcttccatgaattcagcatctagcttcaaccattatattaacttacaaccaatatgattattactcccatcaataattttatccataaacacttcaggaggtatctaacatgagcacattatcattttcattctccaataataattctttaatatacccagccagaatttaaatttctggttaaatgccttaaattattcttttggttgcaagctttttatgaaggaaccagatcatttgtcctgttgagtttcccacagtctgaattgctgaaatcatctccttggagtagtttaataggcttctctgtcctctgtattgtctataaattggtagctagatttagaaatttaatcagattcaggtgtcttaaggtagcattttattttttcatcaggaagcacataatgagtggtttatttgggattttgtttggttcggtttgtgatgttagcagccaatccattaattcactgggagccataaaaatggtggtattttaattccataatatttttctttagtagctggaataattttctaaggagaaacgtacctgtttggttttccagtgtagcaacagttttaacattgtaatcccttcggctgtggacatgaagagaacagccacatctttctagaccatattaacccattatacatctgagatattttctccgataccatattgaaatctgtattagtctgttatcacattgctatggagaaatacctaaaactgggtaatttataaagaaaagaggtttaattggcttatggttctacaggctgtacgggacgtgatgctggcatctgctcagcttctggggaggcctcaggaaacttccaatcatgttggaaggcaaaaggagcgaggcatctcacatggtgggagcaggagcaagagagagtgagaggagaggtgctgtacacttttaaacaatcagatctcacaagaactcactatcagtaaaacagcacctgaggatgctgctaaaccattcgtgagaaatccaaccccatgatccaaccgcctcccaccaggccccacctcccacaattcgacatgagatttggtgaggacacaaatccaaaccataccagaattcatcagtgcttttcagagatgtcactgagtttctctaggacctccgtgctaggactaagaccatcttgataaatgccgagcttgaactcaggggtttaaacgtagaataaacagacttcacaagtcaggtttttcttagtctgtctggactgttgtaacaaaataccatagcatgggtggcttctgaataacaagtttatttttcacatttctgtaagttgagaagtccaagatcaagggactggcacatttggtgtctagtgagagcccactttctggtagacagccatcttctcactggaacctcacacggtggaaggggccctcgaagaatagcactggggcctcttttgtaagatcactaatcctatccacgaggactctgccttcatgacctaattgcctcccaaatgcccaacctccaaataccctacattgaggattcggtttcagcagataaatttgaggggacacaaacatttaggctgtagcaaggctggagctcagaaaaatgttttatgacaagcagtggaattttaagttctagtaacctccagtgctattgtttctctaggtttcggtggaccgggtcttaaagaccctgaaagaaaacgctaataaagccaaaagcttactgctcactaccatacctcagatagggtccacagaatggtcagaaaccctccataacctgaaggtaagtgtcagccatggacaatcaggcatgtctgtagactctctattgtcttcttttcttacttgcatttcacctttggtcctcatgtattttatgccagcctagatgttttcaacaagtttttgtgacatctactactaccataccaaccacttgtgaaactgagtagtcttattttctggctggtagtgcaagaccactgaaggctagggttgagagagttttattatctcgtgtaccagattcttcacattgccctgctctgtagtatccctaagtcttacttcagaagattgatagtgctttctctgcatatcgcttacattgttgacaaagctattttctctttggcagatccattcaaatttgtggcaatcctttaaagccaaaactctgacaatagtaccaaaatggtgccagaaaatatctgcttaaggttaatcatgcatcaaactaaacagtaattaatgataaaccaactgctagtattctcagaatataatttaaactaactgataaactcggagttgcatgatttttctttgggcactttgtgactcttcttaaccacatagggaaagacttgtctcaaactgatcagatattgcattctcctactatccaaagaggaccataccccaaagtctcctagaatacacctgtacttttgggtcttctggtggtggtggagagaggatttgaaaggttgatctaagccctccttacctgaattaccacctaggagctctgtaatgagagagccacagttttagtataatgaggacattgtatggtggtaagtgactgccaatcactgggcatggcagagccttgatttgtaatgtttgctaatttacgtggtacaagtgctccagtacggccagtttcacactactaatgtgaagccactgatgagttgagaagtgatacacacagctcttgcaagctggtacgaacagaatccagcacaccactgtaactaaggtgtctctcagcagttaggactgacggtcaagaatgttggaatttgtagcttatcttccctactaagaaacaaatctattggtttcaacactgtatacctaggacctaaatgttatttaatgaataaatgatactcctttcccccatgaagtgttttatcataatatatagagatgcaggaaacccttattattagaattaaaagggaaaaaatacatttgagtgcagtcaaatggcacaactggagcttgcataaaaaaacgcatgttggtttgccagaaatgtgactcctacttgtactattgttagcaaaatgtcatagaagtttgtttgtttatttgtttgtttgtttgagacggagtctcattctgtcacccaggctggagtgcagtggcacgatctcagctcactgcaacctctgcctccctggttcaagcgattctcctgcctcagtctcctgagtagctgggattacaggcatggaccaccatgcccagctagtttttatatttttagtagagactaaacctagtagatgaccaacatggtttcatcatgtcggtcaggctggtcttgaactcctgacctcgtgatccacccgctttggcctcccaaagtgctgggattacaggcatgagccactgcgcccagccaagtttattttttttaagtctcccaactaaccccactttgaccatagtctttcaaaagcttgaagttaatttctcaaataatatatttactgttttagctttatttttaagtaaaaatgcttgaagagtagaaatcagtgttctcctttcctggagcttctgaaattgtaaaattgtgtgattttatttgtatgcatttttaaagaggcttagtttacgtagctttcatcggattttcaaaggaggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatg

SEQ ID NO: 15300 - DNA, 139552 bp, Human
tgtactgaaattatatgggcatatgcaactaattcaatattaacctacgagcatggtaaaaaggaggaaagacaattcactgcctaggtaagtctgatgaaatcaaacagtattatactttccccaaattgtattcatttaaaggttatttctctgtatggagctggggacaaggggaggggttgaaggaagatgactacaaacccaatcttctgttattcatacatctagtctagatggggtggagtcttccttttcccccttgactccatttcttcaaagtgcttttctttcttcttgctgtgagtttcacccaggtctagagaatagttttaagttgaaattaagactccagaggttgttatacaaaaactgggggtggaggttaaggcatgattttataaacactaattataagataacatagattcaggccttctttctcaagccccaggtattgtcatgcaaagtaacagaactcgtatattgttatacaggctacacgggagataaacaggtctgtttttcaccattaatcatttatcaacactcaaggacactctcaaagaacactgatttactgtattcctcacttcaaagtcattttgctttgggatcttctgtcccattcccctccatgacaccctacccttttgcaatctctaactcttacctgtgtcttctttttccggcattctcaaagatagcgactagttgtaaatatgtaaaggaatccctttcaaaaaggcatgtgcctctggttaagacacattacatgtgtaatgtaatgtgtacattacatttacacattctggtaagaatggtaaaaactgtctaggaagttggtgctatctttcaagattgaaaagagaaatgctggctggaaaagaacgtaggtcaaatgaatattgtgtctacttatacatccagacgatcctgaggacctcactttcacttagaggaagaaacaattatcatgcataaaactgtattttggtctcctgaatgctgttaaaatatggggttgtaataaagtagtcttcctctatgaagcagaagcattgatagcacttggtcttctggttaaacttcttaaatcctcacagaaagagccctgataaaggttcaactatctttgctgtcagcaatacatgtgtggtccaaggactgtacctgtctgcaaatgcagaggagtggcttgttccagttttatatacagctgctctttttgagaatcattagacacctcgaagtgaaggaccttagctctactcaatacctctttttctggataggatatttatcctacacttttctattctaacatgaagtgaaagccaattcaaaccgtgcagctttatttgagagcatttctgacttcatctttatcttaaaaggatgctttaaaaaggggttcatggggacacataaatctgaaatatgcgtatattaaaataaagacatacaattacctaacatctaatacaaaatacagtactgaacacaaatcgaaaaaaggcatgcgggcaaataatggatgtacattcatccctttcactcagatcaaagagagggagctctcaatgactcatacataccggacagagttaaatgttataaagaaatatgccacagatgcagcagtgatggcaaaggaaatgaatctttctgaagcagaaagatttaagaggaaaggagatcgtgccatatcgcaaactctgatagtacagttccaaccctcccacgttgctctctccacatttctttttgcttcttgcatttcccttcgccgccagtgttaagagtgtacctccccgcacaacttaccttgaaacgggactccattgagctctcgagagtgacacaagcccatagccaatcgtctcacgcggccccgcctgggcggcctcaatggaagcgtgtggaccaatcaggatcctggggcgatgagcaagttacgttgtggcgcgattcggcgtatacttccgcgcgtgctgcccgggataggagcctggcagagcagctgcacacacggcagtgcggaggcagagaaggggttggtgatacggtgctataaatctgtggtccagtccacctcccttttaagacgtcctcccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaaggtaagtttcggtttggtttctttaatcattagttgcagcgatgcgctggcaaacccagaaaacctgtaagtgagcggaatacagaatatgaagttaattgcacatgtttgtctcatttcaaagctactgttctgcttttttaattttaaagagctagactaaaagacggtggacgcatgcttagcgtactgaatattcgtaaatgtccatggcagaaacttaagtggtaaatgtggccaggggggagtaggggtacaatgggaggttagatgtggagtgagcttcaagattgagatcggaagttcatttcgtggggagagagtgataacttgggtgttggggatgcatgcctctactttggctcagcaacggaaggacgggagaggctttacaatcattaaggggaatcagaagcctggactggcagattagaccagcgaaaaccacaggcttaattgcattaaccagatagcatgtgctggggagatgggattgccagatggaatttagatgctgcaccaggcagcgagttgtagttgactgaaaaaagtacatgccgcctgagggctggggctggggctgggctgaggctagggttgttagaagctgtcagaactcatcattgtatgcgggctctgattcacggactccaattatcataattcagttttaaaagaagatagccaatttggggctgaattcttaagcctgtaccggatatgagattccctttgttcagaaaagcgtaaataagatccttggagctgtgtctatgaagtgccggctgcttgggagcctcgctgtgctgggcgctgggaagtggattccaagccctgtccttggtcctacgcggctgacttcgccttcggggagagggggaacccctctgcagccgcgaggcttcgcagccaccccaggagccaactcggccacgtagccctcaccccctccttaccgcccccacttcctcgaatagctattgttaaattgacgccaggagaaagatggttggggatgacaagctgggcagataggcacacgcttcattttaacttttgtgatttctcagggtttaggagaaatcatttggctttctactgccaaagagaggatccagggtagatgtgggaaagggggaggatgttcgtgggccggggagggcggaaggggtggtggtggtggaacaagctgctggctttcctaagagaagtttaaattattggcacgagggggtgtgggtgagtgtgtgcgtgagagcgctcatgtggtgctcgagaggcagaggatgggaaaaagctacaaagccggctggggttaacgtctcgttgctcctcaccccacccactctaccggctgggaaagccagcgcaccgtcagcctcccggactggactctgcgaagggcggtgggggctagggatggcaaggtggcagtgcccaccactggagctccgcggcggacgagacctcgcgtggccattgttgcttaatttatgcccagcacgttgctacgtacccacctatttcacgtctgtacagaattaatacgaaagctatacaactgtgacaaattggaggttggataagttccccgtttcccattttcaagtaccggttagcaaaactgatggcgagactgggtattttctcgtaattaccggctgcaggtctggttttattatggcgagggtgagagaaatagccaaccatttagtatttactgttaacactgctggacagggatggaggtctctgtactttctccccgaaatgcacggattctgtcccttccccctctcatgtacaaacactccagttggttaagattctaaaccttcagccgttctccgcacccctatttattatacccatcctctgggggtgggagggagattaatgttttatttcccaggcctacactattaactgcaacctataaaacgtagacttacaatgaaaatttttagaaagtacacagcagacaatagtaactaaagaaattattttccaaattgaaaatcagtttctaaaggtcagaaaaagggtgttcgtgttttggggaacagaagggtaggaaatgtgtttgggccttaagacttccttgtaaaatggcttcttaaatgggacatctgaaagatttgtcagactatgaacagataagcccgcaaaaaaatatgttgagagtttcgaagttgttatggggttaacattttattttttaactctcgcccttacttattgctgtcattgcctgaatgtgtcttacagcaggcacttcttccccgttccctcttttaaccaagtgcttgggcaccccgcttcataaagctaacctgttctggagctcttcacaaaaaacgctacggttgtaggaagaagtggtttggaagacttggggaactcttctgagagctctcccataatttagtcagcgtcaggaagtagggcgtagggcattctaagagttttaggtttggattgacaaattaagtaggcccattttcgcctaacgttttggaaataggcatttttagcaatcccgcgtgcctgggatgagaatattataattaactatttactgagaggtcaaagaggcgcaggcgctttgagcagttttcccaggaacccacacaaagtcaattaaggtcatttaattgcaaatcggatttggggtgacacggaaatgctgatatagaatcagttagctgtatccggtgtccccagactgggtcgcacaaattaagggatggcctatctcgcttttgaccttggttgagccccctacttcactatgctgattagacttcgcccaagagggcaaatttgcctctcccacacccgccctgggttagacgagtcccctcccttccccccaaccccgctccgcccgtcgcatgggggcggggagcgctggacgcccttagcggaccttgctgcatcaaacctgcatcatgcccttgaagctgtaacctcggtcacgttcttgcggcgactgggtcgcccactgctcggttcctttctcttacctcctacaatttcaggtaggtatgacaggtgattttttaaatgtagtattttaggagaagggctaaaatcgatgcctttgcaatgaaaaaaatcccaactacaggtgctctcgtaattaagcggccgagcaggtgtaaaaacgtgctccagccgcgtggctccggggtgggttttgacttccagccgtggggccgggtctgaggacaggcacaggtttttctggggaaaagggattgagcttggcgaaggggcgggccaaggcaaggcagcgatgggacgccccctcggtgaagagttggccatttcgggtcttgagttggggggcgatagaaggatgcggctagcggcaagcgtttgcatagtcgagtgcaggatttcctactttgcgtttgaagcagagtacagcaccccgcacaggtactctgggcttatttaaacgtcaggttctctctagagaggcagggaggggcagcagggggctaagcctttattttctgtccagggacaggaccccttggctgcgaagtagggggaaaaagagaatttttaaaagagacacacatatgtgtgtatacttatatatatttataaatacatttatgaacacataaagtaacccccacgttagctgctctgactccccgttagcgccccgggcctcgggatttgcaaacttgcacctggaatcagcctcctctgggcgctcaacgctctccaccgagtccagagaaaccttgtcggggaagcctggtgagactcggaagtccggagggacggagctgagctgctgaagcccggcatctccctgccggcacggacccgaagggcggtcgggcagggcacgcgccggcggcggccgcggcgccgcgaactcgccgccggccccgcctcctggcgctcttccaagcaagcccctccttcccgccccgctacaaacggcgggaccgcggcgcctgggcgtcactgaggcagtagccggccgggtgaggagggcggttgccggcgcggcgcggcgcggcgcgggtggggcgggggttccgccggcttccagtcccctttcccgccgccgccgccgccaccgcctctccgcggagctcgccccgagcgactcctccgcggcagtgctgacggccagcggcacgagccgtagtagctgcagcttcgagtcacagcaggcaagtgctgggggcgtgggggcggggacggcgtccgcgccttgcccctggtccattttggacgccgaggctaaggtctgtgcgcgcccccgctgcgtctagcagggtaggggtggtgcgccctagtccgaactctgggcgggaacactggtgggggcggcggaggttgtgcccgcgaagttcctagagctcagcccgttgcggcgggagtagagagaattgggcgcctcgggaggtggcaccgcccctcccgtgggcacaagcaggttgggggcggcgggagccgagcggggacagtcgcgcctggcagcgtgcacgggcgtggacgtgcccgggtgcggccgcgtgtagcgcaagaaggaaactgttgagacgcaggtgagtgtattggagggaaagtgggggagggggcttttctagaaaaagggcaggattcctgtgttgcactggcaaccccgccttgcgggaggatgtgtgcactggcttctcccgcggaacacgccggggtggtgtctggtgtgtgcccacttgctacggcgccttcgcgcgcgcggtccttggagctctcggggcgtttggagacttaacaccggccgcgttgtgtgcggaggtggtgtagggccgcgggcgcccagggcaggagcaatgatgatcccctcgtgcgcgttaggtgaggcccgtcgcagccgcgcgaggtcgcagctcgcggtcacatctcgggtttgcgcgcgaggcgtgcgctgcgcgggaagcgcgggcgctctgccgggcgaggccggctctgggatttcagttcgcttgccgtggttgcggcagctgctcctccagcttggctggtagggcctgccagcggcggccggggtgcacggactagtgtgcgtgcactggtgagactgggggagccagcgtcggttcactggcaggtgctcctccagtggccgtgacaatgcttagccagcagtctttctcacggcatttccttaaaagcctccttgttatccttcagggccagagcgtaaaaccatgcctctagatgcgagctatgagcatgcagttgtagctgcccagatggtcatttagaattgtgtgcatttttaaagaccatctttatgacaaagattttcaagtcctatcgtctctacattttctgaaaacatgggaaaaggatttgctacgagttgtccactctcctttattccctccctcaaagaacggttcttagaagtgccaaaatgtaataccttcggcaaggacaaaagcgcttttaaaacttaattttctagtggccctattcctaataattcttcataaaaatttagctcagcctcaaaacttacggcgaatcagtccatttaaaaccattcgaatatcaattgctgtgtaatgtccccattccctcaagtaaaatctgtttgtttgaaatattgttttgttgcccttgaagagttttctcaagaatcgtttcgccagagtcgcttgaatttcccatttcttgtggaagctgacctggagtttccattttggtgagcgggtggaaaagctgtcctgcatctaccttgtcttagtaacctttgggtatatataaatggtgactgtattgctgagtggacccgaatgttactgcatttgtggtaggggccttctttataggaggtttgtagggatgctaaggtaacaacacttaaggttgtggggaggatatacttacgggaagttcgcttgcaaactatggggagagaaagaagaggaagaaaacatctggaagataaaggccagaatggggtaggaaaaattagaatatgaagaaacatgttacattaaattttctgtgattcctcctttgtaattttcctttttgagagagtatttttatttttgtgtggttaaaaccagccccttgttgcctgttatttgggtaactttgtgctgccacctttcagggagttagttgtttttttcttcctttgaaagacaactttaggtgttaagcccctccctcttccttatctgtaggtgtttccttcattgtgtagtgtcttctttcaggaacaatcaagtcagctatattcagtgctcacacactttccctgtggttcaagataattttagttataggatatgcttcttgtttagagcaagtacccactgctggtcagtgtctaccactcttttgacactcagtgtcaaaaggttactatggaaccttttttcttttctaggcctaagatgtgtttttatagatcctctctgatttagtttttttggttgatttgttctggttaccgcctcttcacaagagaaaaacaaagcctttctgtcccagtttcagtggttttagttaagactcagctcctggtaggttaagggagaatgatgctgtgagtgtcatataccatcattccttgaatcaaccttttgattatttatacacagacagatgctgctagctgaatccttgtaaccaaccgctcttggctcttccagccttccctgcttatcttttaaaaataatgtgcctcccctcctgccaccccacttctattctagaagcaagtcttaggttctctttaaggacacagcaaagccttccagaatatcctgacttttaagctgggatcaaccttttcctctttctttgctgaaagacatttttttaaaaaacctgtgacgcttttcaggcattattggcattgcacaagagcaccacagtggcaaattagccttcatgttctttttccccaaaggactagatactctgaaatagcttcttaagcttcttatcaagactgactttaccattcccctttttgatgacttgtctgcatggtagcatcagtattttcgctcccatttgatgtcttattaaatctatcacatcgtcacattcttattgccacttttatcactcataatgtttatttggaattgagagaggctagaatctgtggtacttagcttggtttggttacttttttgttgacattttaagggggctagatggtgtgccaccctgtggaaaacctgcccatctcagtctacccccagctctttgtttcttggctactcagctggacaggtcaaaaatgatagtaagctaccacatttgagtgtgtgtggggggaggttaattttatttttggcgtgagtacttagttatgggcaggactgcttttccagcttgtaaccggtatggttgcacatcctacccaatcttgaaattcttaagaatttttggacaaggttaccctgcattttcatcttgcactgggacccacagattacgtagcttttcctggttagttgccttcccacttgttagtatttagctgtcagtattgctgctttgttgatatattatagaactgtttgaaggctttatgtctagtgatgccacacctgactatcaaattcactatggaggacataaaatgcataaaattttttcttgctttggccattttcattttacaggtgtagaagtcttcaccggttctggttacgcacagagcccacatattgtagttcagtgccaaatccacacttttgtatgttctaatttgggaagaacatttattgtatatttatttggttcgagatactagacggtttatagtgctagttaattatttaaggatttcacataacgtaaatttgccaagtggaaacagaagacacttaagcttgaaaggcagtgcttattttaaggcttttacatattaaaagataagtgttttattatgatttaaatgataacttttggagtctgaattaaaagtcaaagtttgcgtaataaaatcttagatttttgtggggtacttaggacatttttcactagtaaatttaacagatttggctttcagcttgtgtgatgtgtatcatatgtttcattttagtaaggctagaagaattttttatttcaagggaagaattttttttatctctaagcttgtattccattgtgcaaaacaaaacaaaaggtaactcttgtgtgagcaacgctgtgctaaatgcattctcatagacatcttcatctttaatatcaatgttaagtttctagagattggtcttaataaaaataactatttttgcaacgagcattcttttctcagagctttgagttaggctctcaatgcgtgaactgaattgatatgcttaatgacatggtacctttttgaatattgctgaatagttctgtgtgacaacagatacaggttttcgttgtaagaaatctttatgaagagaaggatgggggctttgaggagtaaaataggtaaaataacccagaaagtcataagaataggtggaatggggataaaactaaaccagtttatagaatgccttacagtgtcttttttttaaataaacttgcagtttcttagtatatatttatattactgatatctattacatcagtttctgactgaaaatgaataggagataaggtctgacatgcaaaatcccctttcccacttttaaaaatgtattttaaaaaacttgacaaatttaaaattatacttactgtaagacagtaacagtaaaatgataggtttttttttttaagacacagtgaaggttttgctttagcactggtatattttgaaccaggtatgttatctacagtttgatgtacctgtatatttttccgttggccaatctaatacagatgctcctgataaacccattgcaagttgaaaatggcattaagttaaaaatgtatttaatacgcctaacctactgaatatcagagcttagtctagcctaccttaaacatgctcagaacatttatgttatagttgggcaaaatcatctggcaacacagagtatccatttttcactctcatgatccattgcctgagtgggagctgtggcttgctaccattgccctatatcgagagagtctcttaccatagactgctagcccgggaaaggatcaaaattcaaaatatagtttctcctaaacgtgtgttacttttatatcaccatacagttgaaaaatcgtaagtttgaaccatcataaattggggaccatctgtagtgatagatttaatccttgggtttttcctttgacttaaaaagtttatcatgaaagggaaatttatattctaaatgttcttttcttccagcattttgtttttgtgggttgttcattattggagattatttcagcaactttaaagactatgttaataggatatcacaaaaatcttttataaatatcaaagcaataaactattccttcaagatggatttttatccccttttttttttttttttttttttttttttactgaaagcttttagtacacactttcttgactaatttcatctctttatgggactagggaatgatagttgttttgagattcttagctttcctgcatttctttagagtcattgtaaaattggaagttcttgttaatattgaggggctagaatctctttaagcatttgaagaaagctgtagctgtctcttcctagagaaatatatacaaataagaaatttccatacagtttttagtattttgcactttggaagaaagcgtgttaaaatgaggttccatttgggaaataggactttggcaattagagttgtcttcttatactagtgagaactgggtgaagtcattcagaggttcttgtctgctgttgagttagtgatgtgggcctttagcattctttgaaggatgactgactctaagctttcctgtctcatagtttgttttaaaatccattctgtttttgtaaacaaataatcacacacataaggtcttgtgatcaccgtgcccgtgcggccaatttgctgagttgtctcagtaggttttgtcacttaggttgaaattcttaatttagcacagccaggtggaaaatagtaggctagaagtctgaagttttcagcatctggtttggtttaattacttatatccttggtttcttaacctttgattgtgtataaaatcttaccctccccatctcaaggaccacgtaaagatgagcatattgaagtacaagattttttgacaatgaaatgacattgactgaattggaaaggtggtagtaggtggttactgcttgattagttttatatttttggctttcaatgtgttatgaaccatttttagtgattttgtttttttataatacaccatcatatgtttatttctgccatgaagtaaaagaaaaatcccagactgcagggaggatttgggagaattgtgactttggacatttcagtatggaaatagacatatttatacctatgatgatgggacttggaaagtttaaaatgcattttccttgaaaatataaataatgctaaaagattacatatgagactgagaatttagccagctaacattccaggaatataaatttcttaatttaaatttctcatatttttttcagtgaaaaatcaaaattttaaatttaaccatttatattaaaatagtccgcgttttctctgatttgaattttatttaacctcttatcaaggatccattcctatacatcacaaaatggagtttacatagaaatacatttttttcccctcattgctgatggtgtgaacatcattgatggatgccctgtcaagtaagttattggaaattgctcacttgttcagcttttaaaggatgtttagcactttttttattctttaggcatcatttgtgtatatcagaataaagcaaatcacagtgtatctgaaaataaattcagtgaattgggtaaggatgggaaaatatttctggagcacttgatcttgttttctctgagctgcttttcaaaagtaagaatttcttgttatactgatattgctttattggaggtgatatggcaggtgagggggtcatccacctttattgcagaggtatccagaatgtgttaaatatacaacatttattatagagggagcaagattttataacctgttcccaggtaaggcctatttctatttgagtttattcaacaccacttttgatctccccaggtgctatttactgattgctggcttattttgtttaaaaacccttggggtcttttctgtcctgtgcctctgaatgacccatggacttttcccaaatacgaggtcatcagtgcttttgactttcatctcttcccttctccatagtctccgcaaggaatttgaactacccacagccttcctcccctctttgggatgcgtctgtacttgccctctgtcccttgtttatccttttagccttgtgcttagttccaggtcctggtaatttggggtcaggtgcaacctgctcacttgtccctttattttcttatcctgcttgggcttttgcattggctcttatgcactttgttacattttacttactgaagaatatcttctgtgaccaagtgaatcactgataccagaaggagcagttggtatcagtggacaaattatttgtgccacaggtcctgaagggtgatccgtgagcttcatatggcctataggtgttttgattgccctgaactgtgttttaaatagttgtgagttgttgatttacggtttggtaatatataaagatctggagccaaatgtattgcttcttgaaaacttggaaggatggagcaacaacaatggagtccacatttatcgactgcgccttaaggatgaagcatggcttgtttcactttgaccttggtttgtttgcctggccttggtgtctctaatgctatacttcctaaagccacgtgaattaaaaagttaagtgtaaagacaaaggcagtagttctaaaggttttatattcgtttgatctcttgtatttacagataatgtttgaatcatgttaaactgctccttacatatttagatcttatagtctcctttacttcagagaagatttgtcttgggtctctccttccttaacccgtggttgaaaaacagtttctccttttataaaatgagcttctctcagcttaacttaccttttctctcctccccccctgggattttagaactgtccccattgggagtagggatttctccctgccagttgcctgcttctatttattcagatgctttggggtcaacattgctacttgatgctgtaaaaactgataggatgttatgagctgtttaaaagaggcctgtggcccacctgctaacctcattgctgatgttgtgagcttataaatgacaacagatttataagattgttgtaaaaaaaaaaaaaaaaagccgatatgagacttccaggtgtgtggtttatgtgtgtgtgttatttctctccctttcccctttatttttttcagtcttcagccttttctcccccactccagaagcagcagggcagccttagcaaggccctctcctatgtgtgccgtagagcagactgatgcaccagcagaagtagaaagaggctccacatgtcatgtttggaccaatgctgtaattttattttacaataaggaaggtggataatattaatctactcctgagcataatagcacaatttgaatagcagagagcaactttggtgtgtgttaatgtctagtgagatgaatatagttgaatgctaagtaggtagaaaatgtcagtgtggagccttccttttggtgactttaagcacttacatttctagttaacttttgttcagcctggtaaatagatatgaagatctgttgtatcaacccagcattaatgtagcttcttaggatggaacaatgcccataaaaccctgctctcctggcagccacttcagctaggccagttataacgatgaatcagaatgtgcccctgtattgaacatcttagcaaaacccttcagaataatagcttaatgttggcagttttaagcattggcttactctacaacccagccaattttttttttttttttgatatttggagtgttagtataagtgtatgctcacttaaaaacttaattttgaattaactgtgtatgattttaaaaaatcattgtaggtacatttggaacttatttttcagaggcacttaaaaattcttggtaccaagcatcttctattctatgattatatgattcttttaggtgaacgtgttgcttgtttttgatgctccctgcagcatctcattgcggcacctcagggtggcttagttactgggttggggtggggaattgaatatcagtaaaaacaagcatgttttatccccctaaagattgggagtcattcccgtggagcttctactgtgcaataagaatgactttgatatatgtgggctgctagttaacttgaagcttagggcttttccaaattaatctaattttgtttttgagtttgttgaaggatcaataaaaatattcttctaggttttgtgttgagattatgttcagaagccaggaagattgtgtaatacttattgtttcatcacaaattactgagtgctggatactgagaacgttgagacttgtataaagtgccctttacctcatattccttggtctctacctaaggagatgaggcagaaaatgataacttaaaaaaaaatcacacactccccactcttgcatttaatagtagaaactgagtgcttgaggaattaagcaaagagatatatccctgttgtctgggaatcaagggatcaggccaggttgttgcttattgctttagggacaggactgtgtcttttcttggtccattttgtctattttttgctttttatgtcttatttccctcccccgttcctcccatattgtttttgttacctttgattttcttttatggtatgagtaactatttcctagtttgccaggagctcagtcacaggtgaaaagtatttctgcaaaacctactcaagtttgagggtgtggctagagagagacaagctgtgactgtcttaattccactgttgtcccagaagagtagatctgaggcacgttgtgtttcaaactacatgaagctgggtgtttcccccagagttttattctgttgacaacattatgtgccagcagcctcctctgggtataacatttatttttcaaaacacctaggaaaaagtcaaaataattacaacttttttgacttcctcccttttgggaatatagttgcaggagcaagaagcaagtaacaggacagaagctggggtgcttttcagagcattgatctatgccttctccttgcgtcatcttcatggctaaggccatgtcttccaggagcatgtgttgtctgggctgctgactatggctttctcatgccagtgcttggtgttctgaggcctggccactgcttttctcccttaatggcatttgcattactgtttcgtgggtttttttttttttccttgaaaggtgatcgaacagcttgtacgctgcgttacctttttgatttagtggagaggctcattccttcagttggaactggctgttcggggaataatttgtgttcttgtttcttggactttttgaaaaaattttttcccaaacagtttggctgacttataaacattgttttgtggatggtagggtgaaatctttggttttagagtgaataatagtttgtgacctagacaggaagagtgaagacatctgttttggttttccttttgtacaacttctatggtaacttccaaatgactctcccttgagaatgcaacagtaagaaattttgtgttggacagtcaagttagcagtggattgggatggggcagcagggatctgccactttttagttgttgacttaccattaggaagatagaaaaatacgtggagttggcaattgaagatggtgaactaccacaaggtgatggaaccaggagacacggagcatttcctctagtaatggtgattaacaccaagtttttctgtccttatagaaacttgccacagctccctgggaatgatgttttataggtgaggaaaatgaagctcagaggtcaggtggtttgcccaaggatacaaccaagtggggaagtaggatcaggtcagactcctagttctgtacctctttccatggatcccagaatgatgttctttctacttttggtagttctgctggctgtagtttaaggtggctgaaatcagatccaagaagcaactcagttttcatgtttgagaatgtattgcttctcttaggggtgttttgaaataaaatggtgtgactccagcagcaattgtatctcacctccatattaaattgctttagaggctgtttggttccccagtggtggggttgttgtaccaggattattttttatttttataattttttttaaagcttcactgtggtccctgtagcactcctagcagtatgcccacaacttgttcctcagggccaggattctgaccttggattattttaggtccatgactgggtgacttctggaggcatttccatcacaggctggtgactttctgatgccagctggcatccttgacttgcaggattactttttggaaccatacaaagtatggattggttattttctgtaagcaaggaaatgaagacactgtcttcaggctttttttaggatgctgttaaaatcaagaaaaaggtgaaagtgacattgagataaccctggctcattgtagtagataatctgtaagggctgttttttgaacttgttaagtttatgaaaaaaaatgtgttcccaatcaggcaggattttagaaatactactttttgttctgagaaaaaaatggcaggtcaagtgttcaataggatgtttgatatccaaattggaataaacaaaatattcacccagtaaagattgttcttgattcacctttctccagtaagttttcagtatttctccaactttactgtttctccaactttactgtcagaaaaattggttgggagtggatgacaaagaattacagattcaaaatgacctttttgctcttccctagaaagaggccatgtgctctttttcattacttgatctctcacatagtgtgtttttaggagaaattcaggaaaatttgtggaggtcactggaacagcagaactcaaaagtctggaatagagataataatttaaagaaagaatatagtacatgagactgataatcaattgaaaattatttgcatatgtaagtaaatcatgaatgataggtaatcttactagaatttcaatctctacagggaaatttttgcaaaaactgccttaactaatcccatgttttctcatgtcttagatatgcaatttttatattacttttgagtctcttaagtttacttaatgtcctgattctatgtcccccaaagctgtgaggttagtgggtgcatctttcagtccaaatgtcttagaattgagaagctgaaatagcttcatgccaacatgttctctgatttcttatctctgcaaatattttactcttcctagagtataaatattgtccttgtgctatggaaagctggtgtaaacgtgagaaaataaggtcatcagattgtctctacatatttcaagcaggtgcctctggtataaaattggccaacaggctatgcacaaagcagtcaggtgggatcctgacaaggctgctccgtactggttagctgtaatttagaatatcacaggatgaagcagaagttaattgttgagggtgaaagctcaatagcattttactcatcatcacattttataggacatagtaaccttaaactttgaccttaatacgtatcatttctctttaatttttgttgtgtttccttaaatttggcgaagactaccagagattttgttgggtaaaatgctttgtagctccccagttccctatggaattcagaagcattaagagatccagggactttgttaagttttgggtgttatagttcagactccttaaggaattttctggaactttacccataaggaatttttcattatggctaacatttctttctctctctcattccctgtgattattctctgttatcgtctcaaagaaatgtggcaatttgatgacagtttattaaatagcctatgaatatttgaaatgtttacatctaaagtttttattagtagccactttaaaactttaaacttatctctcttttcctagcatttaacattttattattttattgtgtctggcctcctgacatgaatggcattttgctctttttgattgtccttctattcagtttttgatttgctgatccagccttttctgccccccagtactttaaaagcaattattttgccagtttacatgtgaacatttcttggtttcctgtgcagattttcatttgtttagtaaatatttgtgatcttgctatatgccacatatactaccttaggtattaagactatagtagtgaatacagtatactccctgctgatatgaaacttagagtttattggaggagatattatgttaaagttctacaaattattacatataattgtgatttgtgctgtgaaggaaaataacctttaaggcttataacacagtgtgggaggtgattagtgaagatcatttgttgatttccttcctagctaccttatttttactgtacataaaaacagactagtttttaattttataggcataaggatagacagaggtcctaaaattaaactctattctccttgataaattgatggtgaactttgagtcctagagctgattcctgccacccagcttctatcccaccatggatctggctttttatattttttacgagaaaccgattttaatgttctttgcaggacaacgtaatttggcaacttttactctgaaagctatgtggtgaatgcaaagcccagcagtgagatctgcattgtctaaatcctttattctctttacccatggctttgaaaatgtgttggattttgaaatattatcagtatttgtttaaataacactttctaatgtattaattgatgcagtaagaacttaggaatatttgttaggctttttgcttggcggaaattagaatttcactaattcatccacagttgtgttttgtcattgattggattatttggtttgtttatgaatgaccttttagataatccctttgacagatcaccccattgctttaccatattgtgttccttccagtattcatttaaattataactaaaaggaaataccatattaattggaattgtttttaaaatatttgttggagtggaagagacttaggcagttttttttttgtagaaactttggaagacatttgttgtttaagagtgtcgaaaaatactttttaaaaaaatgtcagtggcttctgtggagttccttaatcctaaagggctaggtatgttcgtaagagatgggtagaatatgggaaattactctaagcaattggaaaagacacggaaaaaaggttaaggaaaatgaggaagtgaattttccatctggctagtttcctcattcacacagatcaccagacctaaacagtacagtgaatgcatggcaaggatatgatattttaaaatagtgtctttctgaccaccttattagattattaagcttacttgactaggctcttagtttcctcagagaggtggactctggcaaacagttttatttttaatataagctggtctttaggaagataataaaaactttgcatgccttttagcttataccatttataattgtttgatttaacatggatatagcatttttttgtaggtggatattatttcatcacagcttttagatttcagccccttttccttaggtgcagaaggaagctactgaaaatatagacagtaacctctactcttgatggaatttggagagaagtaaaccaagttttagttcaggagaggagaattttaattttacttctggcattacagggacagcaggtatgagagttaaggagctgttacggaatgggcacttggggtaacaacttcccattgcctttggtgtctggtctctccttaatagctttttatattggtttaaattttcagggcacaacttaaatgttactttcaactacattggaagctctttgatgtcagtgattcttataactttgttttctgaatatagtgggtcttattgtcttattactgatttttttttttaagagatttagtctcactgcagtggcatgatcatagttaactgtaactttgaattcctgggcttttagggatcctccagcatcagcctcctgagtagttgggtctataggcatgctttactgcaactggctaatttttaaatttttttgtagagatggggtctcaccatcttacccaggcttgtcttgaaatcctgggctcaagggatccttctgctttggacttccaaagtgctgggattacagacctgagccacctcacctggctagtctgatttcttgaatctaataggtcctatgtctttaaaatgaagattaaaattatatatgctgaaggtaaatgttacatgcaagtttttttcttttaattgtgtattcggccttggtattttggttgctatgaagttgtataacttacatatttaaccaattggagttaataaaaattgttaatatttaaactatagcaaacatttctatgttttttagatatcactactatatgatggtaattaagtgctggatactgaataatattttaagatgactttattaaagtgctatttcttttcatccatacctgtgaataattaagaatttatggtatctgtttgcagtctagttggtgagtttaatttacttggaccacccagaaaaaaatatacaatgatgcttctgtaaccactttgactaagctgaaactatgctttttacatgtatttatgacctgttaataccgcttcaaagtgtgctgtattgaaaagatattggctgcttcaaggttggactgaaatgactgtgtttgccaggaataaggaggggtctccatggatgaccactgggccagtcatttaatagccatgtggaaccctcttcggctatcagaagaatgttttctgctctacactgagtatctttggaagcagatagagaagttgaggtctaaggtagatgctctaatcatggatggctaactttaagaagcgttattgggccaggttctcctgtggtatatgccaagctcatgctcgtgcatgggtacacacacaagcccaaggtacagtagcagctccatctgttttgtatgttgtaggcctgccttgacatagaactgttcgttctaaagcaactcattttaaagctgcagtatgttaaatgggcaacccttcattgaagaccttgggtatgttggcagtttatcagcagcagggttgtgatcctgtcacttcttgttaatgaaggcttttatttagcttagcaaatcatatctcttgttagtatccactctctcaaatggtagacttgaaagggatgtttgtaccgttttatttattagtagccatgagggtgctttggcccttacttgttatagccatttagccatatttcttttacggagatgtggtttgttttaaactaggaaaatccccaaatgattaacgtctttcttttgtttatcatttttgaaatggctttttatatttcctattaggtggtctttttcttcagtctcaatttcacttccattttgaaattcctagcaggggtttgtcagagcatttatgttcccagtgttgcagctgactttcccagcatttatttgttgtccttgggtagtccaagaggataagcattctgtcttcatatttaatgtacatttcttatatataacaagttcaaggacatcagagaatgttagagctggaaaggccctacccatagtgttgaacagcagtctcatttcatatacattcagaactgatgctaagatgtattgtctaaagtcttaggtataatgattgtggttggtgactgtgaccttgtggctggttcccgacttgcctttacttcccccagtgccctctctacactgctgcattatttcctttttaaaaatgtaggttatgctttggtgggactgcaaactgataagttttcagaagttttttttggcagtgactagcgtaattaaaaatgcaaatagactacaaaccagcaatttctatctttaaatttacatttttgctttactgtataaggtatctattgtaagcactgtttgaaatagcaaaaccttggaatgttcatcagtaggggattggttaaattaatcagggtatatatctctattatatagtatctgtaaataaagagtatgtgctgatcttgaaatgtaaaaagcaaggttcagagagcattcaaaaagatctatgtattaagtatttacttttcctcacctgtgccattacatgtttgtattttctttgaaagtgttcaaagtgttcatgaaattgttaacctctcaggtgtagatttgaagaaattaaatatttctgtcttttattgcttgaacccaggaggtggaggttgctgtgagccgagatcatgccattgcactcctgcctgggcgacagagcgagacgccgtctcaaaaaaaaaataaataaataaataaataataaatccatcttttaaacagttctgtggttatctttttgcatcaaatatatattttttaatttgcacaaattattataatagaattactaattacttcaaaagctgatcccccttgggcttttcagagcattttaatagatttgcacttttcctacatatgagctgtttgttagcattcagtgcctgccttgagctgagcgttgtgcatggtcgttgggtgctcagaaacactaggatgtggatgccactctcaagttctccaagtctggttgacagtccagaggaagaaaacgtgagtttatgggagtttggtgaggtctgctgcaaacattgggaaaaggttcctgaaaccaggtagatgtagtagcacttgtgaagctcttttatacagatagggggacttgtccccccaccccacccgcaaccccccaggagaagaggattaagtgtggtgtactcctagcatgtaaggaaaaagttttgattattggaacatgggtgggtttctagaggacactgaaatccatacaggaacatttctcttattttgtttgagagagccagccttgggacaattttacaggatggcttagtgtgaggaaaactgaagcaaaagacatgggctgatgtggctaaaggggccttgaggaggaacgcaccagggctttgagaggaagatggagcatgcatggcttcctgactagggtgtaaacccccaaatgaaagtgaaaaactgcttctggcatgctttgtattgtgtaggagagactcataagatactcaagcatttttctaaaccagtgtaagtatgcaacatgaaacatgtaatagcttgttatgctttataaagcatcttttctgagaaccagaatatacagttatattcatgtttccccgacaatgtttatgtaaaaattttacattaaaggcagttgagatgattcacgtttttttcttataaatcagggtagtactgggcatgagaagtagtttacatagtcccagagctggaggaacatccctttgaaggtaaggagagtagttggaagctgttctaaggtttatctatatgggctaaagggattcaccataaaggcatgcttatgtagcagtgaattagaccagtaattctcaaagttcttgatcagaggatccctttgtacacttaaattattgaggaccccaggaccttttgtttgttatgtgtataaatatttactgtataagaaattaagatgagaaagtttaaaaacctgtttaaatagcaaacccattacatattaaaaaatatttttaaagtgaggaatatgtatatttttaaaaagtaaggctggcatagttttacattttacatttctttaacgtctggcttaatagatctagtcaactgtattctcattgcaacagactgaatgcagaagcaagtgtcacatataacctttagaaagctctactgtacatttatgagaggaaaaggcattctcttgacttcccggatgtatgaggaagtctcagaggactcttaggttcccaggctatgctttgagaaccactggattagcctaatggattcttggaaggcagggctaggcccatctgagtcttaaaacttggaatctgtattgtagggaggagtgggcagtcatctttctaggggaggggtaaatttaagaataaagctgtggaattggagtactttggaggtaagattgtcttcaggagttgaaaacttgaatgctatgaccagattctatcactagcaaattctatcactagaaagtttggccaagtcttggggcttgctttctctgtctaaaaattgaggctgtgggctagcgtttggaagtcccttgtagcactaacattattaatgtattttttatagcgctcttgaccctttctataaatacatgcccacacatctacatacaacatacttggagcacgttggaaggtcacatgagctaaaaatgcacctcggagtagttcacctgctccatgcattttcttcttcctgtattggtttcattgtcctagtttgttgctcaagtagacattgactaaatggtacccaggatgtgtatagaatcttaacctctttcttcaattgtggaacacatctgcacttaaaaaaacaaaacgaaacagataaacaatcttccactgtatttatttcagcttcccgcattagtcgtgagattaggtgggtaaggaggagggaggtgaggtgtcatctaaaaccaccattgtcaatcagggctccacctgtcaattcctatttgcagcgcttgttagaagaaaactctgtgggagtcccttccccctttaaaatgcaaaatggggtgttggtagtgaagggtgcccatttatttttctgtgtatgattccacatttaatattgtaatagaattaatttctttctagtttcaaatgtgctgatttagacattttctgcattttagtttggataactaatgcgtgaacattctgttgtcagatgttgacctttatacaccctaactggatcaagaaatgtcagtaacagtgacatctagcattcttaatgatgttgatttctgtttaaaactaaagtcccttagctaggacacttctgttggtgagatcattgatactctgggatttctgcttgcaagaaatttacttgtctgaaaactgagtagcccttgaaggcaaagacacactttatattccaatagctcctgtacgtagagcttaatatttattgaatgaatgacagtataacttttcctttcaagcacaacattcaagagaagaaatattagtttttcattttgaaatcccttgtagctttaaaaaatcttctacctgagaaaatttctttgagtttaaaagaaataaagcagcagttaagttttaaatgttattttaaaacatattgagcctatttccagtaatgtttttgtattttgttctaggctcttaatatttatttcatacttcagtattcctgggtgcgtgtacctacttccaaacagaaagttttgagaaatagtctggagggcttctgtgtctgttaggtagctccaaattgaaataaaatataaaaatggaagacgaaggacagttgctgtacagttcacaattagccttaatttgtagatctctgctgggcccagctgtaaagtttattggtataaaatgtgttcttgatctggaaagccctcaaataaggtgccttgctttccaacaagcaggaaggaaatgttaatgccagttttcctgtggcttctgtttaatgtgaataggatcctctgaggagatttaaaaagcggctcattgcccttgaaggcacccgtatcagatgaagatagatctaaattcgtatttgaataaaaaatttcatacgtcatctgttttcccaaactaaatttaaagtttagttttaaacttttactgtaagttattttaagtaagtcaaattttctaattttgtagattcatttgcttgagaagcattctatactgattctctactccccaaaaccaagtaatctgaagtagttttccaaagttggggataatgacctatgttctttgaaagaattcttaaaatttccatctgatatcttaagcatatagggctgtagtgcatttcacttcatccttgaataagagggaagggggctaggctggacatgttctgcagcttgtgaggtccttctcctcatgtaagcatggtgccatttgctcattctggcttagtagagctgctcttgggcactaccatcccgggttgtgaagggtgcacttaggcccctgcatgagcagataccctgggttacacatttggtgttaaaataagctgagaagaggaataggaactctactgttttaggacttgattgttacacctccagttcagaatttggggtccctattcaaagtcactccacctatccaagccttcgatgtctgacctacagaatgggaataatgaaaggttgattgtgatgctttatggtgaagccctcattattagctactttcttttctcatttttgaattgggattctttggaagaccaaagaaaacttgccttaatgaggttattttaggagaaatattggactttaaggcttttgtttctttaatgctttgtttctctaatactcttcaaatcttgcatagggaaagattaggtctgtcccctgcacccacccacagagtccttggacagctgtgtttaaaagtgagggcttggtttaggtttgctgggagacctcttaaagcttttgggaaaggaaagagaatgggaaactacaaagggcttaagatttttcttttcagtggtaaatagagccctttcagggttttctaattcttaatagatttcttgcccaactgtggtctcttatttggtgtgttaggtctgtaaagaagcttagtctagcaggaagcaccttgggtgtggtaaggcaattaggggctctcaatagaagatgcactggtgacctgcatgtctttcaaactagggtgttggctgctgggagtagcaagagttactattgagcatcagtgacaaagaattaatcttattaagttggaaatggggctggatattgtaattagatgtgagagacccagtgatcagacttgaggattgtaggccctcaaaactctgcttttccccactcacgtggtggggtggagtaagagtacaaaatcttgttttttatggagggacatctaggttctagtccaggtttcaccctgagtgccttaggaaaatactcacttttcaggtcctgggtttcttatctcttaaaatgcgggatgggaaacaaggtaacagataggattgcttttctcctctaaagatctgactaggtgatgttagaaccaggggaaggtttggtgctactcctgacttcgcttgttaagaagtcataggcgagaggtactcctttgtattttgggttttttggtaggtagtttggagatagagatggaaaaaaattttaaaaagcttctgtgagattgcattagattttcttaggctttctagtcatattatgtctgtcttaattgtgtaataattagcactttaggaaggccattatgataagggttttaatagttcttccatccttcactttacatgaccaccacctgggagaaaattttgtacacatatcaaggaagaaaatgatcaagttttggatttaagaacctaattgttaagtcttgattaaatgatgcctattaggttgtaattatatctatctataaaaaacagatggtggcagatttgattgctgcatttcctgaagcagttttttaagataatgaatttaattacacgtgtgcctgggaaccattttaaaccatcgagaagggaaaaatggacaaggcctattggaaatggaaagtgttcacctaggtgtatagcttttagcttgtggttttgaaggataggaacagaaaaatctgactcctccctcgtctcccttcccacacacaccccctacaaaggcagaatccatattctgatactttatatgaaatgttacagtaacatttatcagatgtcaaagggtatggcatagaagtggttgtgtcagcataatttgaaggctgcttctctgtgccaggcactgttctcagcagtctacatggattcactcacttgagttcttacaaaactctgagatgtaggtggtataattatctccccacccccgccattttataggtaaggaaatggcacgtagagtgatttaagttacaggcccaaagatgcagtaaatgacagagctggaattagaactcacgcagtctggcttcagagtgcacagtaacatctatactggaattctctctgcccaggtgttagaactaaattatttaatcaaataaagggtcctgttttgctgttgcgacctttttgcactaatattatgaactgtctcctcagataaataaccttgcagaatttaggcacatttgagttagaatcttgtaagagacagttaaaggacagctttggctctgtcatcctgcctgaaggtttcagtggctccctattgcttacagaacagatttcaaacactttcaggcattcagagttctcccttctttgccggatgcaatgtttacttcatgaactagccaaataactttttctcttgatcatgacccatgaattcttatcccatactttttttttcttttcttttctttttttttcttttgagacagagtttcactcttgttgcgcaagctggagtgcaatggcgtgatttcagcttaccgcaacctccgcttcccaggttcaagagattctcctgcctcagccacccgagtagctcggattacaggcatgcgccaccacgcccacctaattttgtatttttagcagaggcggggttttctccatgttggtcagattggtctcaaactccagacctcagatgatccacctgcctcagcctcccaaagtactgggattacaggcgtaagccaccacgcccgcatcccatactttttattcactcaagtatatcattatggcaaacctaaatcgtacacctggtgtcctttaaaaaatctcctctcagtccctacctttaattatttctgtcattatctaccacccatgcccctcctgctaccaagcaccctttctgttttaaattcccaatagctggcctttgggattttattgaagtgtatcatacatgagatttaccagataacatgaagatgacttacacatttcttcatttagtttgtgtttatatttacactgttcctgtgatgtgctagggacttagcatgcattacaatttaagatcagtttaatgatatttagaaagccgtgctgtttttgtagtgcctttactggttgtatttttttgaaaacgcctgtgtttttcttttaaacagaggatagaggttcacttttgggcttaagtagaattagtaggattcattctggattttggttcatttttgtctcgaatcttaaactcttcaaatcctattgttagctgctcaggactcagctgggcagatggtagctattgtacaaattaggacattgaagcataaaggtcaggttaattcaacctgtgtccatttagctaaattggctaccatgtcatgcttgtgagttggactctgcatcaaccagctttgcagtccattgtccctgtcctcattctttatagttagctatctctcaaatgcatccttactatttggaatgaggaaaatggggttaaaatgaagagataagcaagtcagaatctattttctctagtatattccatgactgatattgaatcagtagaataacctatacaaaggacgaagggcaagggcaattgttctcaggatatcttttacatatttgggatattactctgttttgaaaaaaaattatagagctataattaaatatcttcttgtgcagggaactaactctacgtatagatttggcaataatagtgtcaaggctctccgtaaggatggtgtaaactctagatatcttacttatagacagccattgccctagtgaggcaagtcatgcatctttggatcataatgactaagcagcagaattttaatctggcaattttgtgggtttaccgttagagtgtgaagctgtttttgccttttggcagtattttgctttcctcgagatgatctcagctttcattaagatttcatctgactgaaaagattgatttttgagtaggtgagagtccttttatgtgatgtctcaaaggacagagtatgggtcaaatcgctcttcaaatggacagtaattgtgaggaagaggctttttaaatggagattgcaagttacccaaaggttattagaagtaagagcttttatatgtaataagcttccacatttgtaaataacaagaactgtaataacccagtgaaagccccataaccagggcttgaaccagagttgtatgttaacaatgatcacccttctaactctagtgttttatagtaggacctagaaagttcatcatttgtcttttggtttaattcttctttggattgcagaagtatattactgttcaaatttttgtttctcataaaaattaagaaacaattgaaggtccaaggaccaaaatgggtacacttcgttttcataatattccaaaatctggtgggaaacaatattgatcaagaaagtaatttaaacatccacttatgcatttttcccccggtttgtaagaaggtggtggtgctgcagagcgggctgtgaagaggagtcaatattaaaaatgattgtttagctcttagaaattatttcctggaaatgctaaatagcaataaaatcaactttcagggaggagacacattgccattaaatgtcttgtttttgtctcagctttgtgatgaacaaaggaatattcgttcttaaatatgtggaatcttgagattttaaattccattttaatagtggcaacttaaaatttcttctctgtaagaggttctgtattttatgacagtcctattttttgagacattttatatatcaatgactatggacgtagtattttccagtacttacaatgttgttttccccatttattttttatttttatttttttgagatggagtcttgctctgtctcgctcaggctggacagcagtggcgtgatctcggctcactgcagcctccgcctcccaggttcaagcgattctcctgtcacagcctcgcgagtagctgggactacagccatgtaccaccacacgaagctaattttgtatttttagtagagatgggattttaccatgttggccacgctgttctcgaactcctgacctcaggtgacccacccacctcagcctcccaaagtgctgggattacaggcatgagccaccacgcccaacattttctccatttcttaaatagacactggcaggatcttaggttcttagggaatcttatataaaatataaacaaactacccacttaattataatgagcctgtggtctataaagataaggacttaatttttcaaagttgttgactttgaaaatattgcttagaaatgtgttttttaatgtctgaagagcagtaatattattttactcctttagtttgttttgatagcagttgatcaaaagctattataaggcatgtatacagatgttttgtaggtgtgcataagataaaataaggtgggaaatttggttaaagaagtgttcatcttctttagctttagttaaattttatttttctaggagctgtatatacctaatttgtatggtcctggctctctacttattattaaaacaagagaagatggaaggattaatgcatactctgccatattttatctgtattccattggtcaggaaatcttcccagattgtagggagcattgccaagtggttggtgtactggatctgaaaagattagactggtttccccacacaaattttttcatgattttcctaaacattaaggattgatttgtacaagctttgtgtaattttaataattagtctggtttgactaatgtagttatttgatgtaaaaatggttgatactttggaattctcaaattctaggaatgtttaaaactgaatgtatcttattcagccttgaatttgaaaaatgggggctgtctatccagtatggattagggtatatattttcactccctaagaaaaattgttgtcctcagaagcttttaggaactctggcaggacagcttgccttttctcctgcaagaggcctgctgtacgtgtgtttaacagtcaatctgttgtagaaagtgggtggttcttttcccctctttaggggaagctgatggcccagcccttttgggcactcagtgttctaggaaagtgtcactgaagtccctgaatgttacactatcagtttgcttttgattccaggccctgattgtagatgtcattggtgtcatttctttgccctaccaaccctgaagttagaaggggaaagataagctcatgaagcagcttgaatgctgttggtatgctagtcagtgacattggagtatctctgggtgctgctgactgcagtgccctttgatttagatcacaatgatgaaagaactaaagctcttctagaattttatgtctccattctggttgggtttctatataaagatgaccacatacaggtggagtcattgatggggccttacaaatggctgtatgatatagtgcatgctaagttaccaggaaagagctcttggaggactgtttttaaaggggtaagcaaaatttattagagaagatcagcaaagcttataatgaagagcatgcgtgtaaattggaaccagtagggagaagatcatgagtggagaaaatagttataaaagtttggaggtggaaagtccactgagtgggacagaggctattttgggggcatgtaaaaatcaagagccaggtattcaggttgttggaaatcttagtatattactgtgttttgtcactcacatgatgaaaatcaataaggatccagtataggttacgaagctcaggctctcataaagagagtgttgaagaggcttgttatgatgttctttggaggaatgataggggaggggatcgttgaaaattgggaaaatctgagagactctattagttttgttgctgggatttaggtgatagctttagaaaaaaagttgagggtttgagagaagaactgattgagctcagatcaaatctatatgtgtgtctcatggtctctagaccttacttaggatgataatacttagggggagatgagagcctctgaaaactctgaatttcatttgtgtcagatcttcccattttctatttatgtggagctgaaattggtaccatctttcagatattgtgtaagtacctggcatgatttggtggaggtaaaagcctatttgaataaaatcagtatgtggcagagcagcagttgagggtagaaggttttgccataacaagccccttgtgattgtgtaatgttcttcagaacttctttcttccagctgccatttagaaaggaaataagcagagaggacattccaaattgtcacaacaataggaataaaagcaaggaaacaggccaggcagtggtgcctcactcctgtaatcccagcactttgggaggccttgcggggagggattgcttgaggccaggagttcaagaccagtctcaacaacatagtgaggaccctgtgtctacaaaaagtaaaaaataaaaaataactgggtgtggtgatgcatgcctgtagtcccagatacttggaaggccgacgggggaggatagcatgattctaggagttggaggccaccgtgagctgtgaccacaccgctgtactccatcctgggcgacagagtaagaacttgtgtctaaaaaataaaagaaaaatatgaaaaaaggaagtaaataaaataatgcaacagattcagaggatggttatgggtcattttgaccttatgcagggttttggcttgagaagttgggagaaaacattagggatggattagaaagttaaaaaggcccttaaatgaaggtctgtatgtatacaattgatggtatttgagcaagtgatagcatgagatgtttttgggaagttgaagctagccattatataaagatgagcatgttggaggaggagacagatttgaagcagtgtatatgatgataaaggcttgccctggtctcatgggaattggaggatgaggggtagatattggtagacactcattttagtgaaggtaaattagcagttatggatagatgacagtgttgattcaaaagcgagggggcatggttcagtggctacaagaaggtgctctgacttatgatggggcttatgtcctgataaacccatctttaagttaagttgaagatgtcataagtagaaaatacatttaacatacttaacctgcttaacatcatagctttcgcctagcctgccttaaatctgcttagaacacttgcattagcctataattgggcaaaaccatctaacacaaagcctgttttataataaaagtgttgaatgtttcatgtaatttactgaatactgacagtgaaaaatagaatgatggtgtagttacttgaagtgctgtttctactgaatgtgtatcgatcttgcaccattacaaagtttagaaactgttaagtcaaaccatgtaagttggggactatttgcatacctaaggttcagattccaggaaaagattgggtggcagcaatgagaggaaaagacaactgagagattaagaattggtgtgggggttgtattagtttgcttaggctgccataacagaataccatagcctgggtagcaaaaacaatagaaatttattttctcatggttctggaggctggaagaccaagatcaaggttttggtagtgttggtttctggcaagaccactgtttcaggcttgcagaaggccaccttctcactgtgtcctcacttagcttttactctgggtatgtaaagaaggagaaatcattggtgtctcttccttttcttatatggacaccaatcctattggattagggccccatacttgtgacctcatttattcttaattatttacacttatgacctcatttagccttatttcctgaaataattaaggaaatagagtgaaaaacagagtggttgtgtagttacttgaagtaccgtttctactgaaactactgaactacacaaccctgttttcaaatatagtcacgttggagattatggtttcaacatgttaattttgggagatacacttcagttctctaacaggggtaagggtatttaatttctcgaggcatgaacagaaatgattcttttcccctgaatttctgatctacagttttagtttttcattccagaagggaaatgctttctcatctttacgattggtcaagactccttgctcccacccctgcgattagcatttgccgttttcaacctggagatttcttttccatttaccctgtctgtacagtagtttgtgaccacctctgccttttaaagttgagttttgacaattgatatacaattgatttcttctctaacctcttcagttttatagtttgacctcttgttacaaactgcttttaaaggcaccatgcttatgctttaaaagccacttaaacagaacatatatttagaagacaggatgtttttgccacagatgtcaagagggtcttggcagtgttttcacagaatgtctgctggtgtctgtgcagctctgagactctaggcactctgtacttagagaacatgtagaggttaagtgttcatcaggagacctgcgatgtttgtgttggaaatactaagagatgtgaggtttaggatgttttgtgttgtgttgctctgtgtgctcgtccagagcagacatcctcaagtcagaacttaatgaggtatgcggaaaatcaccaggggaaccgtaatatataaaacataaaattaaagctctgggatgaatggctaatgcctagttacattagatagtcagtttatagttatttgctccagcctaatttggctgtctattcaaggtaatcagcagagagtcaaacctttaactttttcttgagggactgcagtgagccttttagctttctttacgttgagctttatggtgacagatgagatgaaggatactatttcacttccttcaagtttttagtgtggcctcattatatttgaaagtgaattcccagagcagccgatatgcctgtaactaatcctaagtagaaaatctattccaaagcagaaaatatattttggctttacctgtgcagtcacagactgggaaagcgggtattggggtgtctaataatgtggatttaaatggtttggttagaatatctactctcctttcatccaaccaggcatttccatatatttttgtattccctctctttttttctaccacagaagtttaatttcaagattttctgtctcatctctctctggtattcattacacctgttacatctgttttgtttccagtacaaaacagcactcggacctgcctcttttacattggtcctctaaccaaagaatgatttaggagaaaatttgtcatttgttgaaaggttgttttttttttttccccttttttaccatcaacctgtcattttgtgtatcttaatggattattcaagcatttatagccctttgaaaactttggtttcaggcattagaaattaatgtaatttaggaacatggttaccccttaccttacctctgagtgtcctacctgtatacattcaggaaagggtttaaaaagcatagaacacttaaaaacttcaaatatgttttctcatttataagtgacatttagtaaagtcttgaaagatataagaagctaactgttttgcaaccatactgttttcctctgggctgtctttaagaatgtttatttacttttctggggaagggagatatgtgatagcttgtataatacgatacattatttaggaagcaatttcttgccattcagattgtgggtttcggatcatttagctaaaagattaccctgctgagtgcgtggaaatcatcttaagacaaaataaggtttgtgaaaatgaaagttgaataggaagttgtgcagatgaccaagctttatcattcagcaggtgtcagattttaagttgtgtggattcttttgagaaataattaaaagttttaccgaattgtattactattttgaactgtttcctcaatactatgcctcaagaattcagttgaggacacatatgcattttaatacgtaattttgtatgtagcataaatttaataaatcacttaatatataaattcactatttgtgaaatgacggtcacttcagtagggttaggggacatacattccaccttaccatttaggaaaacttgcatttcttgtggctgcgtctagtgtctgggcactggcctagactgatatagagggtcactgaccctctgtatagggactgaataagcagtccctctatatagggactaataggaactgaataagcaggccaaacttctattccccatttactgagtctttaacaaggccatctaaagttgtaatggtaagaaggaaaaaattgggggactatattcttacactgccctctataagaatacagaagccgttggtctcttttcttttgcttggatggcagtagttcctccttacccacagtttcgctttccatgatttccgttacctgcagtcaactgtggttcacaaatattaaatggaaaattccaggcataaacaattcacaagttttacactgcgtgtacttctgaatagtgtgatgtaccctcatgctgaccagtcaggatgtgaatcctccctttgtctagtgtatccatgctgttagtcccttagtatagccatctcagttataagattgactttcgaggtattgcactgctcgtgttcaagtagcccttcttttactttcagcggccccaaagcacaagagtagtgatgctggcagttctgacatgccaaagagaggatgttaaagtgctccatgttccctttaagtaaaaaggtgaaagttctcgacttaaagaaaactaaatacgctgagagatcacatatacataacttttattacagtgtactgttacagcagttcttagttattgttaatgtcttactgggcccagtttagaaattaaattttatcataggtatgtgtaggaaaaaacatggtaggggtcagttctatctgaagtttcaggcatctattggggcttttgagtgcctggtaaaaaggggactgccatatctcatatatttattccaataactgaatgagatgataggattattttctccatttcctaaatgaggaaatcaagacttaggatggcaaatgctagaagggatcaccgtagagttaacagttgtaactactaggctatatccgattgctcagcaagctctgtttattgtcactcacttgttatattttatatcctggtccattggctttaggttagtcaactgttattttttccttattttcctaaaattcatacccattggttacattagctgtaaaagtcattttgtgctcccttcttacctacagtcttaaaagtaaaaattttctaacctgtagttcattctctcagcaaaatgattccaacctggttttttgcgcctttttaatcactgcttggactaaagcctgtgttcagactttccctgaagttagtctggatcagctctgcctcagcacctccactgtttttgaacttctgtttgccctctaaaagctggatgaattccccagtctctgattatttgactcttgtttgtttggcactacctagctgatagtccacttgtcttacaaaagtcttttacagtggttctcatccttgcttgcagattagaatcaaatcgggtgctgataaaaatgccagtatctgggcccttaggagagattcttatttaattggtctggggtgaagcaagatattggttattttagctgcttcattgatgtgtggtgcaaagagcatgggctctggagtttgttagacccacattggcaggttttgtgagttctggaaaagttaatcttttttttttgtttttttaagcctatttcctcatttgaaaaatagggatgaggccaggcgtggtggctcatgcctgtaatcccagcactttaggaggctgaggcggttggatcacctgaggttaggagttcgagaccagcctggccaacatggtggaaacccatctctattaaaaatagaaaaattagctgggcatggtggcgggtgcctgtaatcctagctactctggaggctgaggcagtttgcagtgagctaagatcatgccattgcactccagcctgggagacaagagcgaaactccgtctcaaaaaaaaaaaaaatggggatgaaatgacccattttattaagttattaggatcacaggggggtaatgccctttaaaacggcttagagcatggcctagcatatcctaaattaaattaatagctgtcatcctaccctgtccaacaatgttgtcttccttttccaaatgctcatattctttctcacatttgccgtatatatatctgttgccctttcctcatgtttgaattcttgtctttcccattaaaatttatttacaggtccaagttcctcagtgatgttttattccattgtgtgcttaaataaaagtgtaccttttatcttttgcaatatattggacatgaaaaacttccaaagagaaatagagaaacagcatcagaacttctttgaatagaaaagtaaactgggtcatgtgggtgtcactttaaaattccagtggcttagatttttaaaaggctttcctttctctctctctctcttttttttttttttttttttgccactaaaatctgttactgagactactgcaggtttcctgcttatatactttttgaacattaatgtcttcgttttctgtcttaacaggctcctggtcctatctgtaccttgaagtttaatattttcctccaagcttcttatagcttcagggtaactttctgagtgatacagtctatctccagtaataaagggcagatcaacaccagttgaaagggataactgtctttctatttttaataggtacatttttattgagctgcattttttttttaaagtgtgaaagagactctcgccctcaagtttcattgttattcttctgatatgtcagtaatcacctttgggttgttgtcatttcagtagctcagggtcaatatatattgctaagtcattcatgtcctgtaaatttcagtatgaaataagcatttactggttccttgcctgaatagtctgagcctatatagtttatctcaatataaattagatctttgttgcttacatcattttgatgaaattaggtattatggttataatttttttaaagttctccttgactttcctggtatgttaaacagcttttctatgttactttttaaaaaatagtgcacacgatgtgggctttcacagcaattcttctggaaggtgacttttcttcattgttaacagagataaatactctgcatttatcacaaatgtttcaaatgtccttggatagacttagaagtctctcaagttcagctagcttgagacagagtacaaaatagaatgtagcatcagtgaagaccagtcaggctgttcttgcagtagatcactatgccaggtgacctcatagtgaccttcaagtaccgaaaagtctgggattcttacttattttacaatctattctttgggaatgtaaattcagtgaaaaagttgagatactttatttttgagtgggacccagtgtctcttcctctatcaaaccgatcaactacttttcccattgtgtgtcctctccagttttgatctgttattctgctcagactggagctggtcatatgctttggaaatacctgtttacagattgatgcagacctggagcagctgctcattgacagaataggtctagatttctatgtcgtgactgattcgtactcatactgggagttttgggttaacagacgtgagacagtgaggattgagctatagtggcttcaatttgaaggggattgtttcctcccttgttatttttgttttcacactatccttaaagtaatgcaaaatttgggagatatctgattaaaaatgtttcattttgcctatatttgacttgtaggtgcagctgtgataactaaaagatcctaagtccttttttgtcctccaggacactaagttaaattcatcaaaattctcattttataatatgctttggtctatgtgtgggctcttacttggctgctgaagaacattgaattgtgtgaacttgtatgactttatcttcatatctttcttgttcatcttccttgataaacactttgttttcatttcttgtgctttgatgaacagtgctgctgtgaactctgggagtggctccctctactgcctcaaccctcattgtgacagttgttccttgatatatgtacttctcagggaagtacaataagaagtaaaactgtacattgtgggaggggaataataggtttgtcaactctgttttgccaaggaaaggcatttaagaccatctgacacattatctattatcactgtcatttcctggtttgcttagatgccccaaagtaggatgcacgtaacttcacaagagaaattgaatatatttcactttacaaaaaactcattacatttcttattttgcctggaaccaaataagatttttcccacaatgtctagtgaagtacttggcatttaggcccaagtctacttatttttccctacggatattaagtgtttcttgtacatgatcaatttactgaattctgacattccacataaattctgattaaaaagttaattggcagtgtgatgtaatgggagttacaggttgtgccccacctctgcacctacctagttcagaaacactgagccagcctctgggtttcatttccttcatttgataaaaaggaatggttgaggatagatgggtttcaagatctctgtagcttaagttttatccataattgtaaaactctgcctgctgggttccacatattggatgtaattgcatccctaggatgacattcctcagggtacaaattatgtcttattcaccagtcccactgcccccaacactacctagtatgtgtgtggcaccatcctttaccttccaaagaccaagtattacatatatgtagtcatgtttatctttagatctcagcttaaatgtcacttaatctgcagaaggcttttcttctgatcactgtcccagttttattcccacagcatccttttttccttcatggcatgaactgcaattctaaacattagctttattctttggcttgtttaatatgtctctcccactaagttcccttagtacctgtcttgtttatgctatagtctctgtgcccagcatttttgtttttgttttttgagacggagtcttgctctgtggccccaggctggagtgtcgtggcgcaatctcggctcacagcaagctctgcctcccaggttcacgccattctcctgtctcagcctcctcagtagctgggattacaggcgcccgccaccatgcccggctaatttttttgtattttttttagtagagacggggtttcaccgtgttagccaggatggtctcgatctcctgacctcgtgatccacgcgcctcagcctcccaaagtgctgggattacaggtgtgagccaccgcgcccggcctgtgcccagcattttaaaaatgattgcaactatgtgtactttgccctttatttgaacctatgacaacagagagcctagtgcacatggcttttctctgttctgagcctgatttttttttttcatctgtcatccagatacaatctctccttctcacacttaccagattgcgtcctgtgttgtggttctgcatgtgttcccttctttgcttagacagtaagtgggaactccttatctgagtcatcttggttatccagcacagtgccctgcacataggatttgcatgttagaatgaatgcagatgtctgtccttcaaatgtgttgatatttgaggcatatctgttttcttctgtgtccttttagtggtgactaaagccttatttgaaagctccatctccaagaattcctgatgcctttattcaataatgaacctcgttgttttcaggttagtgcatggccactttgtagttgtgcagaattgtaccagtttttcatgctctctgaagttacatgtttttcttcagtttaactttcggttttccttggagttactccatttaagtggcttcagactgtgagctgagtgagatcttgctgtcttccagtcttggcaccttgaatatttacttttgtttacaagctagtttctctttggctgtttttaatttggaggactaaagtgtaacaaatgaggtaaggataattctgcttattaatgtcttatctggaagtatgatgacttcacgcctccggagagtagagtttggctacctttcacaggtattggagtaaattccaggtatgcttattgcccttttgagataagagtttgttggatgcatagaaaatgaagtgggctctcactctagccaaatagttaccagttagtatcttgggatatctgcagactcagctgagctctcaaatgggagaggggatgaaggcacaatgagcaactgagatgggaagctgggattggaaagagaagaggctatcaaagaaatttgtcttccttcctggtttcacttcagctcacttcttgtgccccggggtctccatccttagctatgcttccacatcgggcccaagtctgtttaccaaaccttggtggtcaagcaggctggtaaatagtttattaataaattcaggtagaatcgcctcattggcagaatataccaagaagtatttgagcatataaagtggttttcttggtatgggatggaacgtatgctaattgtcttcaggctaaatcttagttcatggttgcagctctttaaaatggcttaagctcttgcatggttttttgttttggtttggtttcttttcgtttgtttgtttgttttttggagacagtcttgctctgtcacccagtctggagtgtggtggcaggatcttggctcattgcaacctctgcctcccagattcaagtgattctcctgcctcagcctcctgagtagctgggattacaggtgtgcactaccacacgcctgtaatttttttttttgtatttttaattttttgtatttttaatttttgtatttttagtagagctggggtttcaccatgttggccaggctggtcttgcatgtttttgagaatgctaagactctgcgttaagcactatgctagcctctgagcaaatgcttacgatgtactttgattttgaatttttcaggaatagctatagcgtgtgattcttaaattgccaactaaaacatcaccgtctgctgttcagtaataaaagtgttttgacttggttatctgcttggacatttttatgttaaagaaacttcttggtcgggcatggtggctcacgcctgtaattctagcactttgagaggctgaggtgggaggatcctttgaacctaggagtttgagaccagcctgagcaacatggcaaaacctcgtctccacaaaagattttaaaaaattagccaggcgcggtggctcacgcctgtaatcccagcactttgggaggccgaggcgggcggctcacgaggtcaggagatcgagaccatcctgactaacacgctgaaaccccgtctctactaaaaatacaaaaaattagccgggcgtggtggcggttgccggctactcaggaggctgaggcaggagaatggtgtgaacccgggaggcagagtttgcggtgagcagagaatcccgccactgcactccagcctgggttgcagagcaagactccatctcaaaaaacaaacaaaaaaagatttaaaaaattagcggggtgtggtggtgtgtacctgtggtcccagctactcaagaggctgaggtaggaggatcccttgagcccaggaggctgcagtgagctgtgatcacaccactgtactccagcctggttggtgacagaattagaacctatcttcaaaaaaaaaaaaaaaaggaaagaaaaaaaagaaacttttcttaaatatgctattctgctgtatgttttggtggcttaaatatttggtacttggaacgtagtatattgtagaattcctgatctgtttggtgaaaacatgaccttttgagggaaagaagaaagcaaagcctggagtgtgtgtgtttatgtgtatctttgaccattaatttgaatttctcaggttgcagtgataatggcagtttgaccttaccataaattaaagatgtgtttttaggagagcatgaaagcagaaaacaattctcaagaaggttagtgccttgagaacaataccctactttgtatagtgcctgaaattttttataagccattcttttatctgtaatttgttataacttatttcttttaataaccctgttcgctagcagagtgagaaaaatctgttcttaatagatgagggaagttatgaacataacaaacttgttgagggtcacagaatcattaagaaatagatttaggaccagcagtgattgtctttggactttatgtaggcttttaccttcgttctagtctttttttccatatccctgttagtttgttagcctgggacttgggaatgagataattgcttctctgaggccactcctaaccctgactgttttatgtgaaagcttaaatttgctccaaatttcctgaatgctacatagtgttgtgacttgcccttttttggccttaatttacctggccatgtcttaactctcctgaagagctgaactaaaatcttcattttggtataaatggatgccttaggttctgatgttttagttatggaaaatagtgcttatgttttgggtgctgctgtgtgttacacatgatcatttgatttgagtttagaccaaatactcttatttctttaaccttgaccattaatgaagaatataagaagaatgttggtataagccaacatagttatggatgtgagctaagaggtgtgtttaagttttacgaaggtcacaggaaattgaccacaaattttctaagaaaataattataaaaagactcataggattcaatattataaactttcaacaaattgaaaatatgcttaaaaagccattttccaagtttattaagttggaaatttatcttaagagttaataacaattgaatgtccagggggaaccctaaacactttttagtgtttatatttgaataaatgtgagagcttcacattctgtttagaaaattctctgttgttagactgctttcttatttttgaatctcatgcatgagattaggaaacaagtgtaaaatgattattataatttactattaataccaactgttgatctgttctcagttcaaaatgttttataatacagtcctggaaaagagaatcaacctaagttatgtgtgaggttttgtagaatagatgatattctctgcagatttaggaacccatactttactttgcaatagagattggacttggaagttcatgaagtttttttttttttttttttttttttttttttttttttttttttttttttttttttaaggaacactatcaccgattctggggaaaaaaaagaaaaagccaatagcattaacataatactctgcaaccttaaaggtttgcagttgataaggaataatttaatgtgccctataaaacccacagttttggaattgctccagctttttatttttagctgtggcttttagttaatgagaagaggtgaaaagtatagtttctcctggtctctgcttgaaatcacagaaactttccgcgctgtgaaagttcaggggattttgggagaccatccttatgaattggatggtggtgtctcctcctctttgttcaggcctctttttctagagaatagcaaagaatggtgagttgattaccttcagattttaaccaaactgtaattgctctgatattgtcaaatgcacctagggacagtgttgcagtattttgaaaccttacacaggaaacaaaatagcagctttggaggcagggaagaatgcattagtttctgagtctaaggaagccagaaggaagcccgcccacccactctctagctttcatattccctcagccacctcccagatcttccattgctgtgctataaatagccagtgtttaggcagggcgttgctttcttcccttgcctttgaagactttctgcaggccctggaattgcctttgttcctctgtctgcccactttgccagtgtgaagcaggttttcatgggattctactggggtaaaccaaaagcagcagaaaaagtgtgaagtaagacctcttatttacccttcagttccttccccacttacctcctgttttacctccaaaatacaatttgtggtttgtcatgagacagtttttagagcgttaacctggaaatttaatgttaattcaagggcttctggtgtagtgccaggtgatttttatcttttttgtgtgctgccctactcactgcctcatcctggggataaagcacttcattggcccctcctcttctttctcatagcaaaatatttgattaggtttgaattaactgtctcaaactcagcccccagaagggacaggatatacctaattctttgtggacaggatgactttctaatccaaatccatagtagtataaacaggccaaaatgagttatttagagtgctttgaatgtctgtggcagtcatattaggatgtttagtgacacagacttgatgcttttttgcctcattttttgttatgcatattcattagaatattttcacagatgattaggtctacaattaaagatcctcagtttagatgaccttggaaaaccccctccctcccccagtactctgacattctgaacctctccatcatggtagaaaagcatatactctttagcacatttgacatttaggctatgatactcttttacttaaaatccagcccttgcaggggccggaacattaaggctgtattgggagagctggaaagaaggcaccccatttatagggcaacctgctggctagtagctctgggaatatggactcttgccaaactttatttattaagcgaaatcagaaatatagttttatgaatgtgaaattgttacattggtgaaattttaaatgttgaacactactgtttttgtttgtgttttgttttgtttttaaggacgttggagaaaccacgtaacatgttttcaggctaaatctacccgctagctgccagtccgaactttggcctggaggttgaggagagttacagaatctgcttgtttttgtctatcccttgccacttttcctttgtccttcttttcaacctcgcacgtgatttatttaagcagagtccattgttggctttttattttttgtttttgcaagctggccctcggattctgccatttatttgaatgcttaatactttaagtagacttttgactcccatcccctcaatgttttcttcctgctggtcatagccactctggggggttttgttcaccatgcccttaggtatatgatgtactttgtatcaggaagaatgttcagagtggccacctggctgctgctgtttatgttggccatgtttattagaataggtcttagttaatgtgtagtcaaccttggtggataaaaaagattcacttgtttccattttggttatttgtaatgtaggaggccagctgtctttattcttggcaagtaaaagtatgggtcattttccagttagagcaagaagttacttaagagaactaactgctgtcttggtagccagcgatgcagagcagttgttcttccttaattgatggcaggcaaatttggtctaattactgttccagtgcagtggaagttttcttcagttttaatttaccgttcttgcttctacctcatgataccccccgtttcccacttttgctctttagaaatggagaataaagaatagtgtcctgatgactcaactcaattccaaggcctgcagtctccagatctttgttgtgaatcctgggttttagcctgacaaaggatggatgtaaaaagcatgcttgggtggggcagaagggtatagaaagggcacgtttctaaaccatctatttcccttatagtgattctcaactagagactggcactcagaatcgtcaaggaactctttaaaatagtctaagatagagcgatagagtggcatttgagtagatctacactcttcacagaagaattgaaaaatttgggttcagggtcatggttccctttagaagagtggtttaaggatctttttgttcatacccatctcagattaaagtagtggatgatagcgagaatttctttttagctcgatctgaaagagattgcagtcctaactgctgtagactatattgcctggtacttagtaggtacttcctgaaagttttatcaacagttaaagactatttactgctaagcaatttacatgttaaatctactctactgagagttcttttaaagaaacttgtactttacataggatgaagttgtaacaggaaatgggtacctggaaaactctctgagcaattctaaatcaggaaaacttcagcctgctcttctttataatttaaaattttcttagtgaggcagaagtccactttaatgttcagtatcaatgctgtgcacagtctcctgttgtttagcactttaaacactgggaagcaaaatgcctcatttcttctcaaatacgtgtccacactcaaatattgaagttagaagtggtagtttccatagcagcagtgattttgccatctttttttttttttttttttttttgatagcaaactatttagcataggtcaggtagagaagggattatttctggctgcgggttcttaaaggtttccttgtgtgcgtttgacttctttggacaccttcttaggacacaggtgtgttttggagaagttccgtgaggggtggaatgagtggggttttgtacatctttgttttcccagcatctgagcacagcgcttggtacatgcagtagatcaggaatgttgcttttctagccttggggagtttctttactcctctttttggtattctacacaccagaccttggctgtgttggggagagagtataaacttcaggtttcctcttgattttacacattggtgatgagattggcttattttgaactgtgagatggtgacaatggaacacacctgtccctggttcctccctgaggtttatattgttttaacaaaggcttgtagctaggaattaaaaaatgctgattccacttgaagtttgagcttacaatatggaattagtagctatatgcggaaagagatgtgtgtgttagtggtaggacttgacagcctactttcccctttttccccttgacagtctaccttcctctttataaacaacctgagatgactttggctgctcctccagctatacagggttgcaatggaaatttttcccacttggcagggaacataaaaccacatggataagtaagggggttgttttttacttgccaccttgaatcacaattcatggcattcattctctttatggatctgtcttgatattttttactggggagataaaggtgagtcaggcatataggagcacacagagttatctggtccaactgagtggttcacagaaggcttcctcgaggtttgtctgctctcttccggtgctgaggatgtttccatgaggcaggagaagaaaggtaggctgttgcaggtggagaaaacaggttgggtgacactggaaaacactgggagtgggaagaactactgggagcttgttagagcttgtgtatatgatgcgggggtgctgggcatgtggatgaagaggtaggagctcggtcaagtcagctgcctcactagggagctgagatgttacttcataggcaacgtggagtgagcagagctttaaaagagatagtagtggagtgctgcccattattttagttagatccccacagccgtggaatggaggaaggattggagaaaggggcaagcctggaaatagagagatcagctaggaagctctagatggggtctcagcactgatttcaaatcccagtttctcacttaatacttgtgtgaactcttgaagttttgaaattctcatttgtaaattgaagagaatgtaatatagcttatagtgcataagatttgttttggagacatggtcttgctctgccacccaagctggagtgcagtggtgtcctccagccttccaaagtgttggaattacaagcgtgagtcaccttgcccgctccacaagaggattaaataagattttgtttgtaaatatctagcttgagactggcatggaaagaggaatcaataattgctagtttctttcccttgccatttatttttacttttagttgtaggattcgttggattctccagaaggcagggagatcatctgaacttctttactgtagcaaaagatactcaaatcccacggaaagttccttttctatttttcttgtaattaaatgtgattttaaagccacagtttaaattcaggtcatttttgaagatcatgataggagaaagatgataggagagtgtatgattttgtatgaatgtagatacatggatcatttgcctgatccattaattgtggaaacttgatcccatgtgatctcataatgtacacattattaatctagattctagggtataatcgtggattagatttctacactcttgttttctctgtattgtaaatctgaatataagtacaagatgcctggatcatctttggagttcttagccagaataaggaggtagcaatttctaatcttattaaaattccaagagcctgagcataagcaggctcaaagaggatgggagatgtgtatttttatggggagttggggaggggggtgggggtcacacacttttaaaaataaggtaaattaaaataggcaaggctgtaattctaatgtgaagtacttgggctgttagtactctgtatatttaaacatagtctttggaggtctggggttaaaaattgcagcattgcaagtaaaaatttttaacttccttagtcaccgtttgtgactgtgctaaatgtagtttaacatagcatctgcttcagcagtccaggacaggaattaacagtcatgattaggaaaagtctgcatactgtactttctgtccacagtctttcctttccatgttaaaaggctcccaacacgactctgcagccttgctgtccatttagatgtggggggaagaaaaactgacaggcttaatccaaaagacagataagcaaattttctttctttctttctttctttttttttttttttttttttttttgagatggagtctctcgcacttttgcccaggcttggggtgcagtggtgcgatctagactcactgcaagctctgcctcctgggttcatgccattgtcctgcctcagcctcccgtgtagctgggactacaggcgcccgccaccaagtccggctaattttttgtatttttaatagagatggggtttcaccgtgttagccagggtggtctcgatatcctgacctcgtgatctgcccgcctcggcctcccaaagtgcagggattagaagtgtgagccactgcgccaggcccagataagcaaattttctatgctaacattttaagagacatcttgttttgtccagcaataatgataataccctctgttcacttggcaccttagagtttgtaaagtgctttgacattatcagacaaaatatgtatatgtaattaaagcttttaaagagaacagacccctttacctgctcttttccttcctagagtggaaataattcaaaggctaatgcttttgtgatttgagtcttaagaataatttcctgttaaaatgtagcctgtaattgcgtatgtgctcccttctcctcttcagcctgtgggggatagatgtttctcatcaacacttgggaatatgtgtgtataatgtatatacaggttatacatatacatatatgctcatacacttgcttcatttttcatctgtaacatgggggtacttgccccacctactttttgagatccttaagcgttcgtttcaaatgtgctttacttgaatgatactaagacaacttgcaaagcgggaagtctgacaaaagtaggagtaagaggaagctctatgctgggtgagatggtgaggtcatcaatctaagcatattgacccctttctctgttagggggttgttcgaaattgggtgtatgtgcctgatgtggatataagtggataaggtctgaggctaagaagggccttacctgttctatagtgtctagcattaacttttttgaaaaacattattaactcttatatacattcttatgtagcagattaacaagacatttccttgagatacttctcgcccttagcaaccctttcctcactttggaatcactgaataaaaataacacttgcattgaatgtaaattctccccctcccccacttttttttcttgaaatgtagtaaataaccaggaacttaattaccataaaaagtcacagatgtacctaggtgtgttttgttctagctgggatgtcggtttttaaagaaagctgtctttgggggagcaagaggcagaggtggaccaaaggaaataaagttactatcttagggtgtgaatcttgtttttttaagatgcctcaaatttccatagtaaataaaacatagttgtgtctctaaatcacaagtatacatgtcttgggaatctcaggacgttacacatcaacagaaaagaaaaacacatttcataggtgaataccagtaattgagatgatccacagttcagagcagaaggaagctgtctgtattgatcaaggtttttagactccttgttttgctctccacaatacatcaatgaattctaagatatttatgtgccctgggatggcatccctttatttgtagcctcctaatgttactaaggaaataaatcttgttggttgacattttagatgcctttttttttttttttttttttttggtgtaagctgcttgaggttaaacagtgtagcatttggttttctatctctaagtcctgctaaataacagtgaaaaataaaatgttaacctcactggccaggaggagtgttgtggcctttataacatttgtgagttaaaaaacattatttttgtccataaaccttccttgtcttttattttccctttaagattagtcattctttctgctttggagtttgtacatgacagagtattttagtgtctgtatccaacagaggagctatgtttttaacctacctaatgaaaacactcaactactgggattaatttgaggatttccaatcagcctttcacaatttgtactaccctgagggggttcctgatagctgtgacttttgtagaagaatgtgaagttaatccaatttctgtgttgattactatgttaactgtcttaatttagcaattcagattaatctgcctataccaaacaaaacctctgccacaaaactgagggagtagttgattttattcttgttgtactcatatccctttttagattctattgccaaataatggcatggaaattaattgggtccacttaggttggaatgaaagaatggggttggaatgattcatcaccagaaggtaatgatttagtgtattccagcctataaccaagacagagttatctcatggcttaacctttactattgtagaggtatataaatgaccctgttgaaaaatacagattttaaagtttactcccattttacaaaatgtgacttaatctaatcttcatccactttgtttttaaacttttggggagagctttgagctattttactttgaattctgaaagttttaagggggctcacatagattacaaatcaattttctgatatactatgtttagtagtagttgcatgttttaagctactgatttgtgattttatatttgctcctaaatgaatcagttgattctttaagaagctggcagtggattcatttagtagcaaatataaagtgaatagtgaatatccaaccataaagtgaataactctggatttaatatttataaagtcaaaatttttgtatgttgggtttcctatatatatctatatatagatttatatatatatccttattttcttttaaggcacaactgtccataaaatctcttcctttgcttattcatcttgtgttcttagtgtccagagcatagtaaatgttttggtggtttgtaggaatgtgagcagttagtatctaaaccagttttttgacaatggatttcaacagtgtactgatgtaattaaaatgtagcaccttaataatgtgttttcttctgggtatatccagaatctgatgacttctccccaacttcaccctggtgggagtcactgtcatcctgcacctgaattgctgcagttgcttcttgactggtctgtttccaaactcactgagtcttcctgcacacccacacacaatttattttcacagtagccacatgctactcttttgctgaaaaccttttatagtttccttttttgttatggtggccttcaaggccctatgtgttccggcctcattacctcttagactcatctcctcctactctccctgttatctccttgtcattctgcacagcagacaagctttgcactggcaggtctctgcctagaatcttttcttctagatatctccatgggggctgtctttacttcctgttagacctctaacaaattactttaaatttactggcttaaaacaatacaagatttattgtcttaaaattccgaagaacatcagaagtccaaagtggttctcagtgggctaagattaaagtgttggcagggctgcattcctcccagagtctttatgagagattgtttccttgccttttgcagctcctagaggctgcttatattccttggctggtggccccatttaaagccagcaatgtcctttcgatttcttctcatgcttcatcaccctgacagtctcaccttcctctttcacttataaggaaccttgtaattaccttaggcccacctcagtaaccaaggataatctccctttctcaaggtgagctgattagcagctttaattctacaatcttaattcccccttgtcatgtaacataacatattcacacttctgggagtaggatgtagacattgaggggaaggggatttttcttcctatcacagcagccagcccatatctccttcaaaccttggttcaaagctcaccttttcattgaggcctgcttgtttaatgctggaaactacccgtcttcatctccacattttcaaccccccttattcttctctatatgtattccacagcactcttacttattgctgatgtactgttttcttctatgtgttcatacttgtatatgttctgcacacaccatccacagcaaatcagcactccaagatgcttcttcattgctgtacctcaggactctcctgaattcgtgggagctgcatggagatgttcgttgaatggatgaatgaacaaaacatgaaacttaagcagatctttttcgccagatctttactttcccattgctcaaactggatacctgtaatggacttagactgaagagaaggacttgggaccctaaactcattatcttacctctctaacctcaaagcttttgaacctgccagctctgaaactacaaaacctcagaaagactggcatgaaggagactgtgtactttgtccgtagaagtcataaagggccaagagacagaaaaacgttagtgtttgctgccaaagaacattctccttatgacgcgtgcagctgttcagtgcattgtctctgcaagttcttgggccgttgttagccccaaggctgaaaatgtgggtttgaggaattcgtagagctagtgagacagctaacatggtatgtgggtgggctggagaattgacaaggattctagattgaataaatcctttgacatttaaagctacaaacctttattttaggaatcacaaagcaaagagagttaaagaaaacaaactaatggcttgttcctgtaactgacattgttagccttgtgattttagcacttggttgactattctcttgcttaattaagtgaaaccacaaacatatcctgaaaataccacttagtgatttgaatgggaaagataaagcatttgctataggaatggtgtgtgtcgggcagatgatccctttgactgcctacccagctgtcatctataagctcatatgacttatttcaccaattttggagtgcttttgtccctgctgcaagttccccaaaggatggtgtggtaaaggttgtgatgcctggttttgttttttgtttgtttgtttgtgttttgtatgtttggctctaaaactttagagacaaatgtcttctgttcatctgtaacttggcatttagggagaggtttgatgtggtcagaaggaaggcctttgtactgggctgattctgtcctggtgtgctgtgtttgaatactcagggtattcaaagcttctagttgcaaataagtgtagagaccaagttcactctgtttaggctggacctttccagcctgagagataagcttgtctttgcctctagccatgattcttttaagagatgttatcgtttctgtttgcctaaacttttctagttagtatgaagatcactggtgatccacgacttaatcatgatgtgcttctaaatgccttcttcaagatctgtttaattttcctgcatttacctttgattttgccattttcctgaagttggacccaaattccacatgcccatatccataaccctgctggccagaggcttggatttgtcttgtcttccagggttttgtagttagtgtgatagattgttgaaataaaaatacacaacttttcacaaaggtagatggtttccttttaccatataataggaatttagatttcagtgggtgagggtggctgatggagtgcgtcaaaacttgaaaatatgctttcataattacttctggtttgaaatacttggtgggatagaaaaacaagttagagccactcatgattatttgtgtttccaatttatagtttaaatgtatttgtaaaaagtaaaaaaaaaaaaaaaagttacctagtttgtacacatttagggagggatttgctctttcagtctccaatttttaagaaactgttcttgccctttgctttttcaatgcttagtttgtacaaacccctgaaatggagatggggtgggtttggatggagccttgaataagggagatgggactgcataaacaaagctagaagagtgaaggtactggactgtttgagggacaaggagtagttcagatcttaaggtgcttgaataagtgggctgataaaagtagttgtacaggatttctgttgatacctagtagtttacacttcatttgataggcagcagggagctgtgggagggtttagaaagtctacctgggaacattgttaaggtagattaggatgaggagagagggaccttttggaggctttaatttgctggtcctgaagaagatgagagcccaggtcaggatgttgaccatggcaatggagtggctggagcaacaggcgcagcctcaccaggggtcattgtattggccctttcagcagccctgctatgactttaacccgcagaagtctggtccctaaatcaggtggtttctaggctatggaacctttttccctcctcgcaacattatactgagtgaacttaataacaactctcagaatatagttaggatatatttatttacttattttggagacagagtctctcactgtcacccaggatggagtgaagtggtgtgatctctgctgactgcaacctccccctcctgggttcaagccattctcctgcctcagcgtcctgagtagctgggactacagaccacgcccagctaatattttgtatttttagtagaggtggggtttcaccatgttgcccaggctggtcttgaacttctgacctcaagtggtccacctacctcagcctcccaaagtgctgggattacagacgtgagccgccgagtctggcctatttaagatgcttttgattaactacctggtttagtggctgtctgcaagaggtttgaaaatagtgaagaagctgattaccttagtttgcagaattttttaattgtaagattagaaaatatagactgcttttctctcatgtgaccaggaaactattggatcagtttgacttctcaaattcttaactcttcccagatatgagatataaagcatttattttctaaattccactattgtgaaaacagtagatgttaaaattcataaaggattatttaaataaaaagtttagaagtctttatggctttttggaagtacctgtgtgtataaaagtagagacaatcttctatttcccaataaaacctacgctttcaccatagtaacagccattttaccttggagcccagtgaaagtttagaatattctagattcatctatgctaaagtgccttttcataaattattacttggataataacaggaggaaaagcagtctgaattggcacaagtgatgtctaaattaagaggagaatatatattgaaacattatttttttaagccttaaaattaatggctctgtttcactggaatatggccttttttttctttccgaagagtttcagagccagtggaatctataaatagtacacagcccagttgtctgtggtagattgagtagagcagaattgcctgtccttaagtgaaggggaagtagctttacatttttagtaactgaattgttggccagcataaaggtaagggccatgtgagcaacttatttataacttcccataaaggtatgtgtctgcctcaagcggagaagactgtctggggtgcttgaaatgtaaaagtgcagtagaatcattttccatacacagccttcctatctagttggtgcaataaagtgattgttcacctccctggggctttcagaaagaggggtgtcaatagattagctcattagtgtccacctcctatgaaatagaagggactgaggcagttaaattaaaatctgttttatgtagtgagcaatgtttagattgaactcctgaaggtattcaggacatacatttatgcctgctttaccctgctgggtgtggtcctgctcatgtagtcttaactacagttgggttcttatgaaaaatctttcatgggtgtaaagcactttttcacaggttcagttaaactataagtagttttttgaaaaataacatagggtcagaccaaaatctcttgttacagtgggagaacggaagaagagtaaaatattttcatggcttcctgtaaaaaagtatgttaatcctttttgatagatgccagaaagtggaatccatcgttactggcggcattgctaatatcaagagtaaatcacagccaggattgcctctcaggataaaatttttataattatcaataagtaaaagacatttttggacctcttctgttattcactgtctatttttagaaactaagttttctgattatattgaccatttgaagcatctgcatatatggcaaaaaaagtaaactttggcttttgtgccaatatcatggctctgtttggtatttgggcaagtttcaataagtggtaaatggcccattaactatattggaggcctcatagcagcactaatttcaaatcgtgctgggtttacaatttacatattaaaaaatgttcacttgatttcgttcagggacaaagctgacatcctatgcgagcattactccaaacaatcctatttatcggtccaattatttcaattgaaagatgctggtttactgcctcttagtatatgtgagcaattctcattgaaactgttagaaaccgtttgactgtagtggcaaaataacctcacagggtttcgattcacttttaattttaagtcccaggattaaggatcatttatagtataatgtaacagtgtgggcaaatatagcttctcttaatgtctttctgatattttggggaaagagtgcttttatgcaaaccaatcacttaggaattgcatgatgactttttcccactataaaatttcattcacatttcctcccttctcccacatccttaagagataagacagcctgcagtattttgctttattttactttattttttaaatttttgaggtgtggtttacattagttcttcagaatagatgccaagataactagttaatactgttttaaaatcaggctcttaattaaaaatgcttatatttgtgcaagaaaactacatgttgaaatgaatttggaaagattagattggaattgcctcaatttcaattaagccacactgcatggacgtgctgggaatatcaatacaatcactgtaaattttgtacaaactgatttgttgcattatcttgctcatctaacatacggtactttttgtgtccatattgcagacggcaactccaaactaacatggcagtcagactgtgtgatgtggcttctctgcttagaagtggttcgtgggcagcagagccttggaccggggtctgtgggatttttcttaaattctgtaggctactttttttttagcatgttggaggagtgctgaggccataccaaacacttgaatctttcatttggcatactaattattcttacatttaacctattgtggtatggccatcattaggacttaaagcacattgcaattttaactgtagtggtgtatgtagcatcagaaccatgctctcgtatgtaatttttttacaatctaaattaggatttagcgcagactcaaaagagtgacaagcttttttaaaaaaacaaaaaaagttttggtatggtctgaatactaagttaccgtaattctatacattctgtttactatgtatttttttggttactaaattttgaagttatttacaattctttatgctccaaaaaaaaagttgaaattgtaaatctggctgaaaattatttgcccagtaactgttgaaagagtttgcattctgtgaacagttgtgttgagcctatcaatggaatatgcattatttgtaaaatatagcacattagtatcattttattctgagcagatggtcctatagcagagagatgctgtaattttcagcgcacacagcctactgcagctgttcacttgaatgttggcttaggagctcattcttgccacctgaacatggaaataaatgtgcaattaagtgaggagtgtttgttgtcctttctaaatcttgctgatttcagtcaatgaacactttgtatttcaaatgctatcccaatgagctttagtccgaatctcccattcgggtctcttgtagtttctacacccatccaaacttttcagtagtgatttaagtgtctttggccactttaatcttgtagctcattgtttccataactgctgggcaagggttaaccccagaagaatttttgctgtgaaaagagtgacccacagctaatattctacaaaccagaacagttatgtttaattaggaaatctgaaacttcccttttcaaattcaaatagatttgctaattataataaaacccatatcttgaattatttaagatttttaaatacagatttccaaaggtttattttccttcatccctttaagtattccctgagaaaacttagcttacgtagagaaacagcttgcagcttgtagaataaattcccacttctttgacaaggaaatgaagtcacagaggggttacaggttgttggatatttcaaaagctattctggattttgcctcatgtttttttatcatgacagcactgattcttgttcagtctgaccagtctcaatatgtccaacactgccttcttttgtaaacatctcctggcagtagagatttcttcctatatgtttatctgctaatgtgcccttttatttttcttaggcaatatgtgttttaaaagacagttttttctctttccttgtaaccctctttccctttactttgctttttttctttgcctcaagttctttgccttttctatgttaaagcttccctaaaactagcatcccgtcaattcagaattgtcagttttgagaagcagttctttgtggaggtgagagatgtatgcaatatgaaggataatcctttcagtgatgcgttgatttttagattccaccacagtcttggctgtccaaagataggtagttagtggaaaatgattttggaaaatttggggctgtggtttgtgactcttttgcataggattggttttaggaaactagatttaatactgcttaataagtgatttgtagagtagcctgaacagtttgaggccattttccccaattctgttctttatctggtgtttggagtttatagataccctattacttgcattttcaacaggcttatgtgctcagacgagaattccttgggctggtctgtttgcaaaagttgatatatttacattgttgttttcattgactggataggttttcttttttctcattaaaaagcagagtcaaggagaaacaccatatcgaagtgtttggggattttattttgatgttgtagatcagtcaccttgttggtaatttttagctgccaaggttgacaggagtgtcctattagattctaccagttagacaaagtattcatagctcattcccaagttaccttacagttagttcctttccactccctaaaatatagcatctgtttttttcttaccaatggtagagataagatattgtccatcaaaaacgttttcaatatgtaaccaaaacagtacatgttgacaaatttatatttttaaaagtactcttgctctttgatttttaagttaatggctatctgtcagttttagaatattgaacctcttaggataactgaaaatctcttcagagttaggtaggtcatttttttgttcatttttgtagcatgttaagcacttttattttctagtatgatttttagttagggttcaattctgtgccctttggtacttgattttctcatctgtggacactgcaggtgagtaaggatatgtgaatagacccagaatgtgattctagaaaatgtttaagatttaaattgtgcttatatgcatgtatggaatatgtatgtgaaaatatagttgtaaccttaagatgaataggttaatatgaagtgaaaattagtgtaggtattacactttttgttgaagcattgttgtaatttcattagaacgacttgtgtttagtgacaagtgtttaaattcttggatggagtctctaataggttgtgaaatatgaattctgacatttcttgttttctctgtttttagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacaggtaagcagttttatgtagatgatttatatttaacggatcgtgtctcaagataggagaaaataataagattactgcttgtaaataattcactgctgcaattttacatatctagattttctctctgttattacatcagcaatatgaaacttagtttaaaattttctttttaaatcataaactattttgggggcagtatatattttaactggactttaatgtactctgatctggacaggatctttggaaaatcttctaaaagtatatgtatctgggatagccagtgtcatgttaacttttatcttttagtaccctgagtgtatttaagttagcatttcaacagtgagatacaatatgtgtttgggagaggggaaaaaatcttaaaatgtgttttccttatgttaatataatcattttgcttatatatgataaaataaatggtaatgttcacattgtcagtgtataaacattttcactgatataataccaagcgtgatgagatcttatgttccgttccttaacaaggaaaggacatggtatatgattgtccttcttgttataaagataaagccttaattatagtacattttgaatattaggtgaaaatctccttagtattttttaagatttgactaaatttttagagtaaaccaaaacctaatttaaagagcacgttcttgggatagaagggttaatgcttcctgcaggagttgttttcaaacactaaaaatacatgaagttagacatacatatgaagttaaacactaaaaatatacgaaggtagacagactctgtggacttttcatgttaattaaatttgattgatagtgtataccaaattgctttacaaagcttataaccaaaaatataaaatggaatatttgaaatgagtaaaagatacttaaaggcagtgtgaagaatgagaccaggagtctgaactctcacctagtcatgtgacattggataagtcagccctagacttctggtttccattggcaaaataaggtaaaaggcagagaaaaagggggtaacactgggccatttctaagttcacttttgactttttcatacatgggactttgagctattccgttaatcgttagggctcattctctccaagatctgcaagtgagttctagagccagcccctggacttggctcataatcatatttcctcaagctacagattgagattcacagagacaacttactgaaatcaagttaaaaagctaagtacaaactgattgtcattgatccatagcaaacggccattatattttaattatgttgcttaaatgttcactatgatattaggaaggtggttcttatgtttctgaacactgataatcagatggatgagatttttcaatttcttttccaaaatgagtgtgataagcatatgtgaaatttatagtgtttttaataagttgaaaaaggtgaagaacaaaaggctgctcttacgtctctgtcgtgatgtttttaaacatctttttaacatgttttaaacatgttatcttttgtttttaaagtaaaacaacacccctgacatgtggattttgcaacctttttaatataaaagataaaaatatgataaatgacttgagggctatgacacaaatgatgcaatttctgattgcttagtagagctccccttactattaaaaagaaagatgcatgaacagagcacaaaagtcatgttttgttatgaaactgttacgaaatgatacattttatcattttataagatgaaaatattagacaaatcatacatctttcatattaggcatctgccacaggagacatcttacagatcctcacgtctcacctctagtcaatcttgaattaatcttactcttttgtgaatctttagagctgttatgtggcaaaatgggataaatttgagttctttatcttcacctcctttgcctctctaactttagtgtggtagacggtggtaatagaagcacaacacatgggtattctttaatacatacctagatactaaaaaactgtgtaaatatttctcatccatttccttcacctctgacccctgcctgttgtcttttcagtggcttgaggggaaggatgtaatggagatttccactgtggtaaaatttctattaaaaatatttggtaagcaagtagagtccccaagaaattccacaatggtcatgagtattgaaagatgtttctaaagatgtaagacgtttctatacattatatatatatatatatatatatatatatatatataatactatatatgatgtatacacatatatattacgtgtacactactatatatagtatatatttgtatatagttaacacataattgaacaaatttgtggagtacagtgagatgttttgatgctatatacattgtgtaatgatcaagcagggtattatagcatttccaaatctcaaacattcataatttctttgagagtgttcaaaatcctctcttctagctatttggaagtatactatacaatattgctaaccatagtcacccttctgtggaatagcacaccagaacttatttcttttaacagtgaccctgtactcattaaccatctggccccctccttccttcctcctctcttctccaccctctggtacccactattctgctctcgcctccaatgagatcagcatttttcgattctacctatgagatcgtgtggtatttggctgtctcacctcacttaacatagtgtcctctaagttgacccatgtttctggaaatgacagaatttcattcttttttgtggctgaatggtatttcattttgtatatatagcatattttctttatccatttattggttgatggacatttgggttgagtccatattttggctgttgtaaacattgctgcaataaatatggatatgcgtgcatcccttttgacaaattgatttcatttcttttgggttaacatgcagtagtggggatgctggatcatacggtagttctgtttttaattttttgaggaactttcataccatttttcatagtgtatttggtgtattaatttgccttcccacgatagtgtgtataagattgaaagatgtttttcaaccttcatttggtgagatactagtaattatttcttaacataagtattatattgacagacaagtttaggaagtgctgcactctgtagttctttatttaagatccatactcgataatcactgtattaagaactatgaaaaatccagcagtaaagaaaacctgtttgaattatagttccccggccttatttgatcatagagcctatttggggactgtgggaagagtgagtatctctccctgacagtagattacactgaacatggtgctataaaagcttttgaaatcatttgttgttaactggttatcagaccagtttaacctgttcacatcaataacatatgagcatgattcctaaaagaaacatatatgataataaattcaaaagtggagtaggtaaatctgaacactaggcatctcaacttctggtaatcttggtttgatttggaccactgacatatttgtaatatgggttaaaatggcttttagaaggatctcactcatttaacttaagcataaactgctttaggatatttttttttctgagtttcttactgaatacttctattgagtaaaatagtctagaaaatggtagtatctaaatctgggttctgagtggttgtactttgaaaagtaggcatacttcgtaagaggtagtactaatgtatctctagcaaggttttgaaagaatttgtggagctttggaccctgtcctgtggtgtgtagcattacccgtcttgtgcagtttctcagtacgtattttagggacagaccagagttctttggtccttctctaattatccagcttattctacctcctgggaagcagttgggacccatttctgtattccgattttgtaggagcatgtgcgttaattgggttacaggaaaactctggagtcactctacaggaagatttgaaatctttccttttcccttttcttaaatctttcttaatgctgaatcaggaaactatatctaaggaacaaaaatatctagttaggaaagtgtgtgcttcttaagtccttgaagagagtgtataacttttagactgtgtcagtgttagcaaattaatgtcactattttgatcgagtgaggattagggaagtacattaagaaatgtcttcagtagcaaatacaataatcttctctctagactaagttctatttattatgttatttgtcaggtccgtctctttgggcttctgcccagctgtatgcttcagcctgtttcctatctataggcattcatcatgagaagcttctgctgcttgtacagcttagctgactttagtccatccctttgcgtttttaaatgcacttgggagtccttgacacctgctgatgctgcattctagatgaacgaaatggattttatgatgcaaggaatgagtaataaagtgttacagtcagaaaagccctagaggtgaccttaaccaaccctctcccttctttgccccaaacatcataggtgatgagaggcccaggtttgtgaaatgactagttcaaggccacagagctattaagcggtagagtagggaccagaattctgattatcttatgctttacctggatgtttcctctttgccacttgttggaggcaagagctcactctttaaagatgaagcaaatggccaactgatgaatttatagagagatgtgtgatttttacagagttatccagagggcatcttctggcgagtgtgtcttctctggaaggagaatggaaggtttttgacagtaaggactgacgaatacaccaaatgaacaagaacatctgtgcttctctagaaacattataatctatggttgtgaacttgatattctagcccggtggtacccaaatttggctctacatcctcacctactcacctaagggagttttggaatctgttgtcagagagcttcccaggtgatcttgaagcccaaaaaagttttgggaatcagactgtgtctcatgaagtatggtcacaggattcccgcattggaatcacttgtaatgagtgctagaaatgcacggtcctgggctctgtccaggcctactgaatcagaatctgtagtggggacctggaaggtactcgttagctaggagttatcaatgtcttaaacattttgtagggagattgaaccagggatttccaggtttacctgaattctagatttagggcgttatggaagaggtgttaacaattgcagtacttaattctttggaaagtttaagtttaaagtgctgtcccctcttcagcattggtctctgagttaattcctagctttcagaactagacatgttgagtttacgtcactaggctgtgtccttactgatctgatatgttgctgaaagcacgtgtgcgagcatgtgtgtgtgtgtgtgtttaagtgtaattaggtttttgaaactccagggtagattgttctttcactgttatttttcctttcttctaaaagaatggctagaggagtagttggtggaagacctcaggtaatgagtatttcaccattactctcagttgtttgaggtaggtcttgtactgacctcatcagctgctaactagaaactttgacaaaaggggaaaaaacaaaaacccaaatataaattccagagggcccaaagagatgttgattacctctgagtaggtagtgccttgcatgataaggctcctgccatgccccagcacgccttagggctagtatcttaaaatattttttattaatatgagtgttcttagctaggtttatcttgtgtctctgcttgctgagaattttacagctagttttgatccttctttattctatcaaaataatgtgatttccaaactattttaatggcataggattctcttctttttaaacaaatacaatcttagctcctcaggattgaaacagataagtggtattttattagactaatgggaaccttcaaatttaatagcacttatttcctatgagtcaatcacagtgaacacaaagctgttttgatgaacattaatttgaaaatgtgattttgtatgtcagttacagttgtacagtgagcatgtgaaatgtccatagtatcaagagatcaagaattctgattcttgcagaccagtagttggaaacagcagggtggttgggtgggtggtaacttaataaacacctcactttgcaaactctgtatgctatttaattagaaagatggcagaaaggttgtgtgtgttcttaggtctgtaggaaaggagatgcctgcacaggggtaaatgctttggtccgcagtgcgttaactgtggaatacagtacatttgaatctatttttagattttagtgcccaagtttgtataaaatgaaatttgtgtcaagtttgtggaacctctatttttggaacatctctcataggcaaaaggtaatggagaaactttatttatatcttcattgatgtatctttaaacttaattattttttcattatatcttgtttctttgccaaaggtcttgcagtcatttaaaaaatttggtgttatcactgtagaagcttcatataaaattttggagaaagtctttaacatttattcttctaggttcactttttacttgaacctgggtatttttatagaacaattttcagtgtcagccttgattagtttagtggaaagattacaggatgatgaaactagaaatttgtaacattttaagaaatcaaatacagtacagttctttatcattgttaggaaaaacaacttctgtcctcttttgtttagtacctggggacttggaaattaattggagaaatggcacacaatttttgctcgtattttgtgtttgggagttgacagaaaagtattataaaactaaagtggtcagggttggggggcttatataccattttaacaaaggaaaggtttggactttgcggaataggaaatcatggggaagcgttcagaaaatatgtaggggtaagtaatgacaagataagggcacttttaacaaggttggtttatacagaactgtatgcataaacaatctgatgttgactgtctcaagtaatgagtcgcttacttctgaactggtacaggacagagagacatcttcccatgggaaatttatactctgcttttagggagaaaaggggagggcagagaactcatcttgcatctgttgacttcttattttcctcagcctaaaataatacttgatgccagccaggcgcagtgattcatgcctgtattctcagcactttggaaggccaatgcaggcgaatcaccggaggtcaggaattcaagaccaaccatggccaacatggtgaaaccctgattgtactgaaaatagaaaaattagccaggtgtggtggtgctgcacgcctgtagtcccaggtactcacaaggctgaggtgggagaattgcttgaacccaggaggcagaggttgcagtgaactgagatcgtgccaccgcacttgcatttcagcctgtgtgacagagcaagactccatttcacaaaaaaataataaaaaaaaaaaacttaatgccaaagtggaatattttggggtggcaaatctggaccttttcaccattcagtaagttaattcccagttaacatctcttcataaatcaaagagctgcttctttagataacctgtggtaatgaagcctttaatggctagttgctaggatgaagaaacatctatttgaggatacagaaaagtatgaaacaatattcttctctagtaattcattaatcatccagatttgtttctctgatttcctgatattgatatttgtgttacttggtattttgttccgttagaataaaatgtaaaaaaaaatatgtgtcactcccacgagacagttatacagttttccaacagctgtcttagagtgtttactgggaaaataaagttgaacctatggtgtaaatgaggtttaggagttttgattttgtgctttcctagcccttatcagaggaacttttagaatagccgtatttgccttaccagtagattaggaatagtcttcagtaacctttctctttgttgctttgctggtttgatagaaaacacaaactttgtaaacatattcaaattcatagaaaataaaattacagttgaaattctcttgtaacatttgcccctttataattcagcataagagtgcacgtgtgctgtttgctattccagaccttttctggggggtagtctttgtttactttgcatcaggagattggtggtatagaagagacaccattctcaatttaagcgcttgtcgtaggaatgatggaaaatgtcgatgaggaagatggtgaactaaaatggaaatagttcagttagaagataaaaaacagttaaattgtgatatgaacttgttgcttcttttttttgtagtttatagaattttaaaattctgtttctttggtatgaaaatgatttataccccccatttttatgatgtagtacaaaatcaacctgtttttgacagttttcattctatttcactaccttaactatgacacagctttggccaccagccttttattttttttttaactttgtttaaattcagaatagaccgaagcacttttattctgtacctgttggaacatttcctttcaaatattcctgaacagaatagttgattattggagctaaaactgtgcttcaaaatttgccaacttcttttgagcttgttctaagttaattgactttcagctgagtacactgctgctactgaacgttgagagctgtggaaaccctcagagtgtgcttttccagctcaaaaggtcaactttaacagatattttctggcattttatttgagtgtcattcgatttgtcaggtctatacagtggcttaattagcatgttttagtccttaaggtatttgttttggctctttaaagttttagattgtcaatatttcaaaacccttggatgccccttttattggtgttgggaaatgtaatcaaatattttttgaggggctgtaaatcacagagtagcatttgctgctctaagtgttgtgaagaaacagattcgcagttaaaaccatcttttcagactccactcagtaatttctgacaccatatatcatctttatgtaatcgaggggtgatcattctgtattgttctaaattagaacaaagatttaccttatgcctcctttaagggggaaaaaagcaagacagaagtatttaagctgtgtttataagagttccttggctgggtatggtggctcatgcctgtaattccagcactttgggaggccaaggtgggcagatcatctgacatcaggagatcaaggccagcctggccaacatggtgaaaccccgtctctactaaaaatacaaaaattagctagacttggtgctgggtgcctgtaatcccagctcttcaggaggctgagacaggagaatcgcttcaacccgggaggcggaggttgcagtgagccactgcactccagcctggatgacagagggagactctatctcaaaaaaaaaaaacaaaaaaaagtttcttaagtggtagtaggatttactaaacccctgtgtacactaggtttgttacttagtttgggatcaagttcttgggattaagtttgaatcaaaatacctttgcttcctcctgctagggaggtggcctactggacactaatcttagagcttttagcttagaacattgttacacttgggttccaattccagcctagccactcaatttgtgttgtgtcctgtgtgtgctttttgactctgaacgtcagtttctttcataaagtacctagcacacaggggtactgtctctctttcctgtcctcttcttaccagttaatacccattcagttacgtgacagttgcagacttttgtttttccccccataggtaaaaagtagtttttgaaaaacatcttgaagtagatctgttgtcctagatttcttggagtttgtcatgatgtgggaagaatgcaaagctcatcctccatcctttgctttctaggtgatttgaccaacataattgattttccaggggtggaacaaagtaagaatagaaagtgcgaggcaggacttgggagcccagaatgatgattaatgatattacaccagcctttatgaactagagcaccggagtgtggaattattgctctatgtggtattgtgtgaatgtttcagaatgaattagcttgacttaaaatatgaaggtgctctcaagtgagctttccagtgagctattactgggctttcgaaggtcagcaagttgttaaattgagccatgaagtgttggttagataaaaaccaactgcggcttatttttacttttattgacatcatcttccttaagatgagtatccgtttaatataaaacgtaaatactatactaaatagtctcattttatcaaagatgatgttcaagtctagatatacagagacctgtgttttgggatgttcaaaaacctaatattcctgcagtgttagcagatcagaaggctgaggaaaaaaattactatccctttgttttcttttccattgaaatattcattgaaaacatctaaagcatttcttcattcagtcatcacagactttacagatttcagtttgtgtgtatgggggagggggcagtttccatgagggtatggttaacttagcagatgcaattttacatcttgttttccttttttgttaaatccttatgcatattgtgaattagagtttatttttagctcttaatgagttcttttctcatcattgtactttttgttggaactctgttttgtacatactgctttgattttgtagggaaaatgtgtatggcgtacaagtcctgtatccaccacccccaactcccatcctctagctcaacaaaaatttgcatttcttggtgagggatgatagacttgaatgtttattaccttgtagagtagatctgatggggcccttgactctttacaacctgtttgacctttggacttaatactgagaaagtcaaatcctccttttaaagtaaagtttaagggaggcatagctgtgtgtaaactggtaaatcagaatcactgcactgtttttaaggtcactggagcctgagagaacagttttatttcctcacattttaatgctttaaatccagtcttaaggagttgcctccaagggtactgtcgtacgaatcctttttcctaaccctggtactaagtaagccatgggagcttttttcattccatttaaatgaattgtagtttgctcttattctactttaaatgtatctaaacattttgaatataaatgagagactgatggtgtatcaaatcaattgacatcttctcatgtagacaagggctctcctaaatgacttcccaaatcctgcctctaaaattgtcttttttttcttttgtgaacctgagtattaggttagctctttttaaacatggtgccaagtgattttgccattatatggtgcagacagtgtactaccttctcaagtagaatgatttgggatctaatatcttaaaatctaacaatgttataccaggtttgtttttagacctttatattctttattatttgttgtcctttttttatgggggtaagcccttttatacatattggaataggattaaaatacagaattgttaataccgatttgttactgtgttttatatcaatatgtgtatttttttaagtgctggaaattgggagcctttgcaaaaaggcgtgataacattccattatatccccagctctagaacatacaaagctagtcctgatgtgctacttaaaagtagaatatggaatcttctggggttagtttcttactctatttgatattttagttctctgaatgcttatagaaaacaatatatttggatatagccatcaaagtaaggaggatgtctaatattctttcctagcctttatagttggacaaccgacttttaaagagtcttttttttttttttccttttttaagacagtacccttggaggccactgtgttcatgaccagtgactccttgagactgggtttattaaatggacctgttagtatagtgaataacagctcttaggtaattttgcgtagttgttagtaggcaccaaaggaggaagggtgagcgttagttgctctatagattataatgaaagaaggtctcaggccagatcccaccacacatagaaacctctatctagcaagcaggaccaaattgatggagaagccttttctgaaagcttggtaaagtcccacttctctcttcttttttaagtgctttgaacacactttaaatgaaatgttcaccggaggctaacaatatcccaaaagtcacgttctgcaccctcactttgcatcatgcaaaaagaaatccctttaaacaaagactgaaacccaggaccatttaacatttaggggttctctccataaagatataaccaccttggattatgccaccttggattttgtgccctgtttatacgaaggtgggaagtgtctctaaactaatttagcccatctgcgtatcttgaactcctttaattttaccggtaagactccatttctaacactcgttatgctaattaacaaataactggcttacagaacaaaaccctattttgacatccattaggtgaatcagcagagaattggttgttgatttaggtatggatagtatgtaggcttacactagtcacttgaattttagcctacttgtattatactagttaactaatcctggattgtgcattaatgatagtatgttagatgaccacccagaattaaagcttaaatggctggtgcacacgtgtcatcagattaattctaaactttaaaaagaaatgtttttattgtggcaaaatataacataaaatttatcatttgaaccttttcaagtttacagttcagtgacattaagcacattcacagtattatgcagccgtcacccttatccatttccagtaccttgtcatcatcccagatagaaactctgtaaccatcaaacagtaactcctcacccacctcctttgctcccagcctttggtaaccattatattttctgtgtctctatgaatttgcctattctcggtaccccatataaatgaaatcatacaacatttgatataccaaagtattttgaaagtaaattatgataattgttttcaggagatactagtttttttccccttgggctgtagactcttctgtatgttttatttctcttcctctccaagtggctttagggaccaacccctccccctgaaataagtagcctggcttcaaatttagttcatgccacattccccgtaaaagaaacgtccaattaaaatactgaatttgtgcaatattttgccagattgctgactacttgcagggacttcatcttaccccctttgcagttgttctgcctggtttcaagcttgttttattcttttgaaaattgccttcaatctcttatcactccccatcttggcaagttacctggaggaagaggcagttggtgtatgtacagtgggtcagaaagaagaacccaagtagttttgctccctggaagtcttctctgccttcatacttttctactcttttctcccagagagtcagagcatccagggacaaacatccgtgtggggtcttgggacacaggacacagtgtgtaacatccccagactacttctcgttacctcacttcattctctgctgagcacttgaaggaaatcttggcagaaagccattcctcaatcagagtcaaagagcgacgagttagaaattctcttctgtagttttagttcttccatttttttctcccccttccctagtactctttccccctacccctcaaggaagccccccatcaatataacagtcaaccacccaaccagaaacccacaggacagagccatttcttttttttagaccactggaacaattattgtagttagagaaaacttaaatatctttctgaagcaaccttgggagacagatgctgatgtatgttgaagctagagaggcaggtggtttgtggcctatttctgcctttgcattatttcagattctgttactgagtagaacagtcctttttttaaaaaaaaaaatttaggtcttatatcttggcctcctgccttctctgttggcatcagccaaatgcatgttggctgcaagtacatcattccacacttagtgactggatttattttcagacgttggctattgacaactgaaaagcaatttcctgtgttggggcttaacagaaagcctcccctgggttgtaagagtttaaaataatgaaaaaggtgaatacttcatgggtaagtcttaatgcaagctttgtgtagacttatccccactgcctactttgcactcatgtttgtagggagtttccaaaagcctctgattgagatgaggaaggtcttctacctctggagctgtaaggtcttgtcttgattaaagatgactcaagcttaaccagttgttcagtagtctttgtctgagctttgggtgtgctggagaatatcagccagtgttaagttcttgatttcaagtggtgactatctgttgaagagagcctgtgccatgaaataccgtagtcctcccattatcaacagtttcgctttctgcagtttagttaactggtggtcaaccatggtgttaaaatattaaatggaaaatcccagaaataaacaatccataagttttgagttgctcaccattcagagtatcgtgattaaattttgcaccttcctgcccaggatgtgaatcatccctttgtccacattatccatggctggtacatgttccctgtcctttaatcacttagaatccatcttaacagatcggaaaaaaaaaagtagtgtatattatgttggattcagtactatctgtggtttcagttatccactgagggtcttgtaacccccaaggataaggtagggggtggaggactactgtactcggctagtggaacttcttgtggtatacctcatggttcaagggaggtagagaaggagggaattgtcatactgtgaaggtggaatgcaggatgttctaaattggtgcttgttttgttgagcgaagatgtaaagtatagtctggtccactaatgatttgttgattatttcatttgatgattaatattggatgcagtcatttatttgaacagaaatgagagaggcttttttttttttttttctttttcagtttacatggaaagacttctaaggatgttcgtggatccaagacaaacttgtctcagtcttacatttcattagggtccttctgtattggggaattctctttcttagtatattgctgatgggaaaaagctaattccagaagccagttgggtgggtcctctctctttctgcctgcctataggcaagcagccagtaaggaaccgaagtaaagtcaattaggcattttatctcaggacctagggtctcaaggaagtgatagaaggataagatggtgatgatgactcacctctctgttctgaggtgggggtagttttacttcctactacttaactccttgaagtctggttcccagcccttactcattctgaaaacgctctgtgactcttccagtgtgtttctttgtgccagttaggtagagtcagtgtacaatctagaactccattgaaacaatatttatgtaattcatattttttatctttttctatcagtgttttttaactcaaaagtaagcttattaattttgtattggtctcaatttgacctataagagaataacttttgtaattggttagaagcccctgttgtgaacttgccatagctattggtaaaggagtttgttttgagaggtgtgtatgtatgtatgcatattttgtaaataaagtcacttgtcagtgcctttcaaacaatttactcatatttgtgtcactttgttagtgttggaggaaagcaaagtttgaatttaattttgaaaatagtaggtgcagtgaagataccgatcctcccttccaagtcatctcttgtgacttcctcccccttttgattatgtttcttgggcactactttgctcactgagtgtgagcaagaacaacctgaagaatgactgagatgactactagcagtagcattcacacagcaggtctttttgaatgtttcatctctagcttttagtcttcagaggtcagtaatgtttggtgactcccattgcttttagtagctaaggagagccatatatcttgtggtaaaacagatttgcctctgaatgacctacatttatctcctctgcttatttagtggtcatttctttaaaacccttcagttaacgcttttggtttccagccatgtagggacatgtgtatgcttacaggcattatatttctgtgtcctatgggataagtagtatatgtcatcattaggtttttggacagtctttggttctccttgaaaagatgcaagtctagttttacctttattacagtatgttttttttcccagcaagtaagtcattgatggtgaattgtaaatgtaattgttcaaaaaagaatctagtcaattttgtgttcttctttgcaacctattaagatgtttgtgtacacctaaaggatttgaatgggatatctgttcaggtagcttaaagtgaaaagatggtggtgggtagggcaggggaatgacctggccaagataataccaggttatagaggattacacagaaaatctttgtataatatcttaatttggctgtagattatacattcagaaaacattcttctttggggattgtaaaaatctaccatagttcctggttatttgatttgtattttatttgtttcttgagacagagtcttgctctgtcactgcccaggatggagtgtggtggtgtgatcacagctcactgaagcctcaagctcccaagctcaagtgatcttcccaccttggcctcccgagtagctgggaccgcagacatgtgccattatgcccagctaatttatatattttgtagagacaggttctccctattgttgcctaggctagtcttgagctcctgagcttaagtgatcctctagcctcagactcccgaagtgctggtatttgggagccactgtgcccagcctgtttttttggtttgtttatttttaaaagaatttttttgcttcattttctttaagtcatagattacaatgacagagagtgcaaatgaaggaacaaattagctttgtagggaataatgaggtaaaagttctaattcctttactattagatttaattattatttttatttttattttttttcgtggggggtgcgcgagaaggataaagaagcccaaaatagtatagtaggcttttgtgttaagatccatttcagtatatatatgttttcttgctagaaagtactcttgcttgagaaaaataaagtttataatctaagtagaatccttaataatgttgttgtcaattaggataactagaataagcacttaataggttatattctgtttgggtacaggggctagtaagtgatctggcagcatacatatttaaagtttttccctgaataaaggagattagtttataatatataactattttattccttcattagaaatagcaaggaagaagttttcagcaacaaaataggaaaactcttgacagcataggctattgaatattggaatgagctgaaaaactagttatttagtaaaacattcatttcttcgagtggtgtacttgtaattgaatacctaacattttgtatggcattctacattgtaggaacctcttttaacaagagtgattctaacacgcacatcagaatctatttgtgaaacttaaggtggagacggtagaataataggtgggggcgagcatcagagagtacctttagtgcagtttcttttcccacagatgagatcccaatctcaaattcataaggctagttagctggaggccttaaactcctaacctccttttccttagggacccctttgtggtaataagatggattcttctgatccacttgtcttagccttaatcttaaaatgtgtttgccaagtgggcatgtaatgtggcccaaatagctgagaagctctgtgtatagaagttacttcccacatcagatggtccttcatattgtttaatctggtgccataaaaacatagcgccttccccaagagtgggtctcagatatgtgaataagcaaatcgagtaacttcagtaacagcagattaaagaaagcatcacattaaaagtttttaagatgaattaaaattgaagtgttgttgaataagatttttttaaccctctaccctgttatacatttaagagtacttgagatgataaaatggtaatatgttaaaattatttttgtgtttaggtttttcctgtttcataggaaagatgtatccagaattagcagcaatggtcagatgtactaagttgctgggtatatgatttagatagttcgtttttaatatactttaaagtcagtggtaaaagacaagacaagcctctgtgctctgctcattcggcaggataatgcgtttactataccatgctgatgtggatggtgccacattacttttgtgtcctaatgaatcattgtctaggtaaaatctttttagcaaaatcttcctcaaagtatccgtgaattttaaatttggaggattacaatagctaatcacttcaacttttggatgaggtgatttgggaagaaatgcttatgtgtgatatgaatgtggcaatcgtaggagctgcaccattttgtacttctctttaggagccatctgttaattggtgggcaagttgccctgtggtctcagagtggtttgctgtagcataagctgtccctgagcaaaaacaaaattgatacttatttctgtcagggtacctctttgacttaattcgtagccatggttcccatctgacccatagcctttacaactttaaccatgtacagctcaatttcctctggggactgtgttccattaggattccttttctttattgcttcagagagagtgttcttgaggtttgtgaagctgtgtctgtagtatttaaataggtttcctttatactcagcatttatacccccaccagcccaaacaccatcagtctgttttggaatttttcctaagcatgtaaaaatcagtgctgtgtgtgactattttaagtttagaggaaagaaagaaaaatgttcctcctaccctcttgattaactacctcttcattaactataaactaagcaacatgtcctgtacaaagagaagaaaaatcacgttatttatacttaatccttgtgtcgactggggacgatggatgtcctttggaaatttacttcctttgtctttgctaaaaatacctctaatttaattctgctctttctttttgatataaaaggaattacagtggacattttccccccggtggaagggttgtacatatcggtctatagcagatactttatgatcagtacacataaggtgaaatatgtttttattgaaacacctgatcatgtgatgctacccaatattcccttcttaatgactcagcttccctccctctttcactccttttctaacttgatgtcaccatattgtatgcgaaggacgtaggtatgtacgtgcattcacaaggcatgtgtaattttgcagttgctactcagttaaaaataaggtttgttaacacttgcagtagtttttccccatttactgtggtagttattaacactttgtccactcataatagcagcttagcttggtcggggggcagaaagaggattgaggtacttgtttttacagctgtgtaaaggaggtctcagaaaatcgtaagccctgcctgatgtagtcatcttgggtttagctttttggtggttggggttatccatatctgttagttttatagtgcaagaatactttcaaggctgctgagttggtgtgttgtattaatctctgggtattatggttcaaaaggtttcttgcccttctagttacttttacaaaggccagatgttatcatgccaaggaagtatggatcctcctgggacacaaggagttgctaggtttcaatcctggccattactctagaaggcctgtaaccgaacccaggttcagctgcttgccacttgaaagccagaacacaagaggcaaggattggtggaaggaaaagcatttttaatgggagccagcaaactgagaagatggcaaactagtattctaaagtaccatcttcaatttaaaaatttaccgtagggctttcaaagggagaaaggtatgggagacgtgcagaagtggtgcaggatctgtgtgtcttgttcagtggctctctcaggtgtctgaaggtctaattggcattatcttgactttggctcagtggtggtggactaattatgactcctcctaatcatgaggattttgcagtggggactctgttcctggtttgtttcaagattagcctgtgggatttcttaagagcctaagtagataagcatggattgcctaagggggagtgtctagagagggaaggaataaagagttgagaggggagggaagaaggaaaaagaatgtgggtgatttctaacactgaggtccctagttacagtcttacatctgcatctgctcagtgattataccaggccactaaggtgactgtccctgggtccctcgtgtgcctccttcctcattgtgcctcagtgcttggtgcatcctgcagtttgtctgctgtaaaccttcacatgggccagtcttgcttccaggatggggggtcggtttgcttacctctacatagatgccttacgttcagcgtagtatgcttttggcttgtctcttttatacttctttacaaatttgttcttctccatgttcctattaccttaatttgtttgtcaggaaacacctgaatttcatcttctctgttttgacacactaaagagttctctttttcaagctggtcctggttaagcctgaaacccctgcgatgcactttatgtatttcatgttcattaggtgcctgcctctctcccttgtttactgtgttgggcttaaaatttttgagcatcttagagggcagagaccatgtggtattgatcccatcttttttccaccgctatgaaatcatgctatgcgtatgaaagcattttaatgcaatctgctgaggagagaaatgtcttgtgtgggagaccgttttggcagtagcaaacatgtttggctttagccataagaactgctttctgagtttggaaaaggagtatgtaaatcaaggcccattttaaatggatctttttataatgcagatacctctcatctatctgttttgtaatgatggatttgttttgggggcttaagtggtttgtgcacctgcaggatgtccttccttttctttcaggtcattttttttttctttcacagatagtctcttggatggattaagaaagaattgaagttccagtcaatttatttcatgacaaagaacaagaaaaaaatacagatgtatttggagattataaatattctgattggaaagttgtaaactttggatgtacaggattctgccacaaagtaatttccacacatggccaaaggcaacaaagtgtacacttttgaaagactgagtttggaaaggttgattgtagtgtggaaacccagctgctcctttgagctagctgtgtgtgcccttgagcaagttaacttagcatctttgaacctccaactttatgtccgtaaaatggatacagatgtatttacatgtagccttgtggtgagaattaaatgtgatatatgtaatgtaaggatcctagttgcttgatagtttagtttggcagtggtactgttgactgccagacaggtagacatagcatttatggggcagtgggaatgggcatttttccccgacaaacttactgactttttcatactggaaggtttgggctggtgaacctttaacttttgggtgagagagtgatttttttaagaaaaatgtgttcaagaagaaaatttatctctaacgagaatttttgtttcacatggacttggtgagtttgttagagtctaattttatagtttcccgttcttgacaaaatggggagctctccatggtggtttgcagggactctgacatagtttcaaaacagggcctttaaattttttgtttcttgtggtatctgagttaaaaaatgatcttgtacagagagaaaaacacattaagaagctgtactgcctcttgatggactgcttagtggggggggtgtgtgcgtgtgtgtgtgcaggcacaggcaagagtgcatgtttgtgaagattgacaccagctggtcgcacaagcaacagcagatgccctttttactaccacagttaacttgttttcctctaccacaatactattttgaggaatacagttcctttgccttcatcccaaatggtatatacttgaacaactccattgtcttttaagtaaacacaagataaagcagataatataagactgttagtgtgtgtgggggtgggggtaggggcggtggcggatctgtgtagaattaattataattaacaaagaaatgagaaagttgcagcatacccaaacttttaattgaaagtagattggactagcctagagttgttaatgtcctaaccttttttgaactgtcaggtatgactttcaggctatctgaaggtattttggcatttgctctatcctggtggcagctccagtgtttgaaggtagaactgctgacctatcttttagagaaactacctatatcaataagtgatgagaaccgccttttgttttcattgtggtgctgagcgtgctacactatctcagtcactttctttcaggctggagaacctgctttcaggtagagtctcatcctgtgggttgtagaggaattggtttattttcctactgcacataatttttcctcatcttcctggtcttggatgcaagatatctttgtgtacccggtgtaatacttggcaagaatttagaggatttaatatgctgtttctgttctcaatagtctaagactgaattgtgtgggagttcttaatgttgtctgaaaatgtgatatattaagaacccacagtatcgccaacttaagcagggtcatgccgcattgccagcagattcataattactgggactggaactacaggaaaatagagctctaccagttgcataatcaggggacagatatggctattaaaattaacttgaagggaaaatgccctggtgctgaggacattaaccgctctctctagaattaggctgcttaggtaatatttaccaaatgatcactatttgcagctttgatttcagcagaaaagttatgatttaaactcttctatattagctccatgtatctgtaaagtcctgaaaatcatttagaaactttggggcctttcagtctcaggccagctttattagcatttgggtggaagatgagtcttcgagtgagccatctgttttctgtattatgtgagtgtctaggttgaattctccatccttgtgataatccctggtaatgtcctttgggaagctggtagaaatgctcccagctttcaggaaggctggcttggactgtagtaataggatctcaccagtcctccatctcacaatttgatcttactcattagagggcagcaaggaagacctgtttaacttgacccaccttaacttgagtgtttaaatggaaggacctgctgcatctggcatgctacatttgaggagactcaggctaagtcaggaattaaaatgtggagaaaaacgtgactagagagaactgcatccctctgttctgagattctctcaaaccttttccctgctgtgtggtacccacatggttttgctgtgtatcagatctgagatattaagaaagctcctttgtgaagtctggtgcgagttgctttggtgccagagttgcagtgcacagcctgtctgaacagacacacataatgagtgcccaagaacagtaagtccatctgaagaaatacaatatatttgcaactttattgtgtgtttgagggaggagagagaaggatatcaggaggcaacagggtctttattaaaaacaaaaattttccccctttgtaacgaaaacttgtttttgcaaatcaaattatttgcttttttttgtcgttaaggcatgcagttttatgcaagagctgtgtttggaggaagcgaatctttccattttgctttttaaaagtattgcattattaaacctcaggttgcaagtcttccttgacagagaggaccatagtgacctgtttctgctaactgtgggatttgaaaaagattcacacggcttttattcttttatttcataaaacattactactgctgtaaatggaataatagatacacatcaatcagtgtagtcaccttttattgttgattcaactaccaggtttttacagaattcaccctgcattttatttgacttgtacatgaatagtctcagcagacttaattatattagtgaaaaagtactttcaacaaaattatatgctgacatcccataattcatacttaccgatttgtggaacagatttatgtaaatctatcaaattactctagatgacactttttaaaattgagacttcatcttaatggtatttgtagaaatttttcgtatgaacaattttacatgaactatttaaaactcgtatgacttccttatgaaggcagaattactataacatttgagcatcttgtctccacaagttctgtaatccatctggtacaatgtagggacatgaggaacatgtttataagggcaactatctcctaaaccacaggctcctggaaggcagatgctgctgctccttcatttgtttttcattcagtcattcacagaacatttaatgatctgtcttagggtcctccttgtcaggaactatgttctgcttgcccttgctcagcagtctagtgagggagcatccaaatggaccccagacacacataacaaagataacggaataatataagaagctgtgggaggactagtcgagaggagcactgtacagtgtgcactggggatggggcaagttgtggcaggaaatgacttcagagagtctcaaaggatacatgggagttggctagttggagagctgtgttccagacatagagaactgaatgtgcattttagggtgtatgtgtaggagtggtggaagatgagcgaaagtagaagtgagcaaaaaactgacagtgactggaaaccagagtatggttagatttgtgttttaagaagttctcctggacaatgttttggtggaggatggctgtttttggaattaatgggagtctaagcaagggttgtcctattaggatagtgtagcagtgatcagggccagaataatagagaaccaatgctaacgcagacaaggggccgatttagctggtaggactggcagaacgtgatgcgggtgtggcagaacttgggctggaacgtcttgcacatcttcactgttagacttgagctagttccttcaagccttggatcaaatgttacctgcaggatagggcctgctctgaccattgtatttaaacagcagccctgctcctcccctccccactctcaccccctgctgcttttttctccttagctctattttcttctaataccctgtagaatgtgttcctgtcagaatataggctttatgagaaagatctttttctcctttgcattctcagggcctagcaaaaagtatggttcccatagttattgaatgcttattgtagatgagaaatttgtagggtgactcttgttttttttaaatacaaaattttattttccacaattttgtgttgagggtcttgtttaatattggttggataaagttaatatacttttaatcaagaattacggtagtctattgcctttacctttaaacctgagggggtaatttgatttttctgaacattggtagtaatttaaaatagaaaagactaaataaagtgacctttgaatgaaacaggtccagaagattgtgtatttttaattaaaatatgcaattaaaattttaattaaagtagggtattaaaacaatgtaggtggcaggggaatagctgatgctttgaattacacacagtttgggatatattgccatttactgtgtttcccacagtagcactttgccactaaacgggttttcttcctgttttcctctccttgctctgaaccctgctctcagtagtctttggtcctcttcagaggcctctggagtgcttcagctctgtggtatagatcccttgaccatgatttctaccagcctgtttataactgttctccttgtgccaggagcatcttataaactatttttctatctcttgtgaagaagggtttcttttctgtggcatgtatgttagattaaaaagaagcgtgtgaaacaaaaggcattcatacacaacagtgcagcacagaatatagcaaaagttctagaatccctaccaaggccattaaaatcaagactttgggccaggtacggtggctcacgcctgtaatcccagcacattgggaggccgaggttggcagatcagttgaagccaggagttcgagacgagcctggccaacgtggcgaaaccctgtctctactaaaaatacaaaaaaatagctgggtgtggtgatgcatgcctgtaatcccagctacttgggaggccgaggcagaagaatcgcttgaacccaggaggtggaagttgcagtgatccgagatcatgcccactgccatccagtctggatgacagagagagagaccttgcctcaaaagaagaaagatttgaattaatggtttgaaaattcttagaacacttgaccacaggtagcttctgagaatagctgaggacacgtggcattgagcctcttctttatgttcagttaccaggcaaattttttggcatttaaagacaggatttgtttttcttaagggcttttttttttttttttttttttgaagagccttagctttgtcattttggtcagaatagtcttttaatcatgttggtttccataatggttgtacttggaatttaaatgtagcatcttataaaactttttaaagaaatgaatcttagtttggggattatcagtatgcacattctaaattcagagagacttgaaaaataggtttggatgatatggataagtgatgcttggtttccaagccttccctggtggcccatgacttactgatgaatataagagtgggaaaagggtaggtaaggtatttttttttgtaatgtttgccttgctactgcttttatttttaaaaactgtgcgctcatttataaccagaaatatgcactatataaataagatgcaatttatgttgtcataggaatgaataatggcactgaaattcatatatagtaaaactgatatttgtataaaaggtacagaagtttgagatagtaatcaaacaagaaacaacttttgcggtaaaagtgtcagaagtgcctggttacgttattattcaggcatattgggtacaaactagtcctgggcttatacgcaatatgcctgaagtctcagttcaggtataaactagttaattgagtggagtagagcacagcatttgaaagtcctgacttcaagtcctgactttactacttcctccctgcctttttgatttgtagaagctgattgaccttgccaagcttcagatatcatttctaccttgtaggagaagaatctgaataccgaacatggttaatgtgaagctacaattaaacagtaaaataccatgtagctaaaaggtgagaatggggaggcttgcctatcttggtatcatctgcgatacccttaatatattttaaacatccaataaatatttgctgccttgattacagattttcactgtaaagtaatttaaagttctaactcccttttgttatagtgccaacattttaatacaccaacgatggtaggtttaggaatgcagtcttttaatagcagataccccctttcatattattttgcttaggataataatacagttttgcttacctcaaacatattctgagtggcactcatcctaataatgccactaggcaaataagaaactttttataaggaggcaaagtcatttggggataaatatttctgagtataaacaacttaacagatactagatatttgactgactcatatagctagtcatgattgcttgagggtatcaggtggaagacccatttgatggttgggtcttctgatggtggtggtggtgatgatgataatacctttggttaaataaataacatcagtaagtttctcattctttcatttagcaaatgtttccatgcctacagcaggccaggagtaagggttcagaggctagagtgggaaacagctaagtaggaagtaagcaagacaggcttttcactttacccagtgatctaatctcagtaggcactcttgtgccccagacagacctcaggaggccaataaactgtttctttgaagtaataggtaacttgaagattttagaagaaacacatccacgtgtacctaaacaacgcaactgtgaaacagcagtcatccctgcaagacctttcttagacctcccagcagccccgttgtagccccagctaggttctcaccattaaggcagtgatttctcaacatggtggttgtacgttagtcaccaggattttaaaaagctagtaccaatgcttcatgacagactgataaaatcagagcccaaggtgggaggatcgcttgagtccaggagttcaagcatggcccagccaatgtagtgagatctcatctcatatacacatatatatacagacacaaacacacatatatgtatatatatctatctatttttgggagtgggattcggggatcaggtttttttgttttagttttttttttttttttttttaagctttctagatgattccattgcagtcaagtttgagaatgcactggggttagaagctgctaagatgcaggaggaggagtatctatcagtagaaagggcaattagactatgctgatacaattgatttattttgtcatagaatagcagtatgacaaaactatatttgtattgcccttttctttttctgttatatttgtggcatcttttttatttaactttaaatgaatatacttaaaatctttaacagtaagcatgttattttttctcatgttatcttttgactagggtgacgatccactttcatcattaatgaatattttcatcattgcatcagcaacctagttgggtaggaattaccctcgttttagagagaaggaagctgtggttcagagaggtgttaagtagcttcttcaaagttgcacagctaactgcgagccagtaaacaccagagccggtattggaagtctgtctttccactataagctggttccttgagcagattttgttacattcagccaatttaattctactcaatgacaataggactgcaacacattttcataagaggggcacaatgcatgcagtaaacacatgataaattttgaattaatgaaaagctgaatgcttaaaaatacagtggcttcacatgtgactctttactagaactgtaaaataaaacctcaattttagtgtgagatgaaattaacctaattagtttttagctctctattcctttctcttttttaaaaaggaaaaaatacattttgatagaggacatatattagcagtgattatccaaaattctgattgtggtcccaaaatataatcactagttttcatattgggcactgtatttagccttctcttttcgtttatgtggtaacaagtatccacattaggataaccagagtagctgtcctaaaaacccacattgataaccacttgcacctacggtgccccatcaagaaaaaatacctcacttccctatgaaattgatgcaacagtagtacttagtaaaagcatttggaccgtccttgggcatctgggaaatcgtcatttagtttgttttgacttttgtagactaaacttttcttatgccatttttgtcacctgtataatgtttcttgccatttcaaactgagaaacttgcttcattgaaaagttgagaccattgcgattgactttagttatctttgcattccattgatgcaactgcttttgatagctcccattgtctgagatctagggcatcagtgaaccaggagtgagagggctcagatgatggggggagggtggcaacaacaacaaacacttagaagcaacttttactctagactttttttctcctgttatttttgtttatgttctatttcttcttttcctatatgttctcattgtcttcgatgtcatccctgtaagtcttttgtgttcatattttcctgttcttatctagatcataaaaccctctttggagaaatttgattgagtgtatttgaagataagccctcgtctaaaataaacttacatgtatacacgcccacacatggttcttcaccattttagactccgacattattgtacttggtaaaggctgtaaatatgtcagggtacaatttactgaacactgacagattcttggttgatgttttctgtcttcccatttttatggctaaggaaactgaagctgaaaaggtattgcctgttaagccctctccatagcacagagatttatccccacagtttatgaagctgaccttgtcttgctgatggtatactctggctcaggcagggcatggatggtggaatcctttggggatgtgtgttttttttttcctaaacagcactgcttgctgagttctaaaacttgaaaatgtagtagacaggagacataaagacttcatgtatatttctagaattaatagagagttctttttactgttgaggaaatatgctggtgttaatgacaagaccatatgccaaaatgaaagttgatctctgtcaacagtatagaactaatatatgcctttttccccttccttttcattagggcagagcttgggatatggctttgtgaactacattgaccccaaggatgcagagaaagctatcaacaccctgaatggattgagacttcaaaccaaaacaataaaagtatgtttaaagtttttttatatctacttgcggaacagaagtttaaaaaaattaagatttatttgtagttctttcctttcttccttttgggcccatataaacagttacctgggagacatagtggaattttggtgtttgttgcaagatggaagaaactgtttgttcaagagtgctatgtataatcattcatgtattcgcaaagggggacagagcaacaactctcttagataaatgttataggaagcctacggaatcaagtctccttcccttatagagaattacttgccctataacttgaggaaaccttagacttgttcttctataaaggtctgggtagtgaataagcaaggttttgcgagccatgcattctgtcacaacttctcaactctgcctttatagtatgaaagcagtaatagccactacataaacaaatggatgcagccgttatccaataaaactttatttatgggcaatgaaacttgagattgataagatgtttatgtattacaaatattctttttattttttccaagttaaaaaatgtaaaaaccattcttagctcatgggttatacaaaaaggtggcaggctagatgtggtgcttgagttgtagtttgctctagctaattcagcttgctttgaggagactgactggaggaacttacatgacacaggttattttttctgttgtttttctttttaagacgtacagtaaataactttgtacatactttgctgcttttgtgaatctttgaaattcttatgtagattctctcttgagagggagctaatctaattcacagcatagatttcttttcctttagaaaataagagggatgtcgcctctagcaaattcttagttagctgtaccatcaatttgccctctcctgcccagtgcagacattgccagtcaatcatggcactctttctcacagagtctagatgtggctcccaaatatttttttcaaaatagtgttccagacaacttctatcaattgactcaagtttgaacctattttccacccttgatttaagaaaccagctcagactatagcctgaagtggtgaggggaagttagtcaaggctgactgtagtatccatcttgcttagagacttgtgtaaaagatttttgctcatttttttcaggtatctggaaatgaagtgtcatttttgtgctttaaagttgcttttcttagaattaccagttaaggtaatttattagccctgagtggttttgacacatcagtctttatatttattggcccctaagaaaaatgcctaccagccctgtcttatctaaatgaaagtatatagtggttcccaaatatactagggtatgagaggtccaagaattctagatacttcttgagcaagaaactgttctatgaaaagattcaccaatcagaaaatgaactggttactgtatattatcaaaatgtgaagggaaaaatgagatttccaataaagtgtaagacaagtttgttttgaagttttttcagtctgaactgctttttctcgttatctatatttctctgcatactttctgtgtcagagatcttttactagtactattaagtaacaataagtgttctttaaaaagacatccagtgttcagttaccgtcagaccgtgtgctctttatcctacagcagatttttgcaggtttcttttcctcaatttatattgatttccagcgttgctgctaatttgtcctagttctgaggtcctgagttgtagttgggaagaaaatggaataggtggtcaagatggcttgtcccaggaactatccttttctccattctagaaataattacccttatttcattctagtgtgtcagttcttttactaaatatcctcctgcacgaagatccagaagaaggtagaaatgcaggggaaataggtctccacaggagaaatgcccgtggccttcaaggagacagttgatgacagctgcttccttactgttcatcatccagccttttctctttagggcccagctgcttgggctgaatatgtggaagaaagcacagtaaagctttgtggcttttatagtgtgacatcagtttctgattttctgagatgtgggtcagggtaatgggcaaatagcaggctacttctttccccgcccctatttggttcctgtaaaaatatcagataacagctggcatcctcaatttggcccacatttgtctaagaggcaaagcagaccatttcccacaagtatatagcaccccctttgcctgtttgttctttctatgtttatttatttccattagacagattttgtgctcttgtacaatgtcttgagccaagtttttctagtattcacagctttaagaatgttttggaagttgagttaagccttttcatttcctgggatactattccataaataagtctttttccctcgtctaatctatactggtgatggctgtcagcaccactttcttacacagcaccactttactcgtgttactgctcactcaaaactctatggtgtttctctactgttttaccctatcatctggctgagttttgtaggagtgatgccagtgctattgccgttctccactgttctcagactggctctttacttgtaagctgatcttactcccagcgtccatgcatatgcttttgcagctccgactttttggtataccctttcacactcatttttagtttaactgtggtcatctcatcttttggagcccatctaaaggaattctgtccttcagcttctgtctttccaggttgttccagctcctgctgagttcccccttctttgaagtctatattctttacccttgaggaaccacagaagttttggaattacagggggacccatatgtaatttaggcttaagcactgttctctgtccacagtcagagtggagatcttggtggtcatacaatttagccaagaccaggcagttgaagaaagagctgcgactcaaacaaatccttgtcttctgatcgttatatcaaaactcttgccaggacactgtgctttactttagaaaggtacagaagattggttagtatatacaagtgtttgtgtactccaagccacttagaatttagtatgcgtttggtaaaattcctggttattgggatattgaaacagtgaatcaagtgctgtgaaaggtggtttatttagcagtttctcctggggctccctaatagcattagctcagtagggttttgtgcagtagttggtgtgttgaataaatgacagatgttcagtatttccatggtgagtgaagtgaagtccctcaggctctgtgaggacctaaagcatttgttcccaaactttggttgcatcttaatcccaagggaagtgagttagaaatacagtttctgggatccactgtagatctactcgatccctgtccacaggtgagattccgggttctgttttttattatgcttcccaggtaatttatgacagcaagtctaaggcctagcacttgggaatcaccaaagatgtttggcggttctctatacatttggtatttgtgtgtgcaaagttcagtttgtcttctagcattttaccttaataatcctcctgtggttcattctgttaaccaaaatattaatgttttttcttgagcatgctgggcgatcgtttagcattcagagttcaacgtggttcaccagcctttgcttataaaaaaacatggcatagaaattgaaaacaacgtatccgtctcatagtaggatgctgtttgtttaagtagtagcagatacaggttaaagtctcgagatacttgttctcttgtcctaaaggtcactttttttcctggttaaggagatgtcccagaggcataccttgctggtgaaatgacatcatccctgtactgcatgggaggcagctattttgggttaagcctgcccacagtatccccagtgttgacatggtaaataaagtgtgaatattacaaaaatgttttaagattctcattagggaaggtagtgaaaaggtgatatgtgtacagttcaggcatgggggtgggggagtaatctcatggaagtgtcaagttgtatgctggtgagaagaagagaggtttttctccaagatccttcaggtccctaaaggaatccttcctttggtgagttattcatgaagtgagtggttgtacctactgtgttcagtcttcatgctctttctctactcattttatttttaggggtcttaagtattgaaaaaaatctaaatagtatgtggaatttttatggcttaaagccaatacttttgacttgttaggttaacggtgtcagacttaaattcatgattagcaaactaaaatcattcatttccaagaatatgtgtagacttcctccctcctctgcataaagaactctggataggtgattatcacataacacagtgaaatggatacgtggctcccagcatctctctcagcttttccctcctctacaatgggcctaggatgctttatttttcctgaaactggggttgatttatctggaaagaaggagctgttatctcagggaatagaatgttttattgttattggtaagttctgacccctcaaaagaaaaaaaaattctgtctagaattaactaccatagaaaaactgcccgattttggtcttgattaaagaaatattttccttaatcattcagctatagaccaggctaaaatttacctttgcttaaaagttattaattggtatacaatcatgaaatttcttatactgaaataaaccacaatttaaccacatttggaaaattctattataaaaatgagaatattataaatagtattatctattttttgtgttcagtttgagagtgattaagcaaacctaagaaacctgtattctaagctactgtattgccattaactttttgttaaatttatacctttttctaactagcttatcctttcctcattagtaaatgtcatatttatacttttttttttctgttcagcatgagcttgacccttaacataggaatatagaactacatttctgaaatcttactctgtctaaattaccttactaaaatgatttaactggctgcttaatcttggacagagcttttaaccatttaagtttccatttatatcgttaaaataatttattcatcactgagaattttcattacctgctttttaggagaggaaaaaaagcttttcatggtctgctaagttgcatattaagaagaaatgttaactttttaaacaaattcatgtttattgcataaaatgatttgatgaaaagcagcaacctctcctgaagagagaataattttaattgccttcttctttcactcttgaaagtttaatagccactgtaaactttatatggggatttgagtttctagttcaacctccttttgcgacaggattattgggattgggttggtttttctttatcattataatttgttcttttataaaagttaatactggccagaaggaaatattcttagatgctgtgtaaaccagcccccactgtaaagaaggaggagagggtatgcaggcaggaatgtaagtaaagctacgctaagggcttgccacccagtaggtcctctgttaaaatacctgcagcacagttctgtgtttgagacgagtggctctaatagccataatgctgggagttcatgactttagtagggcatggaagttttaaagcagttgataggggaaccatatagaatttgcccaaaaagaaagcaggatgggaggcgagtgtgggaaatgagcctgagttatgcgttatagaagtgtgttctgggtgcgcatgtatgtgaaggcgctgatgttttgttctctaggtgaggaaggggcaccggagggttttgagcagagtagtgttgggattgaccttgagtatttattcggagaggaaggtttgttttgtatttaaacgccacatctttctcagcatttcaacccaccctagtgtttttctggcttgtgtagtttgttatttcctgtgatggtacaaagggtagaaatttataaatcatcgtctacaaagtacccctcatttaaaaacctttaccttgagcagatttggaaaatttagaagtaatagttggaagaacaggcctcaaattaactgacctacttatgagatgttagcctaataactgttatttatccagacaaaaaaaaaattgaaaaagtatatgccaggagtggggtaaaaattgaaacgttgagtaaattgttcctctgccttttaaaaaatacagactgaccgagtacatgttttcctaacttcattgttaacttgtattctggaaatttccacagccacatgtcaagttttaacagtatattacatctgattatcagcacctcttcaatacatttaaataaaatgcttctatctatattgagtcccatttacatagtccttatttgaagtgagaagtcacagatgacttttttattgttatttgtataatgcccttcatgtgttttgtagaatgctctcttgtcagctttaatttttttcatacaaaaagcccagaaatttcttactcatctaatgtggtctagggaatgtgggtaggtagcccaagtaaggtccagagcttgaatgtcctgtcctcaggcctcttgtgttacttctgttccttttagccaactccaaagtgagagttaattggaattctcaaagggcaataactaggcattcttccaatggatttcctttagattttcccacagttgttggagcagaggcagagcctacaaagagggaaggatgaggaacagggttcttggtggcagtgtcccctgcttacttcctgcctgtcagccacacagtggatagtgatggtagaagagtctcaacagttgactgaacccatctttattggaattgatggatcattttgttacctaagcatgctccacaggggtatcatagcccctcatggcagatgcttaaacttatgcaaagtatggtctataccagaaaagcctggctatttcatttctgtaaccagcatggagaatgtcaggttttatgaagacctccattggaattaaaagagtaactgcctccttgtgagtattgcttctgtgtaaggtagggggaaagccacagaagtaataacttgtataggtttaggaaattgttgctgtctgtgtgtgtgtgcacgtgtggaattgaaaggggcatgtggtggggatgtcactgaaacttactgtttatcagaaatttgagtcattgaggcagaacccttataacagctcacaggtctagaatgttaagtgcaaaattggtttccgaataataaggaggctgaggaagagattcaagcaaaccatgtgcatcatgatagaagacactgaaaatagttgaaccacatgttcaaatgtgtttgagtttgatttctaagataacagtgagataagataaattgaaactgatctggatggccaaaaatcttttcttttttttttttaaattattattatgctttaagttttagggtacatgtgcacaatgtgcaggtcagttacatatgtatacatgtgccatgctggtgtgctgcacccattaactggtcattcagcattaggtatatctcctaatgctatccctcccccgtccccacaacagtccccagggtgtgttgttccccttcctgtgtccgtgtgttctcattgttcagttcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataccagaatctacaatgaactcaaacaaatttacaagaagaaaacaaaaatcttttctacctgaacatcacactgctagcccttgttgctttactttcccactgctttttaaggggaatgtggggtagggcttttctttcatttatcacctgggaaaagtggtgctaggtcagtttggcttcagtctgttctaccacatacctggcttgtgaagttaagatgattgtgttaacttcccaagaaggagcccttaattctttgctgtatctacttttgaaacaaatttcataggactattatctttttactgttttgaattcgtgcagaaacagcagtagtctctggtaggcaaatacttaatccctttgatgaaataaagctcaggttaaaagggatttgttcaaaatgaaatagctaataagcatcagaaatgtagtatcatgttggctgatgccgtagcttttgttgttttctttccatttcacattattgatgttaaactgttttgctcagataccactctaaataaaccaactgagagaggccttaatttgggcctttgagtgtctttgtcttgagactttctggaccagatctcttaggtgccagagagtggagctgtctttgcctaggagtgaagaactctgccctcttgcagagtgagcacttgagacagccagacgtacagtttgagaagaaaactggatctggaggtcatacttagcagataagtgagttaacattgattcagttatttcagttgtaatgaacagtaaaattattattatagtagtaacttcctgaaattattttttaggcagctacgcattcttcgacaatgtttttctggtaggttcatgtaagtcgtagatgctagtttaaaggttacagaaatgtgtgttaacattggtctctctttaaatttgcgtagactctttaaaaaagcatggatggtgcattttcttttattttcacttctgccagccattcctatcattacttttagtgtgtgttctcacccgcatgtactacattagaattacttgtggatgttttatttccagaagtgtcttgacatgctgcttttgggcaatgagacagagctgtacagttgacacttgaacaattcgggggctatgggtagcagcccccatatagcaaaaagtctaacttttgactcctcaaaaacctaactactagtagcctactgttgactagaagccttactgataacataaacagttatcacatattttgtatgtttcatgtattacatattatgtgttattacaatataaagtaagctagagaaaagaaaaggttaagagaatcataaggtagacaaaatatatttactgttcattaagtggaagtggatcatcataaggatccttcccccttgtcatgtttatgttgagtaggcagaggaagagggaggggttggtctaaaatcccatattaagtgcacccacacagttcaaacccatattgttccagggtcatctgtattttgaaaacagtacaggaaatctgatacttgcctgcctcctctcccttccttctgtgaagaactcttttgaatgctgcaataggacttggaggtgtaagtcttggatttgtgttctgttcttggtttcttgatcaggtgagctgcaggaagggcaaggaaaaatagaacaagcatgtagtcctggaaactaataattcagaaaaagtttcagtttctagttttggttgttaaatgtctatctagaaatttgtgcttgccttaaccaaataaccatattcatattcctagaaagagtcattgagagaagctcctaacttcatagaatcaagcacagtggcctttttgaagaggctaacccagttgagccacatccagccagtctgggttcttggaaatatctttggatgagtttcatgggctttattttacgtctgcatttttgcatttgcaggtgatttatattcctaaatgctttgctttcaagctacctggcatttgtcttatttagaaactaacgatcagtggatggcaaggaaaagggcttggcatccgtggttgttatgagctatctaggaaaccctaatatgcccagagttttgaggattatttcaaatgcctttacacaagagactgccaacactttaatgtttatcaggatcagtggggtggggtggttgattaaaaatgcagatttctacaccccaaccaggacttactgaatctgattatctgcagagagagactgaggaaattgtatttcaacagccaccacaggtgattcttaagcagatggtggcctgacctgagaaacactgttcagtggatcttaatgatttgcacttgggtaggtctgtggtgcttattttaaaacaagtctacttgtaaaaaataggattttcatttgtcggttacatcaagatatgttgaatggctgggattcactaatgtgtttttaatgaatatagtgctggatttacctaagaaataatgcacgttctcacacacaatttgctcattttcagggcatttgtgtgtcattaaatacttcaacattacaattatgctagcataatttatttgcttctgagggtatttggagaattttcagtatggttctttagggcctatccatttaaaatgggtgtcttggccaggcacagtggttcatacctgtaatcccagcactttgggaggctgaggtgggcagtcagaagttcaggatcagcttggccgccaacatgacgaaaccccatctctactaaaaagtacaaaaattagccgaacatggtggcgggtgcctgtgatcccagctactccggaggctgaggcagggagaattacttgaacttgggaggcggaggttgctgtgagccgagattacaccactgcaccctagcctgggtggatagagggagattctgtctcaaaaaaaaaaggtgaaagggtgtcttatagagattgggagttaagttttgaaagtggcttttgagccaggcgcggtggctcacgcctgtaatcccagcactttgggaggctgaggcgggtggatcacctgaggtccggagtttgagatcagcgtggacaatgtagtgaaaccacgtctctacttaaaatacaaaaaattagctgggtttggtagcaggtgcctgtaaacccagctactggggaggctgaggcaggagaatcccttgaacccgggaggcggaagttgcagtaagctgagatcacaccattatactccaacctgagcaacaagagcaaaactcccatctcaaaaaaaaaaaaaaaaaagtggcttttaaaatttaataaaaatttgtcttatttttatagcctgccaaccaaacccctcttccttccctacccagtgtcttgatatttgagctttctagccagggcctcaataaatgggaatttgctctattataagagcttccacacattttatgctataattttttaaaggaaaaaattttttgctatatgcaaacttaatttagaaacccttttgacctgtaaaccaaatgttgccccaaagctatgtgaaagcagtgcatactcttgccaaaaggcttacagtgttttccccctgctcagagttgcaaaaatgaattaataagaaaccaaggatttttcttcatgttcttcattaagcaatgtctgaggggaattgtaaaatatgcattgtctacagtatatgtatatcctggtgcacaaagtcagatgaactgtgaaggtgaggggtaaaaacacccctctcacctttgtactttgttctttggagtattaaagaacatttatctgccaagtggcaaaggggatactatttggcggtttaattacagccagtgagtgttattgatgctatcagtcagcaagacccagggaaagggcctggtaccaaatcattcagtgtaattaaatatctcaggacgggattctcaaggtgcttctggagatctgaagcaggagaacactttgtcttagaacaaagataaaggtggtagttcccctcctcgctgcccctctttaaatttctgcaggtgttgcatagatggcaatgatatggtctctttattgcgtacagtgaaggttgtccatgttttccttaaaaactctttcttttaaaatcttcacaactgtcacacaaagggttttgggaatacagtaattattttttgttaaagctgttagggggaatatacagctcaggtgtctaatagatacttggagaatgaaggattgtctttgaatgagactattagtcttgcaaatcagttcatttaaaaaaagctttccctatggttattctctaatgtctaatcatgttgtgagagaaatatcttggtagacttaaagtcataaaacaacactcactaatgtttcaggggttatccccttatgtattgaataaatttttcatagttgcataacttatgtcagccccacaaaatatgtgtaggtaaaacttcctttggctctgtggggagggcttttaataacatttctgttattctttttccttgctttctcctttatcatacgtgccttacacaaatttccatctctgcctgttaaatgccataagcaatctgcagtgtttgctgttactgctttttaaatttttaaaaaactggtacagtttctactgattgaggattaccaaagacaggctgcccttgaaagaaagtgagctggcttcctaacttctttgtgtatgtatacctgtatacatacattagatccctgataattgtgtcaaatcagggcccaaaacactaaatcttggatagcgtatggtttacttgtaatgtagatagggcttgcagattgtgttttaaatttaaaacaggtgtttaaatggggattgttgacataaaacatcctttaagaggaagattatttgttaggaatttttctctgggtgtttgaggaatcctatttttaaaatacgttaaagatttagtagaagtagttactttatgttcaagacttcccaccccttagggctttattatattatatggaaccataacaagactaataggcctgtctccaagtttgtaggaaaggtcagtagctttaaaagatgtgcatggtgctcaccttgcccacaaaacaaagggccaggataagcaaatgtaaaagtttttgagaagtatttaattgcaagttgtttttttgttttactgagaccatgtaatcttggctatacagtgttggacagggagtatctgtaattaaatattttataaacattttgagtgcttaatgtgggctagttagctttgctaaatgtttgaacagcattaaaataagacaagaggtagccttgtccttgatgtcattgtgtagtaagggagacagcacttagtttatatgaccattatttggatatatgatgagtaagtgcagaatacaatgaaaatggatatgccacttgctgtctagaggcctctgtgttgatttcagagttgatggtgttttacaagctaggttttattgggcggaaaaagaagaaatgtattacacataagggaatgtctcattcaaaagcacagaggccttcacgtgatgtgtaccttttaggagaagcttacatctgaacaccataaagtatacttattctatcaagtaataaccttctacaaaaatgattggcaggaaaatttgattaaacctagccctgtactttacatttatccccctttagtgaggacctaatttataagagaaacaataggaatgaattttgggtggatcaagtaatttgctcgtagaaacatatttgccttgctctgcaaagatccgtggagacccatgggactcatttaagtatttacaaatggtatcaagatgaagtttctctaagcagtatttagtgtacacacagaggaaaggatcattatattttcattactatatgaagtaggtcaaagaagacttgggtttctgaacattgttgcaaagcagtttttcttctagttatagtacaaagggaaacttaactgtagatggcatttacatttaactttactaccacactgattttgactgttctcctcacctgcgttatgatgggaaactgtctctgtattctccttccatacatttctgtctgataatacttaccaacatttagattgtcattcctctgctcataaaagttttgccctgacattcaaggtctctagactctgccctcaactcactgttctagtgttgtcagtgtcctacagaaatctttattctggctcagctgggctcttcatcattcagtatggaagcctaattctccattgccttggattattctctgcctacatggccctctaaccctgtcattgataaagttttatttggccataaaataaattaataaagtggataaaaatttcttaactatacatttcctttctcatctatttggtggtctgctctctgagggcaacgggatttttgtctttggagagcagcttgcagaatgtttttatttataacctctgcatgaggaagcttctgtctattgcttataagagacagtgaagacctgctctgtgtgctcaaagacgaaaaaagtcacagtttaagtgaaattaaaagttgagattcttggaggtttttcgttttgttttgtttttgttttaatgccatttttaactttgggtgtgtttttcaaaacttgttggtaggtgtcactatacattgaagatgtggtcggatgaaggatatgtaaaggacttaacagcttttttgtttcatacaaaaacaaagtttttttatatatacatatttttaaaattatactttaagttctagggtacatgtgcacaacgtgcaggtttgttatatatgtatacatgtgccatgttggtgtgctgcacccattaactcatcatttacattaggtatatctcctaatgctatccctcccccctcccccaacccgacaacaggccccggtgtgtgatgttccccaccctgtgtccaagtgttctcattgttcacttcccacctatgagtgagaacatgtggtgaaaaacaaagatttaagtaaaggtatcccgttatgtgagattttctacataatgtccacctacccgtctcttgtcttatccacttctccttttcatgtacttctctctgtcagatcatggatgaagaagtgtatgaaagtcctaggatgtttaattcaccaaaattggcttgatgagaaccttttttcttttttcacattaccaaccggtactggttgttttttattctaagacacctgcagtttatttatgccagccagtgtgtagtccttctttagtttaacattctaactcagcattttaatctgttgacagtgtcttaggcatactagacattcagatactacacaaattatatcttaagtacatttttggagataaagttgccatggttatcttgatagtattggcatctgttcgagatgtcattgggtcaagtttcagaatcttgaaagaatactgaagccattgctggagaatgggcttctaacaattgaatgaatatatctgattttctgcaagccaatttagcctgcgttgttttcagtgaagcagcaaaagccaagttatttgggcaaatgccacaacttctaatcatcttgcttgagaggtacttcagaacaacctcctagctgggcgtggtggctcacgcctgtaatcccagcgctttgggaggccgagacgggcggctcacgaggtcaggagatcaagaccattctggctaacactgtgaaaccccgtctctacaaaaatacaacaaaattagccgggcgtggtggcgggcgcctgtgttcccagctactcgggaggctgaggcaggagaatggtgtgaacccgggaggtggagcttgcagtgagctgagatcgtgccactgcactccagagtgagactctgcctcaaaaaagaaaaacctcctgcacaaggccatggaatgtatacgttcaacaggtagtagagtccctacttggtgggtgggactatgtgagataggcatcatataagacttagtttcaaccctccctctagaagtataaaacatagtaatataaaagctttgaatggtaatactgttaacttgggaggaagctttgaggcagtctagttctctggccgtatttaagaaggctcaaaatactgagtactgactagtgagtactgagatttttcttttagtctctcgaatgtattcatagtatatttaatgaaaatgtctaaagtgaaagttttatagtggtacttgagagtgtagcctcttcagtattttttttttaactgggaaatcatattgaatcatcaggtggccgattgcatggtagcttgtaacacatttcacatgcagaaacatacccataaccttcatctcaagatagaagttattccatgaagttcatttatatttctactactgtctatccaaaagaatcgctcattttacgttttactggcttaggttcaacaggtctctacaaaagagaattgaggtagtgagaggtttaatatgtaacagcttgatgggagaaataaaattttggggccttaactgttggcccatttatagatgttgaatgtttgctctctgtatgtcagtaagacagctccttccttatgttccctccatccaggctgcaggcttcccagcacactcatctgctgtcatcttacaaaatatttggaatattcaggaattaactttaataattatcaccatggatttggaagaagcctcatttatatatgtgatttttgaactgtttctgtgttagagtgcatacattgttcttgtgccacgtctcctcctctgtgtcatctttcctgacctcaaagataatagtattccttgagtttttgttccataaattggggatgatgatgctgcataaacttattgggaggagcaattgaattaacatatgttacatatccagaacagtgtctggcacatggtaaacaataagtgttaggagctatcattatctgaattgtttcctatgtatgtatataaaatgatgttatgattaaaacatttatggttcctctgctctttgctaatagttttattgttgcatttaatacttgtaaggtttccatgaggtaagtactgtgattaacatcaaattacaaataaagagatagaagacctaaggaaatgattaactggtaagtaacagagccaagacctggacctagctctgtgtgactccataccatatgtttttactccttaacatgggagggttctggtccaaacattccatcctaacctctagtttcatagtatgctgtgtagtggccagaactttaccagttacagtgtattctcttctgctttgtataatatatttttgaacctggtgctaagctaacacgtgcttgcctcagttgcagcctattcacattacttagtatttataaatattatgtggctaaataaatgcaggctcatttctgaagttaaaagtaagggagttagcattcttaaccactactgacaattttctaatgcagagagctaccggtaggaatagactctttggtggttacgctaaaactcccatctattttttatactactttagtgtaatcaccttctaaagtctgaaaaggctaagtgaaatatacaggattggaaatggaacatggaacattttgattgacaagttcctgcttagacttggaatggctagcctactgccactaccatagtgaatttgatttcactgcctccacctcagatgccatatccactaccattgctcaattgttttattttctgttaagtatctctgcaggtaaaaaatttaagaaatggtaaggtatttatggcctaagttgcatttcaagaatatctttaccatgtatcccatttgcctttaccagtatgagatgtccttgttgaaccaacttcatactagaaccaaggagaaacaacaataaaagggcagaagttatgtaccagttgtactttactaaaaacgagatgcctgtcagggcagcctatttagaccctctttgatacacatggatgcaactgtttgggtagcatttaataaaccacactcagtgcagtgtagtttgtcagaggctgtttaagatgtgtgaaaaaggtggtctaatttgtgaagtctgtagttgatgatcagttgcttgatatacagttcttacagccaaaacactttttatttttctgtggctattcagtagatttattattgtctttaacaatgtcataggatcacttatttttatgacattacttatttattcctaggtcgcctttaagttgaagctaagatcaactgccttgactaatatttaatgatgttgcactaaaacttgaaaattctatgaaaatgagaatctcccctagtgtaaacagccagttgccattctgttttcctgttaattggtttgtaatcttataaaagggagagacactatcaaaaagattctagctattgtaggttggtacgttttaattggtggaaagtactagtctcaggattcttagtttgatttttctcttcaactcccaaataattagatttttttctccaacatctcctaaataattctcaggcattactagtagaagaattataataactgtcctaagacagtttttttgatgtgttttattatttccttatgtgtatacaagaaaatattctatgtagcaaagctaaggttcttattttctaggaatagctcttctgatgtctccttggaaatgtctgattattgtcccagtcactgtcatttcacaggaagattttatgattttgaagactgtgttgcagctaatgatgtaatggaaaatcccgtgatgaagagctaagaccgcgagtcctacacccaactctttttctttgtgtctttggaaaagttgcttcacctttctgtgcctcagtcttcctatttcccagatacaaagaaattggactaaatgatcactgtattttctttttgctccaaaattaagactccccccgccccacagcctcctatcagcaccatattactttgttgaagattgtgtcgcctctggggacttgaatccccaatttgagaaatgaaatttcatttttgaaatgattaatagaattttcattgtagtctgtacacaaagtaccaatgcgtataatgttgggtatatgacaaagattgtggcttctgttagcttttaaacagtatttcagaaataaactctcaatttaatatgtgattataaatcatcttcattacagtgagtgtgtggtagttaccaggatgtacaaagtaggatgatgacaaggtttcttatttcaaggggttaagtcagtcacaagaaagggttaagagataagtacattttggttaagtcagtatttaagaaaacaaggcatataatgcagtgtgggtgcaggtaagaggcacccaactcagactgtagtggagaggactgattagtgttgactttagggactaggtgatacccatgaggtgtctgaaatgactgaaatttagctgattggaaggagggcagcttatttttaacacagagaagtgagagcaggaagcttggaatactaccgaaggttttgtatacttgtatggaagaggtagccagtgctctgaccataaaggaataagaattctaaaatttatctgaaagtcttagggagccctttaggtaatttaagttgaggatgacattatcaaatatattccgtggtatctctgaacttctcacttgaattaaagcaattgtttagtcttaaaacattcaacaaatccagtcacgataaaatttaaggttctgtgtgtattttccactgatagttttctaaatcctatattttggaatatccgttaaagataactgccctaacctttaataccttttataaaatttcctgtttggatgtgattatttcttttagctctaactttgctggagctaatacttaatttcttattgttatcttaggcttattcattttcaacccattgtgaaatatgcccttccttattgaaaacttaatattggactgtgatacatgtatgccttgatgtgtgtttgagacttgttcctggtaggagtttgaatttagaagcagatcaaagtacacatcttccttttgggtgaattttgaggtctctggcctgagttgtggttagagatcccccttcttctgtgtactatacttctgagctcattttggaaggtccgatgtagccacctgtccaaatatccatgatgctgtcacaagacctttgctactgcttacttagagcctagagctaacttttattgagttatagtgtcatttttcagatagtcccacgaagactccatctttaaaaaatatgaacagcaattaactgtccgtttaaataggcataactgtgacctttcagctggagagattgaaaggagctttttgaaaaaagtctaaagtggcaagtgtctaattttcaggtttaatgtttgtagtcctgggtcagtaattgacaagtgataaaagttgttcagtggtgatcttagcagtgggtgacttctcaaatgtttttagtttaaaaaagagggaacttctttgttcatttatagaccttatcactttaatctattggtattaatgtccactgtcactgatctttccattgatgaatcagagaaacgagagcagttgtgtgtttggacgaaagcatttagagggacttctgatagtgatgcactgggattttaaacattgctatgtacatttaataaagtactaattcataagatggttttgtttctttgtataattttgatcaacttgtgtttgatagcccactcttagtgtatgtgttactcatctttgtatgtttaatgtatcattagttttagctgctgatgaagaaatgagcttttaattacaagtaatacactatatttcaaacggttccattttcaagacataattcaataaatatattctatctttattttgtctagtctagtcttgtttgtgaagaacagtttgagaagccatgggccatttacttacctgtagtagcaagtacttactgcctccccgtccctccccttccctcatataatctcagtattgcttgtctttgtttattatatcactcgtagcttttgtgagaaattccagaataaacctgagttttaaattgctatctttggagtagattggtgttcagtgttgtactccctgtatcatctttaaatatttaaattgcagactctctggctgcctcttaaattagatccttcacttagtagttttgacatttcataaccttgcttctcatgcattaaatattcacctgtttaagtggcagtgaaaatttaaaatccaaactcatatattaatccagcaaatggaaaatggagaacagattgcagtggagaaagaggctattttgacctcagtaggacatatgctggaagtccattgttttgaagcatttctaaatagaatttgtcatttaaagcgaactcttttgggccttcaagggagtttagtcttgtagaaccaaaaagatacttaacactttctgaaaatagcccctgtatgattctgtaggtgcatatgaaggcacctgtaagatctaaatccacaggaaaaaaaaaaaatcggaatggagaaggttgctggtaatggtcagatacaaaatttagtttggtaactgatttgatctccagagtgtgagtccttaggtaactgatctccagagtgtgagtccttatcccactatcagccttcttcccacttaggtctaaatacattttctatttataatctttttagatgaaagaagaaatgttttccaggaagggaggattttgatgacagcgatatccttgatagtggaagggaaaggaagctgttttaattccaagaacagtaaataaagggataggggtaggaccttgagccttggtctgggaggaaggagaaggcaattaccctttcttacacctttatttcctgaaagtgaacgaaaatggcattgcttactcctgagaattagaaagtaacaaaaattaatttaaaaattctaatgatgatgtgtagtttctttggttaattgtaattagtggccacttctcttttcttagaaaaaattactcttaaaaatattaatggagccgggcgtggtggctcatgcctgtaatcccagcactttgggaggccgaggtgggctgatcacctgaggtcaggcattcgagaccaggctgaccaacatggtgaaaccctgtctctaaaaaatacaaaaaaagccagtgtggtggtacatgcctgtaatcccagctacttggaaggctgaggcaggagaatagcttgaacccgggaggcagaggttacagtgagccgagatcacccactgcactccagcctgagcaacagagtgagactccgtctcaaaataataaaaagtggaataacttttaactaatttctagcaacatcctgttttctgtctgtggccagtttctctgtgtatgcctttaagaaacagccaggattcatttaatttttcccaactcagaacaagtgaactgaaacactcacttaccatagtattattgaaggaaaactggatgaggagaccaggacacagaaagagaaagatcagagtttgaacccagaattcaacactagttgtgtataaccttaggcatgttatttaccttgtctgtgcctgtttccccagctataaaatactaatatgtatgctgcctacctcatggggttgttgtgaggcacagacaaaatattgtagtttgtgaaaatgccttgtaaatggtgaagtctcataatgccctaaatgtaagtttaacattaaacattgttaccgacgtaagtttatatataatctaatcactcctgtcctgcctgtggtagtggaaaatggttctttgacaatgtcactgaaagatactgtttttgagaaggtttgtcttggagcctttttaatgtggctgggaactaaagatacaatataaactgaagagtggacattggggaaaaaaaaaatcacataactgacctaggtatgttttcaaagcctttatataagcattaaatataaacccattttcctaaatatattttaggatgacttttaagacacaccacctacactcatctgaattgcacaaagcagtgaatgtcactgcatgagtaaattgttctagaacactgtaatggacccaggtttctctctactttaaggggctgggcatttacctaaattttcagatgcatgtagaggtaaataatatttataatgtcacatagattaggctctgaagcttttcatgtggattagaaattatttaattattcctaatagccatataaagaaggtagaattgtggtaataggcttgaagaacttagttctaagttcacagaactggttatgaattaaacctagttttgagcccaggcacaccgattagctgttacctttaaccacatttccactgcctcctgtgacacttgatctcatgcagagcctgtcacctgctgctggttgcttgatcagtcattggaagttagcctccttggagaatgtgtagatgcctgccctggagcccatgggacatggctgttcataatgggagtacttcagtcacatgatctggaacagagtaacagctgacttgttgggtgctccctcctgtggaaaaaaaagccatagaatcctagatagggatgcacgtcccagctggtgaggtttcaccttttctggataattgagaatcttacacgagaaaagaaattaagttttcattgattcatattactgaatgcatatataattcattggccttgtttcatcagtttatagcaatcccaagatttgattccatctaagttacattaatcacttgaaattggccacttgttcttcacttacatttaagttccccagtcttcattgttcttaagtatttaggcatagagaaaacaaatagcgtatgaatagttatgtatgttttctccaccactattccaaattccttgtttcttctgtagaacaggacagtgctaatataacttccaaacatagcctttggaacaacaggtatattttcacttgttaatgagcaaacggtttgaataaagaagagtattaaatgttaacaccattggggcaggggtgtgaaagataacgaggtctttataaagtagtataaaatgtggcttatatttttttctggaaagccaagaaaaagtggcaacagagagctgtgggcacaattcaaattatggggaaaatgtttggtgcttcatactaaaagttatttaagtattagtgtaaattgggaaagtttgttgttaactggattaaaggtgggtaccaataataaaatgagcaggcagtagttatcactttacctcagcaaatcaatcccagacacattgaccatttttagtaataatctgaggatggcgtatattgtgaaatttctgtcccttgaagtaggctagtccagaatattacagctaaaccaaagggaatgcgatcaggaatagctcatgagactaaatgttggcaaagataggttataggcagagagtcatcaattacaattggggcaggagatctggatgacttgaactgacccttaaatgctctggttcagtaagccgttgtggatctgcatgatcaatggggtattattggatgggctttactcaccaaatgtgttagcatctatcacatgtcaggcactcactaggcattgaggatacagtgatgaccaagaatgatgtggtttcttccctcacagagtttacatgaggaatgatgattataaacaaatacatgcagacctattttgtctttcgtccttgtgggatttggtataccgtatctcaaagacatgaaactttttgaaagtacatacagtggcaggcaaagttaattatagggacttaagaccttttgaaaatcaaggttaaaaagacctgtggatgagaagacaacagacaaaggataatgagggcttgttcacacattcaaatttctgggaatttatggacaatcatacagcatatatcaaaagagcatacttactgataagggtgaatttttttttagaaatgtagcactaccacccacacagatgtgagaggctagaaaacaaaaatgttccatgaatttggaatctttaagcttagaatgattgggcctaaatccctattctagagcaggtgttcccaacccctggccatggacccataccagtccgtggcctgttaggaaccagtgcacacagccagaggtgagcagcaggtgagccagcattattgcccaagctccacctcctgtccgattagctgcagcattagattctcatcagggcacaaaccctattttgaactgcacatgcaaggaatctagattgtgcagtttttatgagaatctaatgcatcccccaccatggtccatggaaaaattgtcttccacaaaaccagtccctggtaccaaaaaggttggggaccactgctctaggggattggccccacagaagacagcctattattgtgaacagtactgtgctgtatgcaccactggtctgttttaagaactttaaattttagtgaattaaaactggactaaaggtgggtacaaatgataaaatgagcaggcagttgttgaatcactatacctccgcaaattgatcccagacccattgaccatttttagtaataatctggaggatgggatatattgtgaaatttctgtcccttgcagtaggctagtccagcatattacagatactcttccctgtccacctaggggagagggaatgggaatactactacccatttgtctagaattttcctggaaatgaataaagcagttagcacctgacttgcttgaacttcagtgttctatgctgttcatgggaaagttaccgaggcagtttttgagtttctaaagggaggtgggtgagtgagcatgcatatacatttaattttattttccttttccaggtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggtaagtagacagccactccggacagtctttccctgtctctgactagcagattgtgaaatattctgtctttccatgtagcagtcttgcttctagaacatatcaaaggtatatgtgggccagaaaatgcaattttctgctggaattgttcataaatatgcatggataaaaatagattgtggagtatagtgagcgtgcttgagtcatttccaccctgaaggtgcaggattgaagcctgtttcatggcttgtaataaatttatagatgctataatcttcatttccaagccactgtgtgataaaagcccccatcctgcttatagagtactaataaacaacctttcttttgtcaaaaagcgaagtttaatgcagcggtatgcagctagttctccaagggaggattacactacatccacactggtaattgctgttcaggctgttttccaggttcatgctgtgctgtatgggcatatgtaagagtttgaaattttgaatgttaaaaatttattttattcctaatatcactgttagcccaactgaaatgggaagactaaaatgttcattaaaactcttgaatgtaagggagttgttctgccaaatcttagttaacaaagctatagcaatatagatttgattatgaattttaaaaataaaatacagatacaattttctattataaaagcaatacttggccaggcacagtggctcatgcctataatccaagcactttgggaggccaaggagggcggatcacctgaggctgggagttcaagaccagcgtgaccaacatagagaagccccatctctactaaaaatacaaaattagctgggtgtgatggcgcatgcctgtaatcccaggtactcaggaggctgaggcaggagaatcacttgaaccccagaggcggaggtcacggtgagctgagatcatgccattgcactccagcctgggcaatgggcaacaagagcaaaactccatttcaaaaaataagtaaaaaataaaatgaaagcaatacttgttctttaggaaacagttaaaaaatagagaaacattgtgaggaggaaatattagctgtagtaccatagactgaagcagccacatgaagatttgtgaggttgtttttgtttgtttttttaaggtagcttttctcctcactgtttgtttctctccccgccacccgtataataataataccttggaggcatgttgtatattacaatgtctaattcttttaaagcagtgacttcagaagaaaattgagccagatttttcattcatcaagtgaagatccatttagttgatctgaatctaatcagaggagcccatattacctgcctctgtgttgttaattggcttcataggaagcaccacctttagagttctgagtagagagagctagcactacatgcatgcctgggagaatagcctacagattttgctgtcatgagactatttagtcaagtgagagtatataaaatacagcctccttaattgtgttagttaattcataatacttatacattgccaccctgtgttgttatcacatagactaataatggtgttaaatagaaatccaggcctagaaataaagatgaatttgttcaaagcaacaaaaatattttttatttcatttgtgctttctaattcattcattctgagatcttgtgaattgagagtaggtttcacctatgacacaaagtgcgtctcatcttttacctgctagtccatcacaggtggacctagcttgttttagtcagcggttctcaagtatgtcccgcacctgcagtatcagcagtcttctggaaccctgctaaaaatgcaaattattgggcttcattcagaacctactgaataaatctctgagggtgagccacaggttgttcttaggtatgcttaagtaggaggaccaccgatttaggtgactctagctgtgtagaggctgttttttttttttttttttttttttttttttgctaatctgatgcttttctaatggaacagctaaattctagaggttattaattcttaataggcgctagtagataagtgaaaggatttgctatcatttcactatttattcttcatacttaaggctttcaaagtgaacttactcaatttacctgaaatgaaaaatgaaaccctgcaattttcttattcagccatcaggtggtaataatgtgcaatgcatgctctttaaatagaaaaggtaaagtgataggggctgtcttagatacgcatatgtggaaaaaatgctttgtctacattagaaaattcttagtcattgaccttacacagtattaattttaaagcaagtagaccttctttctttttttttttttaagctcctccaagtatgatggtccagtgctcatttacttgccaaaaaaaatttccctgccactgcttatctcatgatgaccagctgtggtcaccccactagcctgttcacgctaattaaatggaataagctgggtttccctctacaatttttcataacctggaaaggttcttggctatcctttcccatttgtgtctttcacactggggagaatgtggggcagggagtgatcttctgtagtcaggagtgatgctgctgaggtcagaaagctttgatgctttacttctagaaatttatttatttttaaaatctacgtcttttctttttctccatataatatttttctgtaataaaatatagctagtcagaagcacaagagagcttcagagaactggaagagcattttcaggcatttttttcctaaaggacctatatcctatgcaatattattaagctgaatatattatttaaaatttcaaccgaaatgtctttctaccacagtgtatgtatttttagcatagctttgtagcatttttagcaaattcttctttctgttctccttgtttcaaggacaggaactactgtgtccctcatttctgagctgcttatccaatagcacaaattgaaaaatggaactccggtacactattgacattaaaagagtgtacgggagggaggtgggagagagagaaaacatggacatgcttgtgttttcttgtcttagctgattggaatgcatgtgataatgggtactcagattatgtaagtgacacgaatttttctaaaaatgcaaaattgtgattctaaactgaatggctagtaagtaaaggggaaagtttcctcctggtgtgattttgtgggaaatgttatatgtaggtgaaaacatgttcttgagaaggaaaaattaatgtgtcctttcttctctccttcccttctccttctgttccctcttttccaaatctttactcaaatctaccataggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggtaagtctggtttggttcttgtgcccagctactaaactgaaagagaatactcaggtttactgtccagtacttttattgacaggatctctggtttgcttttgtcagtgttgttggttttattactattaatttttcatctccatgggcacagagagaatctacttgaggaatagtgtcttttgctaatattgaaggtggggaccaaaggacagtaacctacagcagtgattcttaaccaagggtgatttttgcctcccagggaacatttggcaatgtctagaggtattcatgttggcacaacctgtgggggtgctactagcatgtaatgctagaggtcggggatgctgctaagctcctacagtgtacagcatagccccagcaaccagaagttacctggtccaaagcaccaataatgctgtggttgagaaattctaatctgtagctttctggggttatctgaattgtttccagggcttcagatttccttttttttttttcttaaaggattttattctcatgtgtcaatttttaggtcaagctgtttctgttacttcactttatagtatgtgcaccattaagggtatataacctatgtgactacgtgaagtttctacaaatgagttcctctcttccttttcaaaattgtttacaaacaggttggcagactttctctgtacagtaccagatagtaaatatttaactttatgggttatggtcactgttgcatctgtcttgtttttgtttttaaacaacctgttaaaaatgtaaaagccattcttagcttatagcccatacagcaacaggtgggaggcagtctccatttggcctgtcggttgtaatttactgacctctctgtagttcatagaatgaccgtggctttagcccaaagaagacactctatctcactgacaggtgtacatatgctaactgtttaagttttattctgatcctgggataacaaaccaggagtcattcaaaaaatctctaatctgcatgtgagaagaacagtgactttaagaagttaagcagagcagagagtttttggtttcataagcaagtcatgcagtttttattttccaggacatttttaaatatcctttttggccatatggtacactatacccagaatgctatctaaccccacactgatttttaaaaattatttccaagtgcatatcaattttatttatttcattcatgggacagaatagttaattaccaaaaatataatcacaaatataacctaataagatcaggagttatgttttctagcttaaatctatgcatttatttttttcattggaatatttgcagtgctgaagagagtggagataaaatcagttaaaaatagctccttttaaaaaaatactaaattatgttgcttgagatatgagaaggaaatttgttatgaatgccacattaaatttcaacttaagttggcctttgccgtgggagaagaggtggtactgtcaaaagcattgagccttgtacttcatgctctgctgtgaggaaaaggcattggtattaaaaaaaaaaaaaaaaaaaaaaaaaaaaaaaaaaaaaaaaacctttgccacctttgacttcccatggtagtggtgatcagactagtgtgggagatgcgtggggctgcctgatgcttgcctttgtggagaaagaagtctcacaaagaaagccctttttcagctctgcacataggtttcctctgtgacatcttaagtgaataatatatgtataaatatacttttttaaattgcaaacgtaggatgaacaagcctgaaggaattttacaggtatttcctaggcagcttgtccagttaatttcagagctctttggggccttgaaaatgatctcgagtttagatagaacaaagttcttcataatgtattggttgatttttaacattgtgaagttataaaatgtttgctgttagtggaaagctatattagctactttttttttccagattgaagcaatgattttgtttgatagttattaagtaaaacaaagttcttggaatcaagattgaattcttaggaagattgagaagacaggatttgggagagtgcctgattattgaaatggcaaggcttgtaggtgactcaggtgctaggttgttgatgggtgtcagcccttaggtttacctagcctccatccctgcaggctctgtgctttttatttttggttgagtaaagctttacaggatgttcttatggtcaaatttaattatctttttctggcccattctgtgtttttatcttttagtaccatatgttatcattaacttgaaaattctttttccttcactcctatagaaagacattttggaagaagagaataagagattgtcagttgtaagggaaacttggtttcagaaaatgggagaaattgttattctctcttcagatttttaactgttgtcccattcaccccatttctcattcctcccatgatccctgtccagataataaaatatgaacgagttagtgtgctcagagatagtgtttgatctagattgggtgtgttggaagaaatcagatttcaggtttaacctgatgtttgatgcttttctttaatacagtatattgaacctggttgtcattatcttgatttccgccccactcccccttcttctttcacctgataaagaaacttgaattaagggcttgcttgttttgttggtattttgctgttttctgtagttcgagtctaaatcatcacacagatatattttgtccctgatatttgtgttttaatgctcttgccttgagtttttgtcacctttcagcagacatgtagaaaatttctcactgtatttttatgttctcatagtaccttgggagttgagagagattgagcaatataagttatatgtattatggtcaagaatacttttaataatcataaagtatgagccatatcttttatggtcaaaaagcttaaaaatccatgtaataagggttaagtttaaaggtgggtttgtgaggtttatggcttagtcaacctatgaataatcagagaattgttgtaatatgagcactgctggtctaatacgcttatttaattgactgcagttttcaaaataggacaagccttatttatttggatggatggtgtaattcaagccccttaagtatattcttgggacatgatatcagaattaaactttaagccaaattttttcatgttcttttctgtgaaacagctataattttattgaatatgatctagtgtaatgacctgtgtgcctgcttctatgagcctttatgcattttttaaaaagccttttaaatgagcacttgagttgcctttaaggcatgacgtactggttgcattatcacaatttccttttggaagaaaccggtatcaatccccttgaatacttttcctctttcttagaggacagatgataccatctaattgaataaggcagtaaggcagtaagaagatgatcttgttgtagataatttccaagcagttctcggttggcgctttggagagattttgataatcattatttgtgggattccgagtatattttcttacccatcaataacttatcttcctatttttatttctgactttaatcgggttcacatttccccttacttacatgtaggccttcccatagtccatcagctaatttttttagaaattaggcaggtactttatttttattttctacttatgaacacctagctttaaaataggaatgatctgatacatggttctgttcaaaattttgacaggttataattggagctttggtcctgttgatagaaaaatgtttatacacatctctctcctatgtgcctttttcataaattacatatgtacatgggcgtgtgctattcattaaattataaactctaatcaaacataaaaaaggataaagatgagacaatctgtattaaatgtcttgctaattactatactggttggcttcattttccatgtacctaatatcttaataaatgtcttttaaagcaagaccataaaataatttcagatatctcatctgacttcatgtgatgcatgttggattatcttgtgtctaaccttataatgtagcttgtactaagagtaggagaaataatcggctctccctttccttatttacttgtatttcccttactggtaccattctttactctgatttacatttgtagtaatctttttttaagttactttttctttaaatggaggtcattttaattaaagcaggttatccagtctaatcctccatatctgcttgctgtgttatttgtaaaatggattttgttcaggctaaagagcaggagagagtgccactcgccgcctctccccttcgatgattgctcagtcttcccccagggaggcaggtgatacacaggactgagaaggtactgggttcagtgcatctattaaatataagtaaaaaatactttattttaaatacatatttattttatattttattttaaatatatatttaatggatactttaatatttaccttccatatgtactacgttatcatccacacccctccctgagatattctggaggcagctagcttgctctccatttaaaaattgacttccatttataaatgaccataaataaaagatggctgggcgtggtggctcactcctgtaatcccagcactttgggaggccaaggcgggtggatcacgaggtcaggagatcgagaccatcatggctaaatggtgaaaccccgtctctactaaaaatacaaaaaaaattagccggacgtggtggttgggtgcctgtagtcccagctactcgagaggctggggccagagaatggtgtgaacccgggaggcagagtttgcagtgagccgagatcacgccactgcactccagcctgggtgacagagcgagacttcgtctcaaaaataaataaataaaataaaaagatgtccttgagcagtggacagacccagcagacatatttctaggggcttgttgtagtagtccttgtgtttgagctgctgcactattttctcttacaactgcctgtgttacagtttgccaactgctactggatttggagtgaatggtgcccatgtagagcacccgttgccttttctgagctcccatgggaaacatgaatctatggcaccgagaaagctaggaaatacttctgggctcagatgcatacagtcagggggcttcagcagtgcctgggcactgttttctaggttccatgcttctccctacactcgttggtgatggaggagaagaaagattagagtggataacttggcttagttccaaaggaccaatttttttctaaaatgagagagaagtgaaggaatcagtgaagatcatggtatcatgtaaaacttcacagatagggtaaaaaagatgccctatcataatttggagggtcctcggagatcctgttataaaaaattcgaaacctcctgtctggggatgccagagatggaagtgagggagatggaggatggaaaacgaaatgtttctccctcactgcatgtacagtcatgcatcacataacgtttcagttaatcacatgtacgaccgtggtaccataatatagtagactgcaaaaaattcctattgtctagtgatatcatagtcatcctaatattgtgcaatgcattaccttttctatgtttagatatggttaaatacacaatacttagcattgtgttagaattacctacagtattcagtacagtgacatgttatacaggtttgtagactgggagccatagcccataccatataactaggtgtgtggtaggctattaccatctaggtttgtataagtgcattctatgatcgtacaacaacgagatcacctagtgacacattttcagaacatatccccattgttaaaaaaggcctgacggtaattcacttcaggggcagatttggtttctaccctgtttgaaaattctgaaaactcatctgtctctgggcgtatgcttggtgtcctgagtgggtggtagcaaagcatgacctgtccctacatggatgcaattaatgggcatagatgatgtaacttttgagtgaattgataaggtgcctctgcattctgggtcttctagcactttggttggagacctcagtatgcggttctcttctacaggtagcatatgccaaatgcattctgtgttgatcattccagcaatttgataaaattgtattgttactttatgattggtggtgctaatatgtgtttgtctttattgctggtagttgtgatccttattcttgactataaaggcatggcatctttgactgtactcacctctgcaaaaaataaaaccccacatctttttacttatgtgcagacaaggtcatccaaccaatcctcttactagttttcattctggactaagttgaccataattttggtaacctcattgtctttatttggtcatcacatatttattataaactatcagtgaccctggcttgtgctcagtggtgcaatgagagggtggtgggtcaaggcacgcacacacacacacgcaccacgcacacagagacacactcacacacgaagatcttttgtcattgtgatctgttctgtttccttacactttgcataagctcagttcttctcatctttacaaaacagaattttcagtggagactgagggcagggatgtgggaggctatatatttccccattctgaaagaccagatgagatgtgttttggcttttacaaaactaaaaggtgttggcttttgcatgtatactttagcgtgacttgatgccacaggttaggtgataaggctgagacttttcaaacttacctttcacgggtgttaaagaaaaaattctcacccccacccccagtcccagagggacaaccctgggatgtctttggagagtgttgagcattgtagcagttgagggtggttgtggactatgtattaagttatgcctcctcctcagaacacataattagttggtaagcactgtggaaatttgggacattagagtggtgttttgaaactgataaagaagagtcaaatgctgtaaaactaatatttgatataggaaaaatgtagaaggttttaaagagtacttacacctccacccccacccctatttactttctataaacattttaagtgaggctcagattggcttgttttgtttcctacctggcctttgaaaactgagtaggacgacacttcctgtagcgtaatttgaatacagcatccagatcaggatctgaactcttggctttgttgcacactggagtgatggatttttcttttttccttctctagacctcagctgagcacatttgagaaatgggagggttagcttgggttgtccataaggttttttctacctgtaattatacctccttgattctaaaagatgaaagcccttcaaagttgggaaatgaaaggaaaatgtatagaattctgtaacctgcagagtttgagtatcaatgccataatttactagccctgtggtcttgagcaagccacttaaaccctgtgtgccttaggtatctgcaggcaccaacagagttgtgaaaatcaaaagtagtataaagaacatgtagctatacattgatcactttgaagctacctgatgagaaccctaaagttaactatcccagagctttcgcacttcctctctgaaaggtatcctcagatgaccgtcactgtgtcccatgtactgacccttgtagagagaaaccattcattggaagaactgtcctgtggcagtcggtgcccattagcttaaaaacgtaaaaagacccagcattctgagtcttcacatataatcagtgtacagatatcccctcggaagatggcagtaatgagcccaactttcttgaacatcaaggggaaaaattaaaaactgaagtttgctaaatgtgtgttttgcaggttggacaatctgctcaatatggcttatggagtaaagaggtaatgatagaggttcatgatactcataatccctttccacagttgattggtttctttgattttgggagtgctattcacacccctcataagtttttgttgggttttattttgcatgtgcaacctaatgaaaagctgctctttgaagcacaattgactcaagaaatttttataccaccggatgccacctggtcttttaaaaacccatcatttgtttcgtattgcgttacgacgttacagcatgtttacgtatgtgttgatcccttcccctgccaatcctgcttaattcatgaagccagttctaaatatatttctttgctattgtggatgatattcagtacagtgaataatggtcatttcataacttattaatatctcagtagtctagcatgtcactgcaaagccacacacagaccttggtcaaaacatgaaatagtttatatatttgttgggggaggagagttactaaaattcttggggatggaaaaggtatacgttcattgctataaccaacctctgtttttattttttgtgtgtatgtgtgtatttcctattctgtttagcaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttcgtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaagaacagtgtggtgagtaggtctttatacacaattcgggggcacctgtgctcagtctaataagcagacttgctttcttgaattaaaagaagttccctgagagttttagtggaaagcagtgttacctcttagaattccaaaaggcaagttaattgaagtagaacgtgcagaaaatttttggactgaatgacaccttctgattagttttcaaatactgctaaatgagtaattctcacaggagaacatactctcatctgctagttgtaaagtttgggaaatcggatatcgacaccattttatggctgggattcaaccttcagctttttgcacagataatcacccttacacgtcagttaaaaaccaaacaggaggaaagtagcttactcggcttccactggcaatctttaattccctcatgggattaagtgttgctgtgtgaaagttacttttttgcacaaatgctagattgtcaagagattgttccctaaaatcagaaattcagtttctgttaagttagtgttgttgtgtgtcacacacgttacaaaccatgaactctgccaaccccgtatttcgcatagaagttcagttcttgtatacacccttaacagatctgtgaaggttaaaaggatttcctgctgatcttttgtgaaaggattctacttctatagaacttcagacaaatgagtataataatgaaacactttttttttaaacaaagtatactaaatgacttattttaattttattgtatctgtcggcttttttggtaaaagccattctaaaagtaattgtcttgaattcacaacctactagtcaagagcgtagttgagtgacaagacacttccttttttcaacatgcaattagtcttaaatctccatactccctcttcttattatatgaatttaatactctaattttgtgatgttggaacatcctcccctcacctctctcctcttgcatgttttatcggtattttgattggtttgcatgtcagcagttcttttataattgagcagatagtggaaaaattctcagcaaaggaagttggtatagtaactactggtatatttgaggagaaatttcgtctttctcccttttttttttttttttttaacctgtgcttggaaattatctgaacaatattgaaattcagttttagagcggcctacgtgaaattcttaatgttaacatcattttacattattataatctgagaaaaaaatgttagcaatttaaccattctgtttttttaagataaacagattgcaagatttctactttttataagaggtttacaaatgaattgtagtgga

SEQ ID NO: 15301 - DNA, 33624 bp, Human
acccctcctaatactcgttttgagacatgccaccaaaaccgtccacttgtaaaaatgagtcaggctggagtgtgccagcgtgtcagctcctcatcccagaagtagggtggtttccacccccacataaggaggaagtgagatcaggtaggctatgtgacttctcacagacccagcatgtggctgcatatgaagttgcgaagagacagcaggtggaactctatgaaaccccgtccttgtaggtcaaggatggttgaataatagggaccattgcgtagggttccattctacagagtaacttcccagcaatgatcatgcagtgcctcagaaactgcttcctgccctcttggtcttgtcttgtcttttcttttttgagacggagtctcactctgccgcccaggctggagtgcagcggcacagtctcggctcactgcaagctccgtctcccgggttcaagcgattctcctatctcagcctcccaagtagctgggattacaggtgcacgccaccacatccagctaatttttgtatttttagtacagacggggttttgccatgttggccaggctagtctcaaacacctgacctcaggtgatcagcccacctcagcctcccaaagcgctgggattacaggcgtgagccaccgtgcccagcccgtcttttctatgtttttaaaccaagcattgcttgaaaataatcctttttttacttttttttttgcttattttttttctttttatcttatgtttattattattattactataatttttgagacagagtctctctccgttgctgaggctggagtacaatgctgcgatcttgcctcactgtaacctccgactccggggttcaagcaattttcttgcctcagcctcccgagtagctgggattacaggcatgtgacaccatgcctggctaatttttctatttttagcagagacagggtttcaccatgttggccaggctagtctcgagctcttgggttcaagtgatcggcccacctcgtcctcccaaagtgctggaattacaggcatgagccactgcgcctggcctttttacttcttttgtttgtttgtttatttactttaagaaatgttttcttttttatttttatcttatctttattatttcttatttacttcatttaccactcaacaaataacttctttaaaacatttttttttgaggcagggtcttgctctgtcactcaggctggagtgaaactgcagcttcaacctcccaggctcaaacaatctttccacctcagcctcctgagtagctggcagtagagacacatgccaccatgcctggctaattgttttattatttatagagacagggtcttgctatgatgcccgggctggtctcgaagtcctgggctcaagcgatcttcctgcctcaacctccccaagtgctaggattatgggcataagccacactgcccagcctaatattttttatttttgaagagacagcatctcactttgctgcccaggctgctctgaaactcctggcctcaagcaatcttcctgcctcgtcctcccaaagcgctgggattacaggcatgagccaccatgccaggttggatatgatcatattatagccagcaccctgtgtaacagcacaggcaatcacttaaaaacctaaggacactggcagaatacggtgactcacatctgtaatcccagcacttcgggaggccaaggagggcagatcactggagctcaggactttgagaccagcctaggccacatggcaaaaccccgtctctacaaaaaataaaacaaaataaaaacctaaggaaactgaccactggtttggtagacgtgggcgtggctttgagattcccccatgctgcgatgtggggggagtctgctctgtctgtcctaactctctctgatcttctgacttgggaaaaacaaactcgaagttaatcattcccagctcaaagccttgtgcaagtgctctctgccttcacgcttgcttcctttgggagagaaccttcctcttcttgatcggggattcaggaaggagcccaggagcagaggtgagtcctgtgaatgttcatttgtgctggatttgggctccgtgaccaggcatgaatagcgtggtgaacaaagagctccccgttcccttttctgtctctgaataattgcccagtttgttttgataaagcagaaacgtacccgtgacttacaggcctaggaatgcagctctttcctggagaagggggatctgttttctaatctgcaggagaggccttgggcaggccccatgctctgggtcacctcaatgtcacagtttccaaaattaaactcattcaaggctgttatcaccatctctttatttatttaacgtttttctccaagaaaaaatattcatatttttacttataaatacataacattgcgggagaaagaaaaattaggtcgggcacggtggctcacgtctgtaatcccagcactttgggaggtcgaggcgggtggattgcttgagcccaggagtttgagaccagcctgagcaaaagaggaaaccccccctctacttaaaaaaaaaaaaatcaatagccaggcatagtggcatgtgcctgtagtttcagctacttgggaggctgaggtaggaggatcgcttgagcccaagaatttgaggctgcagtgaactatggtcgcaccattgctctccagcctgggtgaaacagccagaccctatctcaaaaaaaaaaaaaaaaaaaaaaaaaggaaaagaaaagaaaaattagaaaaagagcacttttcctaaatctccacacccagagataaaccactgctgggcaggattgctgcaaaaaccatcttcccctagtttgtggtggtttggggttttctcattacatttgtacagtattttgcttttattccgttttctgaccattggcagcatgtcattgtaggtcagaaagcaatgctgagggtattaaaatgctcattttggttttctctccatgtacaattttaaatcaatctctttcccggtgaagatgctattaggttggtgaaacgtaattgcgtcttttgctattacttttagaatatgagaattgtgtgtgctctctagggtaaaacaaacgaacaaataaacaaaaaaacctcacgagcacggcgtacaccttatcccttccttctgtgttctaaacaaagcacaaatgatatctaaggtctttttctcttcgacagacagaaaattattggagatgtagcaattcagtgttagacatccatcaataatgtaagaagtgcattgattcggtctggaaaggccggaaaacttgaagcaaaggcaggaagactgtaagcagggagggggcttccaggtcacagataggtgagagaggaacagttgccttcttttgagtttctgatgagcctttccaaaggaggcaatcagatacgcatctatctcagtgagcaaaggggggactttgactagaatgggaggcagaggccctaagcagttccccgcttgacttttccctttagcttattgacttgcgggccttgagatttattttcctttcacaaagctcattgtctttctcagaagactggttttgtgcctgaatcctgctaggagcaaacacccctcccagcatccccgaaaaggcgttgaggggaaatccctcaaccaatcgcttctctcccactcacaccctggggtttcgcagccctgcggaccttgcccacccctcctctctgccctccccgctcccacaccagctgtgtctatccttggtcaggtttcacctggacagacaccacggccacttctaggctctcagtgcctgctggctccagtgtgtcctcactcactggccgctcggcccttctaaaagtggccaggtcactcccctggttactcagaggcagaaacccaacacatctgcatgctcctgtctctttatcttctatgcatgcccatgtcctgtcaacgaaaagaagcgaactctgtagaatatttgaagagatttattctgagccaaataagagtgaccatggcccatgacacagccctcaggaggacccaagaacgtgtgcccaaggtggtcagggtgcagcttgttttatacattttagggaggcatgaggtgtcaatcaaatacatttaagatacacattggtttggtccagaaaggtggaacaactcaaagtcagggggcttccagcttatacatagatttaaacatttcctggttgacaattggttgagttcatctaaagacctgggatcctaggaggctgaggcaggagaatcacttgaacccgggaggcggagcttgcagtgagccaagatcgcgccattgcactccagcctgggcaacagagcaagactccgtctcaaaaaaataaaaaagaaagattaaaaaaaaaaaaaaaaaaccctgggatccctagaaaagaaatcttcaggttaagagaaaagattgtggagaccaaggttattttgaagtcttgtagcggctgcccttagagacaatagatgacaattgtttcctattcagacttttaaaaggtgctagagtcttagtcaatcttttcaggattggaagggtccggtagaaaaagatgtgaatatctatgtgaatagagattctttacatctttacagatgcaaatttttccccacaaaggacagctttgcagggccatttcaagatatggcaaagaaacatgtttttgggtaaaatattttgattttcttattggtctcatgttatgccagagtcagattggaaagtaagtcacaatatatagttaaatgaaacccttctgatgagaatttttggtttgtagggcatgactctccagaccccttagataggaatttgggcaagataaaaagaaaaatcagagcttcgtcctcagtcccatgcacaagccacatggggtcagaccactgcagtaccctgaaggtgacctcttgctgcctgcaactctaattgttatcttccatctcattcctttcctgctctacaccctgggctctccctcacttctcggcgagactgaggggccgcccctctgtgctttgggggtcgcccgtttccctctgtggacagaacatttccaagtgtgggcaatggtcgccccctctcccggcagcacctacccctagcaatgaaggcgaatgcgtctctccttcatgcagcactcagtgcctgcagagtcctctaggcctttttccttcacactgacactcccagttctgttttcaagtctggacctcctgggctcaagcaaatcctcccacttccgcctcccaaagtgctgggattccaggcatgagccaccacgcgcagcctctcattgtatttctgatcttcataccctctactcagattcttttgtgtatcatccaagctttgatctttccccgcttcccccttccaaatcaggactctctctctgcatttctggacattaggaatcacccctgccctgggctcgggaagcagaagacaaaataatctgcttccggacactgggattctctcatcactttgtgatcactcatgggctatgaaagctgataaaggggatggagaccctatgaccactttcttcctctttctctgaagaccatctggctgtgtattgaaacacgttttacattcttaacatagtattaaacatttttgaagccttttcactcgggaagagcattcctttatagattttgatcattgttttaagatatttttgctattgatatcatgaacgggaatcaaagttcccctaattacttacttactgttttatttataatcaggtcaatttctgctgtcaatgtgattgtggacatctttatgtcttacaggaagtagagagagagacaacatgttacatctgcaccattcttggtaagatacaattatatgcactcattagtagtctcctttctttctttctttctttctcttccttccttcccttctttctcttcttttttttttttttttttttttttttgagacggagtctcgctctgtcgcccaggctggagtgcagtggcgcgatctcggctcactgcaagctccgcctcccaggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcttttctttctttctttctctttctttctttctttctttctttctctctctctttcttccttccttcccttctttattttttttcctttcttatatagagacagggtctcaccatgttgctcaagctggtcttaaacacctgggctcaggcgatgctcccaccttggcctcccaacgtgctcagataatgggtatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcaggtgggcatcaaccgctaccatcggccaggtgtctggttttccagggaaaatcagggtttcccctactacaaaccttggagactcagattacatctttactgcatcccactggggattgggacactatggccctgctgtccatgtgcattcccagggtggcatcgatgaaagaggcagcaatgatagtggcaggctgtatgtcaccaacccctgcggaaatgttccctcatggtacgcaactaccagggctttctcctccaggctggaacctccttcacctccaaacccacttctcatcagataccagtgggctaaagaagtcagtcctgggtattttcatctgtgtgctacaatgaacagagggttttcatagactcagaagtagcagctcactgtgttctcaccttgccccaagcttgtgtctcttccttgctctgctgggtggtccaaaccctaaccccagcctccattccctatgttcaacacagtttgcttaaggaagaacaatgaagaagagggaatggagaaggggcaatagctgttctggggacccgatccatccaagaaaccatgactaaggcaggctttctggctgtttttgctttttcttgttgctgttgtagttttgagacagccttgctctgttgccctgcagtggtgcgatctcagctcgctgcagcctcaacctcccaggctcaagcgatcctcccacctcagccttcccaggagttgggactacaggcacgtgccaccacgcccagctaagctgtgtatttcttgtagagatgagttttcaccatgttgcgcaggctggtcttgaactcctgtggtaaagcaatccacccgctgcagcctcacaaaatactgagattacaggagagagccactgcaccccaccaaggctttctgttaatcatgagtttaatcacttaacaacagactttacagcatcaaaaaaaacccaaaaaacttcaaggccaaataaagccatcaacggtatcagttaattgtaaccagagaaaaacaatcaaatgcctaagagatgtcctcaaagctattctgaaatgtgatgataatatcaatacctcttaaaatagtgatgccaacttcccccatacacaagttctgcaaatgagatggacaggagcatgacgcagtctctgacagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggcaagggacagagaattactcacctggtgcccccaatgcagacaccagaagaaagagaagccactgaaaatgcatataacccttgatcttggcagttcacacttcaagagttctgcacttctgcgttttctaactctccctaatgttactttcttcccatgccagcactaacctcacctcaatccatcctacatatgactgctcatttcatttttatttttatttatttatttttattttttatttttctctgagacaaagtcttgctctgtggtccaggctggactgcactggtacaatcacagctcactgcagccttgacctcccaggttcaagtgatcctcctgcctcagcctcccgagtaattctgggactgcaggtgcccaccatcatgcttgggtaatttgtaagtttcttgtagaggtggggttttgccgtgttgcccagcctcgtctcgaacttctgggctcaagtgatccacacacctcagcctcccaaagtgctggtattgcagatgtaaaccaccatacctggcctcatttcttttctttttttttttttttttgagacagaatctcactgtgttgcccaggctggagtgcagtggtgcgatctcggctcactgcaacctccgcctctgcgattccagtgattctcctgccttactctccagagtagctgggattacaggcgcccgccaccatgcctggataatttttctatttttagtagagacagggttttgccatattggccaggctggtctcgaactcctggcctcaagtgattcacccgcttcagcctcccaaagtgctgggactacaggtgtgagccactgtgcctggcctcatttcattttttaaatatgatttttatccacccagtacataatggacaatgctttagaaatgctatcagccgggcatgactgtaataccagccctttgggaggctgaggcaggaggatcacttaaggccaggagttcaagaccagcctgggaaacatagtgaaatcctgtctctagaaaatataaacattaattttttttttttgagacggagtctcgctctgtcacccaggctggagtgcagtggcatgatcttggctcactgccagctccgtctcccgggtccacgccattctcctgcctcagcctcccaagtagcttggactacaggcgcccaccaccacaccccgctaattttttgtatttttaatagagacggggtttcatcatgttagccaggatggtctcaatctcctgacctcgtgatctgcctgcctcagcctcccaaagtgctgagattacaggcgtgagccaccacgcctggcacattaatttttaaattaaaaaaaaaattagccaggcatgatggcatgcacctgtaatcctagttattcaagagggtgaggtgtgggaggatcacttgagcccaggagtttaaggttgcagtgagctgtgatcagaccactgcactctgggcgacagagaccctgtttcaaaaagtaggctggccgtggtggctcacgcctgtaatcccagcactttgggaggccaaggcaggctgatcacttggaggtcaggagttcgagaccagcctggccaacatggtgaaacccccgtctctactaaaaatacaaaaattagctgggcatggtggcgggcacctgtaatcccagctacttgggaggctgaggcaggagaatcacttgaacccgggagggggaggttgtagtgagactcaaatagtgccactgcactccagcctgggtgacagagtgagactcagtctcaaaatacaaacaaataaacaaacatacaggagaaatcagtgtcgttgcctgtaagcagaagaccaatattgatctctgtctcactcccaaccctatccatctagccaagcccagcacttatgcgggatttcaatcctcccctgctgaaaagctctgcttcagacagacaagtccacaccctcctaatgccaaaatatggcgtgtccatctgtcaagagctagagctagtccgtcctcctgtccgaattccagccttccaccctcatgtagtacttacagtgtgttggcgtccatgaagtcaaaccttcccatgaacactgtgagctccagagaaggtgccctgggctctcagttctgcattccctctgaggtcggtctctcagtaccaacagtgccttgtggaaacttagtcactctatctactcattcatttatttattttagagacaggttgtctctctgtcacccaggttgaagtgcagtgttgcaatcacagctcactgcagcttcaaactcctgagctcaagcaatcctccttcctcagtctcccaagtagctggttctacagacatgcaccaccaatcctggctaatttttctatttttgtagatttttttgtagagacagggtctcgccatgttggcccggctggtcttgaactcctggccctaaactatcctcccgctgtggctttccaaagtgctgggattacaggcatgagccaccgcgtccagccactcattcctatttaaatgagttgatgtttcctcgaaagttcagaagacattagaaatctttgacattacctttgggtcattcctgagaacatcttgaagcactcagcgatgaccagcagaccttctatgaagtagcatgtagctatgcttatgaaaagcctgtctaattttaacaagtaaagctgttaatttgtccctccataggactccgaatattgaccgccttgcagaggacggcgtgaagctgacccaacacatctctgccgcatctttgtgcaccccaagcagagccgccttcctcacgggcagataccctgtgcgatcaggtcagtctctctttacaactgcactagggtgcagcctggtgtattcgtcacagtttctagttcttacattttggtttttttattttttatttaaatagagactggggggtgttctctctatcttgcccatgctggtcttgaaatgctgggctcaaaagatccccgctccttgacctcccagagtgctgggattacaggcatgagccaccgtgcccaggcagcttttatattctgatgctttgacatcttagggctttgctgaccttggcaggactggccctcccagggctagccaattcttagagatagcaaacaagtcacctgggagtgcacctttcatgcataaaccaaacagtccagagcccacacccccaaccatcacttttatgagattttcatatatggggctactctctccttgccctaatccccccagaatcaggtaccagctttctagggacagcccctgcagatgaaagcccacggaaattgtacaacctggccagtcttaagccggcttaccctaccttgcccattactttccaaaaaagaaaaacaataaataagaaaggctttttccatgctttcccctcactccctctgcctcctgaccaaccctggagcttccccatatagtcacacagcatggctcacccctgcgtcctcttgaactgtgagtaataaactatcagaaactgtgagtaataaactatctctccaatgacagtcatctcctgatctgttggccttgccatagctgaatgataaaaccttaataataataatacataacacctacattttaaagcacttgggtagaggctgggcacggtggctcatgcctataatcccagcactttgagaggctgaggcaggcagatcacctgaggtcaggagttcaagaccagcctgaccaacatggggaaactccgtctctactgaaaatacaaaaattagctgggcgtgatgatgagtgcctgtaatcccagctacttggaaggctgaggcagtataattgcttgaacccgggaggcggagattgcagtgagccgagatggcgccactgcactccagcctgggtgacagagcaagactctgtcccaaaacaaacaaacaaacaaaaaaacccttgggtagagatttggaatgtctggagagcagaataaaattttatcagtggctaccaaccttgtcagtacgttagaatcatccagaggatattcccaccatcccaaagcccaagttccacccaagaccaatgaaaattagcacccctggggtgataaccaggcgtcagaatattttgaagctccccacacgattccaatgggcagacaactttgagaacctttagattatatcaagagtttgatgaaattataaaatcatttttagttcaggcacaatggctcatgtttctaatcccaacactttaggaggctgaggtgggaggatttacttgagtctaggagttcaagaccagcctgggcaacatagtgagaccccgtctctgccaaaaaattaaaaatattagctaggcatggtgatgagcccctatagtcccagctacttgagagactgaagtgggaggatcagttgagcccaggagttcaaggctgcagtgatctatagtcatgccactgcactcaagcctgggtgacagagtgagaccctgtctctgcaaaaaatttaaaaattagccaggtgtggtggtgcacacctgtagtcccagctactcaggtagctgaggtgggaggatcgtttgagcccaggtggttgagactgcagtggacattgattacaccactgcattccagcctggacgacagaacaagaccccatctttaaataaattaattaacaaacaaaaaaccatttaaatttttagtcctttttcactgaattatattgcttataacctgcacataacaggaaagtccatcttctcgctaaggttttcaataaattaatcatttactttgttgccaaaaatgcaatccactaggcaaagtcatataggaagtccattttcaatttaattttaagtaagagagatttttaccaagtgttctatttttgaataaataataaataacaaacaggaaaaaaaatgtggaacagtaattctttctcttaataattgctcaaagggatggtttccagcattggttaccgtgttcttcagtggaccggagcatctggaggtcttccaacaaatgagacaacttttgcaaaaatactgaaagagaaaggctatgccactggactcattggtatgtacgtttttaaaagtggtaagcacatgacttttatatggaagggacattcagctaaagagtttggaaaggaaagtgggtgaggtgctgtgggatttcccactagacagaaagctgcatgtatctaggaaccatgttcctttccaggttgttttctgcaaagtagatagtcaagaaataccagctcaggcaaggtggctcatgcctataatcccagtactttgagaggccgaggcggaaggattgcttgagcccagaagtttgaaacccgcctgggcaacatagcaagaccccacgtctacaaaaaaatacataaaaataaattaaaaaataaataaaatgtgctcatgcctatggcatatgttccaagctccattgcacaacacataattgcttctttgttctgtgggatcctctcccacccttcacatggactttttgtcttagacatgaatgtcttagactgaacaccttcagctcttttctggttggtttatggatcaacttggctagtttagtgctgccatctaaatgtttgtgtccccctaaaattcctatgttgaaacccttaccccccaggtgatggtggcaggaggtgaagcctttgggaagtgatgaggtcgtgaaggtggagcctcatgtgtgggattagtgcccttacaaaagtgactctggtcaggcgcggtggctcatgcctgtaatcccagcactttgggaggccaaggtgggtggatcgcttgaggccaggactttgagaccagcctgggcagcatggcgaaaccctgtctctacgaaaaagaaaaagaaagaaagaaaaggaacatcaacttaatgaaatatttggcatctcaaacaatgttctcgtagaccatgataaaaaaaaataagaaaaaatatattcttgcatcaaaaatttctgtaatgctacctatttttccccttggtgtgtatgaaaatgtctttactagatttagtacctccctgtcagcttccataactaacatggttatttttctacaagtcaacaaacatgtcatgtattggatgaaaaataaaattaatgacaacagttccttgagaggagaccaagttgccattatcattattgtgttatagtaatgattgttatcaacagttccatttattgataacaaacaacatgactagtggatacaatgagtataaaattcaataaactatatttctaaaaattaaaaattataaaatgttctttgtttaattttttaccaaaaaaaaaaaaaaaacaaattctggggagattcagtcatcgctgtcaaacaaaggtgtattttttccaatagacttttttttttttttaaacagggtactcactctgttactcaggctagagggcaatggtgcagtcacagctcactgcagtctcgacctcccagactcaagtgatcctcccaccttagtctcccaagcagttggtactacaggcttgcaccaccatgcccggttaattttttcttttttttctttttttttttttttttttttgtagagatggggtcttcccatgctacccaggctggtctccagcaatcctgggcacaaggaatcctctcacctcggcctcccaaagtgctgggattatagttgtgaaccaccatgcctggccaactataatttttctaagacagaagagtctatccttaagggatatccattgggaaatcatgaggttttccagatggcagacagcattggggtggttgacatctctttgtcaacaccatagtagtggctacatggaagcaaagactatattcctttgactgaatttgaaaggtgtgccttgcaaaacccaccacccacttcaaccatggccactatgatagtggtttctcaaagagagaacaattccaaagtccagaagtcttttgcccatgctgctgatatcacatggtgctttccggccttcatcattgcactgcaaaacaaggtgcaatagactaaataatggtcccagagatgtcaggccctaacctctgaatctagcaaatattagcttatatgcaaaaagagtctttgtaaatgtgattaagtgaacaatcttgaggtgagaagatgatcctgaattatccagctgggcccactgtgcaaggacaaggcttcgtttaacatggaggtagaggaagattgggccacagagaggagaaagcagtgtgattaaagtgaggcgaccacaagccaagggatagctggagccaccaggagctgggagaggcaggaaggatcctcccctagagcctctggagagagtatgtgtgtgtctgtgtcctactatcctcttcttataggacacaagttctatcagattaaggcctgtattagtctgttctcacgctgctaataaagacatacccaagactgggtaatttataaagaaaagaggtttaatggacttccagtttcacatggctggggaggcctcacaatcatggtggaaggcaaaggagaagcaaaggcatgtctttcatggcggcaggcaagagggcatgtgcaggggaactcccatttataaaaccatcagatcttgtgagactcattcactaccatgagaacagtgtaggggaaaccacctccatgattcaattacctccacctggctccactcttgacacatagggattattacaattcaaggtgagatttgcatgaggacacagccaaaccatatcagtgcccaaactaatgacctcattttacattaattatcctttgaacaccctgtctccaaacacagtcacattctgaggtcctgggtgttagggcttcaactcatgaatttgaggcaggccaggatccagctcacaatagagtcattgcagatataatcaagtaaagatgaggtctctacagtgggccctactgcgatgactgctgtccttatgagacaagagattaggtcgcagacacacacagaggacaacgccatggaaacatggagatggagactggagtgatgcggccacaagcccagggaggcctggagccctcaggagctgggagaggcaggaaggatcctcccctagagcctccaatttgagtgtggcctggagacactttgatctcagactcctggtctctaggactgggagaggatagatttctgttgtattaagtgaacagttttacagtaatttgttccacctgtcacgggtaactaatattttggttaaagctgacacatggggtcctcattcccctgaaacgatgaggccagattgtggtgcaaataacagctaatgctgcccacacttctttgcaatctcctggccccccagtgtctaacagagtatcaggaatgtgacaaacagtcaatatcgacatgtccagttatgctcagatgcttgtcacatcaacatcctttttgcctctcaggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggtcagcagaaaagggtcagcttcctccaagcactcagctttggaatgaaaacgcatcctaaatagtcttcttcagtcaggcatggtggctcattcctgtaatcccagtgcttttggaggctgaggtgggaggatcgcctgaggtcaggagttcgagaccagcctggccaacatggtgaaaccccgtctctactaaaaatacaaaaattagcccaatgtggggctttacaggtgcatgcctgtaatcccagctactcgggaggctgaggtgggagaatcccttgaacctgggaggtggaggtttcagggaggtgaggtcacatcactgcactccagcctgggtgacacagggagaacctgtctcaaaaaaaaaaagtcgttttctttaattgacgtttgaagaatgggatagccatgacctagaaggacaattttttggtaagaatggggcatagatgagggtcagtggagccctgtgacttgccttgtgtccattaaaacattgttacagctgagctgggcatagtggtacacacctgttatcccagctactcgggagactgaggcaagaggataatttgaggccaggagttagagaccagcctggacaacacagcaagaccccatttccacaaaaattttaaaaattagctggctgtggtggcatggacttgtaggcccagctacttgggaggctgaggcaggaggatcacttgagcccaggaggttgaggctatgtagtgaggctatgaagggagcctgggcgacagagcaaggccttgtctcaaaaagaaattgttacaggtcagctggaatttgctactactctggggtcagtcttattccattagcatcctcggatcaccacagacactatttaagtaacctgcatcacctgaagggctttataatcaattataaacttaaaaaaaagtctatcttcagaagtcagatgtcttttggcagaattcagcctgcggtcaattttatggcaaggaaaattcctgtgtgggaccaggagaaatgggatgaaactagttctcagtactacacagctattttcatgctccccaagggcattctagtaaagatggtaacaccatcaaaagtcaccttacctggtgacaatgaggttgtcatcatctcctacaacattcttagataatttttttctttttttttttgagacagagtctcgagctatggcccaggccggactgcagtggtgcaatcttggctcactgcgacctccgctcctgagttcaagcaattcctgtacctcagcctcccaagtagctgggattacaggcatgcaccaccatgctcagataacttttatatttttaatagagatgggttttgccatgttggccaggctggtcttgaactcctgacctcaagtgatctacccgcctcggcttcccaaagtgctgggattacaggcgtgagccactgcatccagcctcttagagagttcttcatggcaatacctaatgtatgacagaaaggacattgacaattagcttgcaaattaaagcagggtaagactgttgtgttctttttgattttaaatgtgacaggatctggctatgttgcccaggctggtctcgaactcctgggctcaagtgatcctcctgcctcagcctcccaaagtgctgagattacaggcatgagacaccatgcccagcctgacgtgttctaattaaggctaacaccttcaccattgctcttaggcttcaaggatctagattagaccatgaaggccgggtgaagggagggagaagctaaaacactgctttcaaggaggacaatggaaataatatgaataacccaatatgcctcatttgtaaagtgtgttttttataactattttatgtcctaatcctcactacgtgatagcaattataaagaaaatggaatgtgtggcaccacttattctataagctaaagcttgaggttaaaaatagatattgaaataattgaacaaaataaaagtcatgtcagtaacctacagttcttttaactttgcattaagcagtagagttagaaaattataatattcgggggggaaaagatgcattagatcagtgtgggtttttatttatttatttatttattttgagacaggatttcaatccggttgtccaggctgaagtgcagtggcgcaatctcagctcaccgcaacctcctcctcccagggtcaagcaatcctcccaccccaccctcctgagcagttgggagtacaggtgcatgtcaccacatcccgctaatttttgtatttttagtagagatggggtcttgctatgtttcccatgctggtcttgaactcctaggctgaagcaatgctcctgcctcagcctcccaaaatgctgggattgcaggtgtgagccaccacgcctggcccagtgtggatttttaaatagatttcagaagggaagggaaaagtcatgatgttaaagagtcttaaacaagacgtgtgttgtggtgcatgcctgtgatcccagctacttgggaggctgaggcaggagaattgcttgaacctgggaggcagaggttgcagtgagctgagatcgtgccactgcacccccgcctgggcgacagagccacaatccgtctcaaaatgaaaaacagagagaggtaacagaccagaaaggcatggtggctcacgcctgtaatcccaacactttggaaggccgagatgggcaggggcaggtcacttgagccgaggagttcaagaccagcctagtaaacatagtgagaccctgtctctacaaaaaaaaaaaaaaaaaaaaaaaaaattagctgggcctgttagcacatgcctgtggccccagctacttgggaggctgaggtgggaggatcacttgagcctgggagattgaggctgcagtgagctgagatcatgtcactgcactccagcctgggtaacagagcaaggccctgtctttaaaatagccaaaaaaaaaaaaaaaggaagattgttaaatataagaattaattttccgttgaagaagagttttgagtgtttctttttggtgagcagagttgagaagacatttgagtaatgatgtgacaagtgagatccgtatttagtatctacaggacttcaatctctgttttaccaaaaaagtcaccttaattgcttcgtatttatttttaggaataagcatgggcctttcctcctctttgtttcctttctacacgttcacatccctcttatcactatggagaacttcctcgggaagagtctccacgggctgtatggggacaacgtagaggagatggactggatggtaggtaagtgcacttccagggaaaatgggctgcttcccttccagcaatagaagcaggaaaggaaacaaagaatgagaaggttaaagacagaagatgcagaatagcgattgcagtgcgattggattttaagagtgcaaaatattatagcacagatcttcactgcattagcagagggtgaattccataacacatgcacgggaggcaatgcgattcggccaaagatgtccacatcttaatcccatgtggcagaaagctgtccactccctagacagaataatggctgcagagacatccacgtcctaatcttgatgtggtagacataaaaatggccccaaagatagccactttctaatccccatgtgggagacagaataatggccccaaagatgtccacatcctaatccccatgtgctagacagaataatgactccaaagatgtccacgtcttaatccccatgtgttagagagaataatgacctcagagatttccacgtctgaattcccaagtggcatacagaattttggccccaaagatgtctacgtcctattgccatgtggtagacaaacaaaagaaagagcagataaaattcctctccgctgtagagtggctagtggctccactgcactgaaaataggactaaatttcctcctatcacctacaaaagccccatgacctgctgctgcccagatcctagtctgacctctacccaacccccttgtcctccccacctgctgcattctggccacgtggacgccacacagtatctttcacatttgtcccctgtcagggcttccacacctgctgttccctcctggaatgcttcctcaggcttcactggctcctcttcagagcctgccctgacgcacccctaaagtagctcctccccaatcatcttctcccccattctcctgtggtccttttttgttttgcctttgttttcctcctcctcttcctcctttctcctcctccccctcttcttcttcttcttcttcttattcttcttcttcatattcctcctcctcctcctccttcttcttcctcttccacttcttcctcttcttcttctttcttctttctgtcttctttcttctttttttcctaacacagcatcaccattgcttctcttcgtgaccatgtgttaggtaggttgattttccatttcccccaggggaatataaactcctgtggggccggattgtcttgcctcattccctcattatatttcctgggtttagaacaggatggaaggggaatattgcttgagtgagtcagggctgggtgagcacctgtatatgggcacagcacatccctgcctcccagaaaagaacttaggaaccgcagggtttaggtggtggtgggctgcgaatcccaggatcctcagaataattgccatcagagatttgggtgaacgacgtatttaaaaaaaaaaaattgtttcctcaacaagctaggcatggaaggagaaaaagttaattgtgtgtgtgtgtgtggcagggtctcactttttgttttgtttttttttttgttttttttgttttttttttgagaccgagtctcactctgttgcccaggctggagtgcaatggcacggtctcagctcactgcaacctccgcctcccgggttcaagcaattctcctgcctcagcctccggagtagctgggtttacaggcacccgccaccatgcctggctaatttttgtacttttagtagagatggggtttcaccatgttggccaggctggtctcgaactgctgaccttgtgatccgcccgcctcagcctcccaaagtgctgggattacagggatgagccactgcgcctggccgacagggtctcactcttacccaggctggagtgcagtggtgcaaccgtggctcactgcaccctgccttcccaggctcaagcaatcctcccacctcagcctcccaagtacctgggaccacaggtgtgcactaccacacccggctaatttttttattatttgtagagacaagttcttgctgtgttgttcaggctggtctcaaactcataggctcaaagagcctcccacctcagcctctcaaattgctgagatttcaggcatgagccactgtgcccggccaactgtgagtgacattaatgacatgagttcccttgtgtgtggctgcaagaagctcagggtcacttttgaggactggtctgcattttcagtctatgctttcttctcaggaatattcacatgcctcactttttttttttttttttttttttttttttgagaccgagtctcactctgtcacccaggctggagcgcagtggcgtgatctcagctcacagcaatctccacttcccgggtttaagctattctcctgcctcagcctcccaagtagctggtactacaagcatgtgccaccacgcccggctaatttttgtatttttagtagagatgtagtttcatcatgttggccaggctggtctacaactcctgaccccaaatgatcctcctgcctcggcctcctaaagtgctgggattacaagtgtgagccactgtgcccagcctgcatgctgcacttttaagtttttgatattttgtccttgtaggttgcctaaaattctgaccaaaggatggggtgcatataaagtcatacatcaatctccaacaaaggatatcaaaattatccaacagctgacttccattatgcgttaaaactaaggcttcattcttgtggctagcccccgaatgctaaagcatacacttcagagctgcatttctgatatttttccatttcgacggccccaaaaacatctgttctttgcaggacggatccttgacactttggacgtggagggtttgagcaacagcaccctcatttattttacgtcggatcacggcggttccctagagaatcaacttggaaacacccagtatggtggctggaatggaatttataaaggtaagactgagatgctcccagatcttcatcttgcaagtttatctcttccctgcaattcccagcagggcaatctattccaggagggtcaatattattgctcagggacagtgatttttcctatccagggcaaaagtggtaatttgacatactccagtttgaatttttgttcctggaccaaactgagggtcaggctgcttattctggtggttcaaaaatgagatgcagatgaactgggagaggagggagtttatttctgtaaccggttacagggaggtctggaaattgttgccagaccaactcaaaattacaaagttctccagagcttctatttctaagctgtatgtctgcgtgtaagtgtgcactcatctaaagacattagtgatgaacttcttctaatctgtaactaaggtctgagtcccggagaccctcctctggagactaagtaaattgacttaatctaaatgggtccaggtggccgggcacggtggttcatgcctgtaatcccagcactttgggaagccgaggtgcgtggatcacctgaagtcaggaatttgaggccaacctggccaacatggtgaaacctcgcctctactaaaaatacaaaaattagccgggcatggtggcacacgcctgtagtcccagctactcaggaggctgaggcagaagaatcgcttgaacctgggaggcggaggttgcagtgagctgagatcgcgccactgcactccagcctaagcaatagagagagtctccatctcaacaacaaaaataataaaataaataaataaacaaataaataaatgggtccaggtgccagggctgattacccttaccttgtctcctgctaaatcgcggaggtctggggagttgtttcagacctctaataaaacttgtttaatcctaaaagggtcctgctaagaattccttggttatcttgtcacgcttcaaggcccaggagaggcctgggcagaactcctggggggcttttgtgacatcccggcctttgtatacaggcgctggttgtttcagcttttgctatttaacttcaccactcgtcagtgctgaaacagttgttacggaggcctgtgttagtgagacgtggcctgccacgtttttgtgcacaattaaggaatttttagtagattatcagagttgtgtaaccatcatcatgtcgatgaaaagagctaaactctgtaaaacatttgaagaggtttattctgagccaaataggagtgaccatggcctgtgacacagccctcaggaggtcccgagaacgtgtgcccaagatggtcaaggcgcagcttggttttatacattttagggaggcatgagacagcaatcaaatacatttaagagacacattggtttggtccagaaaggtgggacaactcaaagccacggggcttccagcctacaggtagatttaaacatttcctggttgacaattcgttgtttctctaaagacctgggatcaacagaaaggaatgtctgggttaagataaaggattgtggaggccaggcacagtggctcacacttgtaatcccaacgctttgggaggccaaggcgggtggatcacttgaggttaggagttcgagaccagcctggccaacatggtgaaactctgtctctactaaaaatacaaaaattagctgggtgtggtggtgcgtgcctgtaatcccagctacttgggaggctgaggcaggagaatccgttgaacctgggaggcggaggttgcagtgagccaagactgtgccactgtactccagcctgggcgacaaagcgaaactccatctcaaaaaaaaaaaaaaaaaaaaaaaaagattgtggacacccaagttcttatttgcagaggaagccttcaggtactaggcttcagagacaagaggttgtaacatgcttcttatcagacctaaaggctgtgtggatgttaatgccagagaggaatcatgaggcatgttcgactcccgcttcctgtcacggcctgaaacagcctctcaggttaagtttttaaagagctctgggtgaggaggaagtccattcagatggttgggggtccttagaattttatttttgttttacaatcactattttcattcgtaaaatttattgttattatttttatttatttttattgagacagtctggctctatctcccaggctggagtacagtggtacgatcttggctcaccgcaacctttgcctcctgggctcaagtgatcctcctgtctcagcgatcataagtagctgggactacaggtgcatgcaaccactcctggctaatttttgtatttttgtagagatggggttttgccatgttgcccaggctggtctcaaactcctcacctcaagtgatcctcccacgttggcatcccaaggtgctgggatgacagcaggcatgagccaccacatgtggtccaccactgtttatttcagaacatttcatcacctcacaaaaaaatcctctactcatagcagtcactcccttttcccccgtgctaacatccatcacccaaaaacttatttttgatttgtttattatttaatttttaaaattatcttttgtaaagatagggtcttgttatgttgcccaggctggtctgaaactcctgaactcaagcagtcctcccagctgggcctcccaaagtgctgggattccaggcgtgagccaccatgcctggccacaaaattattttgtatcattgtatattttcctactctagacatttatgtaaatgaaatcatgcaatatgtggagtttttttgtttttacttagcatgatgcctctgaggttcatctgtgttgtggaaatgtttcattcctttccatggctgaatatattccattgtgtggactcaggtttgaattttaccttcagacaatgcatccaagaaggataaggccaggcgcagtggctctcacctgtaatcccagcactttgggagaccgaggcaggcagatcacttgaggtcaggagtttgagaccagcctggccaacatggtgaaacctcatctctactaaaaatacaaaaattagccaggcgtggtggtgcacgcctgtaatcccagctgaggaggctgaggcaggagaattgcttgaacctgggaggtgaaggttgcagtcagctgagattgtgccactgcactctcgcctgggtgacagagtaagactctgtctcaaaaaaaaaaaaaaaaaaaaaaaaggtagaagggtagacacctagctggccacattatattcaaacctgtattccattgtttccaaacacgccattctttcgtgtaccacaaagatgctaaaatgtgctgccccgtgtacatgacttcacactgttgtgcttacacattttgtcttctccctgcttagagagctttatttttcagtccttgaaagagcctttttaggctaatattggcaaatatacctatgatgtatatttgctttgaagtagatggatccatcagtctagtacatatgtaaaacgggatatataaatgccaactacatccactaatgccttcccacaacaacttcacattgaaggcctgactcctcagaaaccttctttatctcattgccattgacgttaatgtatcctctacccaatctggttctctgtgccatcaagaatgtcagtattataaactggcggagctttaaacaacaggaatttatcctgtcccagccctggagaccaggagtttgagatcaacgtgtctcagggaaatgttcccgccagaagctctaggggaggctcctccctgcctctgccaactcctgggggccccaggtgtccctgagcttgtggccacatcactccagtctctgcctccgtctctatgtggccttctcctctgtgtctgtgtctcctcttctgtctcttagaatgctgtcattggacttagagtccatccttctccgcgacgatcttgagatacttaattgcatctacaaggacccctttttaaaataaggtcccattcacagaatctggggatcagggtgtggatatatgtttcaggaggactaaagtgcaatccattgcaattgaatccacttctttctggatgctctaggggaggctccttcctgcctctcccagttaccgggggctccaggcatccctgggcttgtggccgcatcactccagtctctgcctctgtctccacgtgaccttcttctctgtgtccgtgtctcctcttctgtctcttagaaggacatctgtcattgcatttagggccaccctaatccaggattatctcaaggtccttaacttgattatatctgcaaaccccctatttccaaataaagtctcatttataggctctgggagatatgacatgaacatgttttggggtcactgttcaatacgttatagttgtatccactttcttcttgaggctctaggggaggatccttcctgctgctcccagcgcctgggggttccaggagtccctgggcttgtggccacatcactccagtctttgcctccgtctccacatggccttctcctctgtgtctgtgtcttctaagaacaagagtcatttgtagtgaaggacctaacttaatccaatgcacactaaccaataacaaggttaataaaaaatataaaatcaaacctctacaggggaactacatgagattgaatgttttaatgtcactaaaacagagagagagagagagagaaattgagagactcagggagagagaaacttcaaacaagtgaaacaagcagaaaagttaaatcagccaggctgagcatctatttctggtttttaaccactttcttttgtttctgttcaaacccaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacaggtacagaacaacccaaagaaacaattcagctttgcacagacacagcaacacttatggcaaatgaacatgtcactttggctttgcagtaaggcgtccctgaaattgttccccgaccaaaccgagggtcgggctgcttattctcatggcccaataacgagatgcaaatgaacgaggaaagaaaggagttttatttctgtaaccagatacggggagaaggctggaaatgatcactagaccaactcaaaattacaaagttttccagagcttctataccttctaagctgtatgtccacatgtaagcgtgcatccatctaaagacataagtgattcaacttcctttcatctagaactaaggtctgagtcctgaggaccttcctctggagcctcagtaagttgacttaatctagatggttccaggtgctggggtgattacccttatcttgtctcctgctaaatcatggaggtttggggagttcttttagaccccccaataaaacttgtttgtggaggtctggggagttccttcagatccccaataaaacttgtttaatcctaaatgggtcctgttaagaatcccttcattattttatcgcgcttcaaggtccaggaaaggcctgggtagaactcttagtgggcttttgttacattccagcctttgggtgctggctctttcagcttttttttcttctttttttttttttgagactgagtctcactcagttgcccaggctggagtgcagtggtgcgatctaggctcactgcaacctccgcctcctgggttcaagcgatcctcctgcctcagcctcccgagtagctgggattacaggcacacaccagcacacctggctaatttttgtgtttttagttgagacggggtttcaccatgttggccaggctgatcccgaattcctgacctcaggtgatccacccgcctcgacctcccaaagtgctgggattacacgcacgagccactgtgcctggccaattaattactttttagccaaaggtgacgtttggtggtgactaacgtgggcagctgctgcattcttcttctaagcgtgctaatgcacacacatgccttccatccatctgcgttcacacccagactttccctccactgatacaacataaggagagtgcaccacctggggctgggactggtggatgctggagggacaaatgtccagagtccctgttccaaccctgagccatgccatgttccttcctgcagagtgattgacggccaagaccttctgcccttgctcctggggacagcccaacactcagaccacgagttcctgatgcattattgtgagaggtttctgcacgcagccaggtggcatcaacgggacagtgagtaggggagccccttcctaacacccttagggaaagagtccctctgtgcaggaaagcaccatgccctagaacaggctagggatggagctgcattccagagtccatctccatgtctccgcacttccgtttttctccacgagctttttaaatttagtttttgtcaatatgtgtccctctcattccagcgacatgccttctgagatcacctgccaatcgtcttaaaacgatggggagtcgttacctatagtttcagcaccatgtatgggctatatttcattctttcttccctgcactatatgaagtgcaacttttatcatcatcacacacacgtatgtgcatgcatacacacacgcacgcacacatgcttgcacacacatgtgttcaagacttttctagtctcttttttttcttatttttttgtaattatttttttgagactagtctttgtcgctcaggctggagtgcaactgcagtctcccgggttcaagtgattctcctgcctcagcctcctgagtagctgggattacaggtgcccaccactacacctggctaatttcttgtatttttagtagagatggggtttcaccatgttgggcaagctgttcttgaacccctggcctcaagtgatccaccctcctcggcctcccaaagtgctgggatgacaggcatgagccaccacgcctggtctccaatttttctttattaagttgaaacaaggtctcagtatgttgcccaggcaactcctgggctcaagcaatccacccatcttggcctcccaaaatgctgaaattgcaggtgtgagccaccacgcccagccttttgtagtctattttatgcatctagatgtgcttccaaatgttttaatcacctgaccttaacacgacttcatcttctttgtgaacaattacaggcgcactcctgtaatcccagctacttgtgaggctgaggcaggagaatcacttgaacccaggaggcggaggttgcaccactgcactctagcctgggcgacagagcaagactctgtctcaaataaaaaaaaaaaaaaagaaaagaaaagaaaagaaaagaaaaaactgactgagtgcaattcacaggcacttcgtgctttcacagtgttgtgcaacctccacgtctatgtagctccagaacattttcatcacgccaaaagcagacactgttcctatcagcagtcactctccatttcacaccctgcagaccctggaaaccactactctacttcctgtcattatgtgtttccctatccttgacattcaatgtgaatggaatcatgcaatgtgtgctcttttgtaacttctttctctgagcgtagtattttgaaagttcgttgatgttgcagcctgtgtcattgtgtcattccttctcatagctgcagagtatgccatgtaagatgtaccatgttttgtttatctgtccatccatcgatggacgcttgggttaggcctaccttttagccctatgaagatgccattctccagcaaggcaccctatttctctatgccaactctgtaatgattatctttccaccaggaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaacaaaaataaaaaaaaaattagcctgcatggtggcacacgcctgtagttctagcttctcaggaggctaaggcaggaggatcatttgagcaccggagttggaggctgtactgagctatgattgtaccactgcaccccagcctgggcaacagagcaagaccctgtctcaaaaaagaaagaaaacaaaaaaatgaaacaaacttcagtgtcatgttaagatatctatttgcataaggatgaatagtttccccctgtgaaaaacaaaggaaaaggcaagagaaagtagaaatgaacaataaacactggccaggcgcagtggctcacgcctgtaatcccggcactttgggagacagaggcaggcagatcacttgaggtcaggagttcgagaccagcccgaccaacatggtgaaaccctgtctctatcaaaaaaaaaaaaaaaaaaaaaagcagcagcagcagccaggtgtggtggcacacgcctataatgccagctactcaggaggctgaggcagaagaattgcttgaagccgggaggcagaggttgcagtgagctgaggtcgtaccactgcaccccagcctgggtgacagagcaagactgtctcatcaaaaataaataaataaacaaacaaacattaataatgcaccgttgaatgatcactcagacaccaaactggagaggcaaagtatctcctgcagtcggggaggagtctgtcaatggaccccagctcagtctggaagaggctgccctgtagcccaaaacagcacaagtcccagcaaaggtgtctctgtgacctacaggtttgcacatgaacaggagataggccccaaagataaaaactggcactgatgtggctttgtctgtggtgcccatttatagtgtttgtttatcgtttacggccacaaggatgagccgtgcttcccgttggaactgttttcaagtggttttcctttgtctccaatgccccaggtgatttgggcaaactctggctgtggaagccgcgctgtgcaggaagtgttcgccccagctctgagctgcaaggtcattgcataatcaggctgcgccttaattgtctgggctgctagaatgaaaataccataaactgggtatcatcaagaatatttctttcttgcagttctagaggctggatgtccaagaccacggcgtgacggaagctgtgtctggggagaacctgtttctcggttcacagctgctgccttcttcccatgtcttcacacggtcatccctctgtgcctgtctgtgtcctatctctgattcttgttttttgttttttgtttttttttgagatggggtcttgctctgttgcccaggctggagtgcaatggcgtgatctcagctcactgcaacctctgccacaggttcaagtgattcccctgtctcagcctcccgagtaggtgggactacaggcgtgcaccaccatgcccggctaatttttgtattatttagtagaggtgggttttcaccatgttgcccaggctggtctagaactcccgacctcaagtgatccgcccaccttggcctcccaaagtgctgagattacaggcgtgagtcactgcacccggccctaatctcctcttcttataaggaccccactcctattggaatagggcccactcttgtgacctcattttaaaggatgaataaaaaccttattcctgtgagtttgaaggcaacacaattcagtccccagcacattctcccctgggagtaaggaggtctttccaatagctctttctgtctccagattcaagcaacaggtccctcctcccactcttccaagcctaggtatgtgacgagcaatgccccaccttgtcaccgcctcaagaacatgtcctcaaattatccaatccacatcagcctccaagaattcaggctgtgcatacagaccaaaaagtcaaatccatctccagccaattctcttgggtcaagaaagaaatagtaggccaggtgcggtgactcacatctgtagtcccagcactttagggcactaagatggcttgaggccaggag

SEQ ID NO: 15302 - DNA, 44353 bp, Human
  misc_feature (1)...(44353): n = A,T,C or G
ttgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacacgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaatttcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtatgaatatgaaaatttgatatggatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctcttattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctatctctctctgtgtctctttctctcttttcatctctccctgtttgtctctctctgtttttctttctgtctccctccatctgtctctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtattagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcacttgaacccgggaggcagaggttgcagtgagccaagattgtgccactgcattccagcctgggtacacgaacggactctgtctcaaaacaaacaaacagcaacaacaaccaaaaacccacaaagtcataaaccaagaannnnnnnnnnnnnnnnnnnnnnnnnnnnnnnnnnnnnnnnnnnnnnnnnnnnnnnnnnnnnnnnnnnnnnntactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaaaccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaattatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggtggcagcaggttggcagtgagctgagatgcatgccactgcactctagcctgggcagcagagtgagatttcatgtcaacaacaacagcaaaaagtaaaataaaaaaagcgtagagaaagggataaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcaccgctgcactccagcctggtgacaaagtgagacttcatctcaaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacactgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaggcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaaattctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaattaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaaagtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatacatacatacatacatacatacatacatacatagatgcatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgggtctatttggtagaatgatttatttccctttgggtagacacccagtaatggcattgctgggtcagagggtagttctgttttaagttatctgagaaatctccaaagtgctttccacagtggctgagccactttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccgttagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatacatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatgtatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaactttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccacttgctgcttttttttggattcctgtggataaatgttgattgaaatttgttttatttcccgaaagcttataatttactaattctcttataaaaaatccgcacgatggccgctgataatgtcactgcagaattgctacttcttctgtttgtcacccagtctccaccttgcctatcgccagcaccaacactggcctttgcagtcttcctgactttctttgttttgttctttcattccatttgctgtttccttgaggtctttctcttctcacatgggctgtgtcttgcaagtctatgtttgggttcatttttctttgcataatctgaagatttgtaaatcgtgccaaaaccagttgtcttgccaccaccaaaatgaattctgaatatgaatacaaagaggacatcctggctgggcacgggggctcactcctataatcccagcactttgggaggttggggtggggggatcacttgaggccaggagtttgagaccagcctggccaacatcatgaaaccccgtctctactaaaaatacaaaaattagccaggcgtggtgacacatgcctgtaatcccagctacttgggaggctgaggcgggagaattgcttgaacctgggaggcagatgttgtagtgagccaagattgcgccactgcactccagcctgggcaacagagcaagtctccgtttcaaaaacaaccaaaaaaccaggacatcctgtgtggtcttgtccatttcggctagtttttcctgaatatctgtcttaggtgctgttgccttcctggggtgaaggacatcgatgaccatttgttgcctctgaagaagtcagtagctcatgaccttcctgtgtagatagttactatgtcatccatgttgacagctgagggcactggcaccatcataactcattgaagactccacagcaatcctcccagttcagcctctggagtaggtggcactgcagacacataccaccacacccggctctttttattcttttgtagagaatgggtcttgctatgttgcccaggcccatctcaaactcctgtccccaagtgatcctcctgcctcagcctcccaaagtgctggaattataggcatgagcactgcatcaagcctaatttccattttctaaacgtgtctttccgtgccagaaaacaagcacctacagacacttgtgccatctgctcagttgctttgctctaaatataaggccctgtgtcatcaggaggcaacatacgaggcatttaaacagtgcattaagaggatcaagtctaaacgtggccactaaccaaccaaaagggtttatgtttgtcaacaacagatagaaattgaatcaagagtggtgcaataattcagcaaaacgtgtgtgaacccagaaagtctgagacaggtctcagataacttagaaagtttattttgccaaggttgaggacgcgcctgtgacacagcctccggaagtcctgacaacatgtgcccaaggtggttggggcacagcttcattttgtacactttagggagacatgagacatcaatcaacatatgtaagaagtacattggttcgctttggaaaggcgggaccacttgaagtaagggctggaagacttgaagtgggagggggctttcaggtcacagacggtgagacacaaacagttgcattttttgactttctgcttagcctttccagaagaggcgatcagatatacatctatctcagtgagcagaagggtgactttgaatagaatgggaggcaggtttgccctgagcagtttccagcttgagttttcctgagtcattttgggggcccaggatatttttttttcacacatgctagc

SEQ ID NO: 15303 - DNA, 66227 bp, Human
ttccagcagcctttttcttctttgtctgttatggttaatactccatagattttagaaattgagaagttcttgaaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgcttaaagtttttggtactttttcggtattgacagctgaactgttagggtttgcttcattcaaatatctcagaggctttgaactatcttggggttgatgcttcttgttagtttgtcaatgtttgaatcctggttttggttttttccctgccctgctcctgcaggtcagaactggaacacgcgagggaagggactgttgaagaattgggtggaatctgcttattcttgggcttgtgttgagtctggggatggaaccagagttccttaaggtggaatggctggcttggcattgacgagttcagggacctgacttagggtactgatttggaccgtgactttttgtttgagatagagtttcgctcttgttgcccaggctggagtgcaatggcgcgatcttgactcactgcaacctacacctcccgggttcaagcgattatcctgcctcagcctcccaagtaattgggattacaggcatgggccaccatgcccggctaattttgtatttttagtagagacgaggtttcgctatgttaggctggtctgaactcctgacctcgggtgaaccacccgcctcggcttctcaaagtgtggggattacaggagtgagccaccgcgcccggcctggactgtgacttggaacaagatagtttttcctcttttgtttattttcctactgcctgcatgattgctatttatttaaagagacggagtctcgccacggtgcccaggctggtctggaagccctggtctcaagagatcctcccacctcggtcttccgagtagctgggaccacagaagcgcgcgccgtgcacttttgatgttttcaacttccttcctaagcagaaaggagacggcccagcagcggatggtgaagctaatccaatatagtgagctgccaccagcgtttttaagtgcattacatagtaagaacgtggttctgctggacgttatgtactcggttgcgatataaaacgcatcatctacagtaggtgacaggcgccaaagtctaaaaactggtctcaaggtgtaaggtcccaggactagtttctggagctactggcttgtgagtgaagctggaggcgcagacttcccgggtcacacggtggcaaggcagctgcctagggtgcggcgggaccgggcggcgcgggggggcgcctggccaagcagtgcagccccggccgggtttgtagccagcacagcacagcggggcctgtggcaccgactgggttcttttacttttgacacgaagcccctcccacttaccacgctctgcacgcgcccctgttaaaatagaaaaagaccgagaggcctcggagactcagtcatcatctgtggctctggccgctcgctgacgtggcgaactgggctgagggagcgcccggctgggcacccgagaactccagccgttccggcccagtcgccgctcagaggtggtaacagtagccgccaaggccgcgcacgggcgcatgcgcgcgtcggaccaaccccctccccccaccgcgcagtcacttccggcgcgctgggagacgtgcggttccgggtcgctgctcggctcgccggctgggcggtgggggttggtgacgcgggccggggctcacgagaggcccgggaggcggggctttgctggcttcccagagagaggcaggtgcgcgggccaggactccgggaatgcgagcaggccccttattctcccagtggcctcggtctgtccccacagcggcccggtcagggttgcccgagccccaaggcggggggcggcaccggggtgctgaaagggtgagagtgggggcggaggcgggctgccccggcctgggagtctggagcctagggttccgggattcctccctgcgcgaccttggacaagtcgctcctcctctctagggctcagtttccttgctgtcaaatgggagagatgttggatccttcctttctttgacagtccaaagcacgggcggggctggaggtagcctgagggagtgagatccaaactgccgtggcaggcacctgcctgcctccctgggggttagacatctgtctttacccaattttgccttgctttttgtcagtgcacatccgtgaccagacgcccagggtctggccgggtaaacagtatgtgagtgtagtaatcaactgagaaataaatactggctccaggaaaacttaacctcattcaaattgttttgctcagggctcccagggagaagtgaatttaggcacccgctgcggtgatcaattctgttctatgcgcttgtaagtgaagctcttaggcaaaaaacaatttcataggagatcagggttagggagggtatcccattgagagttgtgacaggttttcttaccccctttaatccttcttctgcccctcctcttccttcacttcttccccctatccccacccaacattttggccatacacttgaaaagaaatacccaatgcattttatctttgtcttcatgcaggacagaatgctttgacctccaagctgttttaaatctagtagataagccaggtgagtaagtggtttacacacattgaaagtaaagtttctgaagaattgtacagccttaatggaggatctgaagtggtaagatggcatttgtgtatctcagagcagagcttaggtatcctccacaaaacatggaaagttaaggttggaaccagaatattagtgttttatacaccattaggaggaaaaggtttttgaatcttactttgaatatcatgtcaaacattcttaagaaaagaaactgtgaggccgggcgcagtggcttatgcctgtaatcccagcactttgggaggccaatgcaggtggatcatctgaggtcaagagtttgagaccagcctgaccaacacggagaaacctcgtctctactaaaaatataaaataagccgggcatagtggcgcattcctgtaatcccagctactcgggaggctgaggcaggagaatcgcttgaacccaggaggtggaggttgcggtgagccgagatagtgccattgcattccagcttaggcaacaagagcgaaactccatctcaaaaaaaaaaaaaaaaaaaaaaaaaaaaagaaagaaagaaaataaactcattggaggtaattttatcaaactcaaaaccacacagcgtctctagaaaatgttcaaggatatcagatacttatataatagagttgtctggtgtgtcttcttttttctgttaccagcttttcctattggacagttgattgcaaaccatcctgaaacagtaggatattacaccttttacatattgaattacatattgaatattgaattacatatgaattgaattacatgcatttttgtcttcaacttaaagaacactaaactgtagttaagcttattggaggaaggatttgaaatcattaagtcatgaatatatgatgttgatgtctgctctgggacattttaccaagtgtgttatatgtcatagccaacatgtaattaaaaaaaaaaaacgtagagatttgtgaatcagagtcctctgttcaaataccagcccttccacttagccacacaatctttggtaggttacttcatcttcttgagactgggtttcttcatctgtatatgcatatgaagcacctgagtgctttttaaatgtttagtaattgtgttctataagtgtacatgtaagttatgaaacttagttttgaaatctaaaacttaacaactcagatgcgaaatctttccaatgtttaacttttgaactgtctctttcatctgatttgtagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgtaagtacctttacttaagaaataaagatacttttgcagggtattcttccaataaatattttaaattgcttgattatttcatacctttcatggtttatagctgtacaagagcctgtacatctgattcttcttactctgaggtacctttttgttaatgtttggtttgtaaatgttaaggtactctatatttttttccttatttttctgtgagttcctctccatattctctccagtgtcctcttgtactgtttttccgtctatataccttatacatcttcttttgcatttcatttctgaaaatgtctgggcctgttttcattgcagacatatatacttatataacaactaagtcattgctgcttaacaaggtctctgagttgtggtatggggttagcaagagtgcattgttgtattgggacgattgttggaaagatggccccagtgattacagtatgttgctttttttcttttttctttcttttttttttttttttgagatggattctcgctctgtagcccaaagtggagtgcagtggcctgatcttggttcaccacaacctctgcctctggggctcaagcaattctcgtgcctcagcctcccgagtagctgggactacaggtgtgttccaccatgcctggctaattttttgtattttagtagagacaggtttttaccatgttgcccagggtggtctcaaactcctgagctcaggcgatccgcccaccttggcctcccaaagtgctgggattacaggcgtgagccaccatgcccagcctacaatatgtttcttattagtaaaatacatttgtgactataagatttcaaaaaatgaagatgttgctatatgagggaaatgtcatgcttaaaaaataaagtgtggcttttgcatatgacaggatcctcttaagttagataaatttcttttctcttcttttttttttttttgagacagagtctcactctgtcagccaggccggagtgcagtggcatgatctcagctcattgcatcctccacctcccgggttcaagcagttctcctgcctcagcctcccaagtagctgggactgcaggtgcccacgaccacacccggctaatttttttttgtttttagtttattgtttttgagatagggtctcgctctgtcacctagggtggagtgcagcagcacaatctcggctcactgcaacctccatctcccgggttcaggcgattctcctgcctcagcctcctgagtagcttgggactacaggcacccgccaccacgtccagctaatttttgtatttttagtagagacagagtttcactgtgttggccaggctggtctggaactcctgacctcgtgatcctcccgcgtcggtctcccaaagtgctaggattacaggggtgagccaccacacttggcaataaatttctttaaaactcatttataatgctggatatatatataaaagaatgtatgtaatatatatgtaaagtataaagcataaagtaaatctatcactcatctgaagagatagaacactatcaattctgttaagccacttatatgtttcttccaatttcctctacccaatttaggatagcataaccactattctaaattttgtatttttcatttacttgctttttaaaatatcttaccagatatgtatgtattcataaacaatttattatttaatactgcttgtttttgaagttataaaagttgcacactgtagacttcttggatttccttttttaaaatttaattcaacatgcttataaaatgcatccatgttacaggaagctgtggttcatttatttttactgctgtataagattccaggctggacacagaagctcacgcctgtaatcccaatgctttgggaagctaaggcggaaggactgcttgaggccagaagttcaagaccagcttgggcaacatagcaagactgcatatctacaaaagtttttttttttttttttaatttgcctggttggtggtggtatgcctgtagtcctagcttcttgggaggcagaggcaagaggatcgcttgagcccaggagtttgggattgtagtgagctatgatcgtgccactgtactccagcttaggcaacagagcaagactctgtctctaaagattttttttaaaaaaaagatcccagcatttgaaaaggccacatttaatgtctgtcttctcctggcgatagacatttgaattgtttccgttgtcagatgagtcttcctcctgctttcttgtactgcctggatcccaggtcagattacatggcagaagttattaggttatcgggatggagcaataagattaccagatctacattatcactggctcctatatttaagaggaaatataagcacacatttgagcatcgggctgaaggatgtagttttaaggctgggttctgtgacagatggacctgttttgccttcatgctgacaccctaaatgaagtcttttatttagtaatgtattccaaatacagagattgacccagattcaggaagtaatttattttggggtttctcaagttttgaacttaatacagcctgatcctcagttcctatctccagacccttatatccaactgcatatgtttctccaaacagatccctcctctgtggcatctcaaattctaaatgaacaaaattgaattcattatttccatctccaaatgtgcaccttcatcttcccaagtcaccagccagaaaccctggaggtattttaggctcttccctcctttcacttcttggtgtccaatcagtcaacacgtattatggcttctatttctttcttttttttttttttttttggagacagagtcttgctgtgtcgcccaggctggaccctgggttcaagcaattctcctgcctcactcagcctcccaagtagctgggactacaggcacacaccgccacacttggctagttttttgtatttttagtagagatgaggtttcaccgtgtgcccagtctggtcttgaactcctgagttcaggcaatcctcttgccttggcctcccaaagtgctaggattacaggcagctttcatttcttaaatgtctcaaacttgcctccctactccatcttctagtagtacatttactagcagaggttaagcatccctaatctgaaaatttgaaatctgaaatactccaaaatcttaaactttttgagcgccaacatggccacaagtggaaaatttacacataaatacttaacacaactttgtttaatgcatatcatttaaaatattgtataaaattatgttcaggctatgtgtataaaacgtatatggaacataatttcacgtttacacttgggtcccatccccaaaatattatattatgtatatgcagacattccaaaatctgaaaaaatccaaactccaaaacacttctgatcctaaactgtttgggcaagagatactcaacctatactatcatttgatttcaagctgcctttctttctgggacaaacttgtagtctatctgggttccctgtccccaaagtgacctttttttttctttgagacagggatctctttctggcacccaggctggagtgcagtggcccgatcacagcccactgcagccttaacctcctgggctcaagcgattctcccatttcagcctcgtgagtagttgggactacaggcacgtgccgccacacccagctaatttttgtattttttgtagcgacggagttttgccatgttgcttaggctggtctcgaactcctgggctcaaacgatctgcccaccttggcctcccaaagtactgggactgcaggtgctagccactgtgcacagcccaaagtgatctttctaaaagcagatctgttcatgtctctccagtacttaaaactcataaaactcagtggcttccccattattttcaggatgaagtacagactcattattatagcataatggtaaactgtcatggtcttctctcagcttatatggccagcattatctcactgtactttgctacaccctgtgccacagccagactgaatttattgcactttctagaatggaccacattctttcatgcttacaatttttgcacatgctatttcctctctctagaatgtctcatttcccctttcactcctgcattcctctgacagactcttgtgcatcttaagactcagctcatgtgttacttccagcaaactcccttgacctgaccttctcctctggcagccccctaccctttacccctcctggctgtttggtgccttgtcttctgctaacctctgtaatagcacctgctgtactgcattattattgatgatttgcttgtttgtctcttccactgaactgggagtttcatgaaagacaataaagtgtagcccttaggaactcaggtcaggttatagagtcatatctgctctattattattatgtgactttgggcaaatttcttcatttttccttgccttatttttcacatctataaaatggggataggaactgtatctacctttattaaagtatgtgtgtcaaggatccccaagatcatccccagatttaattattcactaggaggactcacaagactcaccatatagttttactcactgctatcatttattacagtgaaaggatctaaaacagactcagcaaagggaaaaggtgcatggggaaaagcttggaggaaacaggtgcaagcttccaagattcttctcccagtggaattacataggacatgctccattctcccagcaatgagttgtgacaacacatgtaaaatgtctaccagggaagctcattagagactcagtgtccaggctttttattggggactggtcatgtgaacaccctctgcctactatgtatcaaaattccagaatccaggccaggcagggtggctcacacctgtaatcccagcactttgggggaccaaggcagatggatcagttgaggtcaggaatttgagaccagcctggccaacatggcgaaaccctgtctctactaaaaatacaaatattagctgagcatggtgacacacacctgtagtcccagctactcaggaggcaggagaatctcttgaacccaagaggcagaggttacagtgagccaacattgtaccactgcactccagcctgggtgacagagcgagactctgtctaaataaataaataaataaataaataatccagactccagaaggaaaccaggtattcagcataaacccatatttttgcacaaacattttaggcacaatgagccattcttaacagaatgatgggaaccctcccaaaatctaagttcccagatgccagccaaggaccaaccttaaaagcaggcctttctaaggataacagtctgaggcctgtaatgtcagttcttctgcgtagaatctaaagcacttagcatggcgtctggctctaagcatttcataattagcttctgttgctgctgctgctgttattttggataggagctctttgtttcaccactattcctagtgcttagcacagtagtgagacataggatgtctcctatgtctcactaacagtaataatcataacagcttcttatactgctagtggtgtggtctgaatgtatgtctccaaaaattgatatgttgaaacctaatcactagagtgatggaatgaggaggtgaatcgtctccgagatgattagctcatgagggaggaaccctcatgaatgagattagtgctcttacaaaagaggccccagaaagctgccttgccccttccaccatgtgagggcacagctagaaggtgtcatgtatgaaccagaaagtgggtcttcactagacaccaaatctgctggcaccttaattttggacttcctaggctccagaactgtgagaaatacatttctgttgtttataagtcacacattctatggcatttcattatagcactcaaacagactaagacaactagtaatagatgacacatattaaagctaatatgtgccaggctgtgttttagggatttgacaagtattgatttacttaatcctcatcacagctctgtgaggcaaatgctgtttgttatcacagattgcaaatgaggaaaccagtgcacagagaagttgagtaatgagcctaagttcttacagctcgtaagtggtaaagctgcaacctgaagcaaggttttctgacaccagagactctcctcttaactgtccactgtcctgactctcagtacatattggatgggcaagtggctggacatgtagatgaatatttgaggtgaattattgaataatctttaaaaacattttggggatacaatgggaaacatgattaaggactggatgttagtattttttgttaggaatgataatcatatgttgcctatgaagagaaatagccttaatttttggagtatttaggatgaaatgccatgatgtctgttatttaaattacttcagaaaaataaaaattgatgaagcaaataagggaaagcatcagcaattgtgaaagtagatggagagcattatttagaccaatctctctccctttctatattttgaaaaattgtataatgaaaagtaaaagagattttaaaaactgagttattagcaattgcaagcagtgcctatagcaatagtagtattcatttattttaaaataatctggtttgttggggaaaaatgtatgcctcattaatatattggtttgttgaatgcatattatctgctgaagtctatgatgcaagttagagttttagattgatatccgtttgtttcatagatgaagatactgaaactttatcaatatcggtgaaagattcgtagtcatagaccagcttttgatccctaaagaacccccgccttctttatcccaggactttacttttggaaagataaagtgatttttttatcatggcaaatatagtttttgtattatatacttgctgtaataatggatctatttactattatttatttcagtagcatgcgtacacataaaattgatctgtttagcatctcctctctccttcactttataagaggaagaaagcgttgcttccactttccaggtagagaaactaggcccagcttttcagtgattacaattaattaaagtgtaaccaaacctaaaataagacttgtcactttctggctcagtattgtggtctcacacatatatgaatacgaccttccttgtgtctacctcaacaggcttccgatggaagcagctccagagaagatctttcatcccagcttctgagaaggaatgaacagatacggaagttagaggccagactttctggtatgtctaagaactcataaaaagcaaacaacaggaaacttgccttgcttgactctcttcctataaaatagccatataggatgactttatagttattttcacatatcattttgatctttttagaaaggagcaagtataccctcttcttttgttagtgtagtaaatagtataaattcaaaactgaatttgaaagtttattaaaaaattttttctgctcctgaggtttctagccatggaaataaaagataataataatatatgtacaatagatttgaccatcttccaccattagcatagcctgctttcaggtggaaagggatggcgttagtatttaaagggaatggccgacagatattggattcatcagcaccagagattggtgctgtgttgccacttcctgcagctcataccacctgtgtaagtgttgttgtaggtctttgggccacttttcaatggtatttctgacttcagcacctgcatagaaggtgtcactctcattatgtcttttgtctgcagtttacaatttacacagctcccattatatcctttgcctgaggagggcatggtcatgatagaattgtgagttattattttggtttctgccagtggatacatttggaaagcttcatcctgtaaagtggttcatggcttctgtgtctctttttgtcccttggccttttaatgcccattttattggagtaaaacagcagaccgaagttcaccaagtggtatgtgaaatatttatatttgtgtagctatcagacccaaattcaccaaattgtatgtgaagtatttgtatttatgtagttatcaaaggttcatagcatagctcacaactaccagttaattattttgtcctcactagagccttattaggcttagcaaggttaaggcctcacaagtagtaagtggtagagctgggatccaaacccagatttatttgatgctagagtcttaattccatctgccttaaacttaattgttgctatcctgttactcctacccataaataatatcagtaacagaggtaaagtaattttacatttgtttaatgttggagagagagttataaaataatatatataccttccccatatggtaggaagaatagttgagcttgacttacgttagagaagggacagggaagagcactgacatttactgggcccactatgtggtgagtattgtcctacagtattagtatgagtaatgataatagtcacagtaacaataagagctacattttattgagcactgtgtgcaaagcacttaaggcacgtaaaatgttttatctaatgcatcttttgtggtaggtacaattaatatcatcatttaatatatgaagaaactaatactacaggaccaataatttgcttaaggtccccagctaaggactgacagagttgggatttgagctactatgttttcactaaaccataactatcttctttggccacctagataattaattctgacattcacatttaatgtagcgtaggttaccaagttcctgtgtagaaagggagctcacttttttagagaattaagtgctatcactataaagacaatgctgcacctaaggtgtttgttattgccctaactactgttcctgagttgtgtggactataagcgagctgtttagtgagttcactttgatctatcctactgctaagaccggaaaaggaagtggaaactgagatttgaaattaagtcatgagataaatctgtgtttttcatagcaggacatttctgatcaccaggctaagcctaattcttgtttttctatcaaggctaaacaaacttgcctttttgtactcaccatttatacaccatggatagtttgtactatacttgttttcctgtgttgttcattgttaatgggaggctgtctgtctagctttccttaacaggaatggttttcaggttaagaaaatcatcatcatttccattcatttttttgtttaattaacttcctttcctgatgtttgtccatttctggtatgtgcgtcaccctcctcacccaagactatgctgaacaggtccgaaacttgcagaagataaaagagaagcttgaaattgcattagaaaaacaccaggattgtacgtatttttttcctgcttttttcaatcttttcaaggtttagtttttgaaatgaaacaatagtgtatggttaagtttgtccttcttcaaagcacaaatctttattttataagtagtgtacttcttaatcaggttgatataacatttggatgatatttataagtatgcaagttttatttatgttggcttatgggcatgactcttaggagtaggtcattatgtgtatcagcttgtctctatccagttgacccctttatttaggctaccctcaggttttaataaaatctagtacccatcccttaggtctggattaggaaatgggttctcaccacagcttcattactgctgtgttgagtaactgggagaaatccctgtcatcactccctcagcaataaatcatacattttgtgtagtctaccctcaatcatatattctttgggtaccatccaagaaagatgttagtagaagtagaaagttattttttttgttgatatgtactaaaacttttaaggaaaataaagtaaaagaaaggttttttgtttgttttgatttttctttttgtttttaattctgataaagtggtagtagccatcacttagcatcagctttgatgttttctggcaacctacctaactcagtgttctatcattgtaccatttaaaaagttaccttttggcatctttgtaaatatatatacttgtctattacaaaaaacaaaaacgataaggaaacaaacaaaaactgtggtctattaccaaggccaaaatattcttctggaaagttgaggtggatccagcttttcctagtatcacaatccacttatgtgactttggcctttttcattaggtgacagttgtaatcacatgggctatttgtcatgctgtttctgaagtgttttcatatctcaaatagagcctctttgttaacagcttccatgcggaaatttcaagagcagaatgagacattccaagccaacagagccaaaatggcagaaggactggctttggcattagccagaaaggaccaggtattttatatgtggcactgcccagaactggtggaaagatttcacttagtgacgtgatttcaaaaatcatgacataacctatagaaaatatttatagcctaggagaagagaaatgttaaaagttcgttaaggttttctttggccttttcttgtaaagtgaagaaactttacagttctaatcatgaaatgtgtccagaatgtgagagtatcattccttgtatctgtgtagtttcataaaattgagaagggaaatagtgtatctgtaatctgatggcaggccccaaaataagagaaaaggtctctcccctctaaaaacctctctgaaagtctaacccccaaacatttgccttttatcctggagaagatgttattaacttagtcataatccatagtatacagagttcttccaacctctgttcccacgtttcttcaatcccaaccagcaggacagaggggaaatcctataatctcagcagaaccaaccactggaagatgctgaatgaataaccacaaggaaggaaaataattctgttactggctattacagtaattatgaagtatattttgttcaaaataatagatgacattttaaatttaagataagcatcaatatattataatgttaattttgatttattaagacagagtttattatgtttcacttaagaaattgtataatttatttcatctggaggaggtgggttggttggttggttttaaagtgtctgttcatcatctaggacatttactagccagaaaaaatacaatttaccaatacttagtggataactgtggtatgaatgtatataaatgaagaaataatctaaaattgatggattctgattataggcaatcaggatattgcctttgtgcaaatgggctttttttcccactattttatggtttgtgaataaggggcataattctttttcttttgacttacacagatggcataaagcatgttggtaaaatcaaaatgaaaaggaaaatgattatcagggactgcaaaagatcccccctactcccccagtttcaggaattaatttctaaacatcatttccagaattactcaactcagctggtcccagctacccactcccaagaaataacagtactcatggcaaaactcccaggaacaagccaaaaagctgcatcagaacagcagatacagcttttcttgggtgccctgcttagtaaaaatctgcaggcttatattcatgaattcattccattctagaatcttagataaagttcattttcttctatttttgtgactcttgcctttcttaatattaaaccaagtttatagatttttttttaattggcttttttgttttgtttggttagttgctttctgggaagagttgggttgttttgttttctgaaaatcttggtattacagatactcttcactggaaaccatacttttttattgttttgttttaggaatggtcagaaaagatggatcagcttgaaaaggttagttcatctttatttttgtctcatttttgttggtctcgtctctggggtatggaaaacgttttatccggtaaccaacatactgattgctataccacctcttggaagcaggacagtttatgattagatactgacttgaaaagctctgatcctccccttttttggtgaatgtgcaggatgtcttttgtttgcccctcttgatatactctgcactcctcctctcttccctttctctgtgtacctgaacgccgatagaaactgtatcagcagggctcagaatgccctctggcatccggttgggttcagccagtggggaaccctgaaagaaccatgtgtgaaagaagatgtggtcaggatgtttcttcccccacctttctccatgtgggctctcttcagcttagttgcatcccatggccaaagtcacagcttcagttggacctttggtttgccttcttgacatagtttttgtctctctgggtttcctataacctcttcatctttttgcctctttatggccaactgttgccagcacattatcttttgggctatcttacccatcccacagctttgataagcccctttattaaaccatcctcaaaatgcctgatttgagatggccgtctctttcctgctgcggttctgattgacacgtggtaatattaggaacacttaaagatgaagcagtggggaaggaaggcatttctcaaggctcagcattgaacatatatgagaacctcttggctagatgtagatgaggaaattgattattctagtaccattgcttgcataacaccgtacaggtaccttaagtaatatattcctggctcccacatataaacgagatgaaatttcaagtctacaattggaaaaacattttagttttaaaataatcattagtgtcaactattttttttccataaaacaccaagttaactttactttctgttctatagaaatctgattatcaagctgagagaatacattaactttttttgagacaaggggttgttctgttgcccaggctgggagtggcacaatcacagctcagtgcagcctcaacctcctgggctcaaatgattttcccacctagacttcctgagtagccaggactgcaggcttgagccacagtgcccagctaatttttaaaaaaattttaatagagatgaggtctcactgtgttgcccaggctggttttgaactcctagaccaaagtgatcctcctgcctggcctcccaaagtgctaggattacagtcgtgagccactgtgcctggcaacagttttatataaggaaagaattatagaaaagtcaagtcccaaggaaacctgtgcttgaaaaaaaaaaaaaaaatcctcaaccatatgctattaatgacagtcttcttaaatatggagatatgggttgggttaaggttttcttgctgtaaaagaaactcttaagattatggcaattgaaattctcattgaactgtttttttatcttttaaaattttggtaaagggtatccatataggactgaaccaactaaaaaacctacttaggttcacaaggttcacaaagggaattttctctttgttttgtttttgttcttttgaaggagaggttggggaaaatttttcttttttttttttgagacggagtcttgctctgtcgcccaggctggagtacagtggcatgatcttggctcactgcaagctctgcctcccgggtttactccattctcctgcctcagcctcccaagtagctgggactacaggcacccgccaccacacctggctaatttttttatatttttagtagagacagggtttcactgtgttagccaggatggtctcgatctcctgacctcgtgatctgtctgcctcggcctcccaaagtgctgggattacaggtgtgagaggttggggaaattttctagagtaggaaatagtaatgagacacctatataggtcttcgaagctacttttcatcgttaaagttttttttttttttttcagtcaagagttagaaactgtaacagaagggttagtccttaagagagtccttttttctttttttctttttttttttttttgagacagggtctcaccacgatgcccaggctggagtgtagtgcagtggcacagtcatagctcactgcagcctcgacttctcaggctcaggtgattctcccacctcagcctcctgagtagctgggattacaagcacatgccaccatgcctggctaatttttttgtattttttatagagatggggtttcaccatgttgcgcaggctggtctccaactcctgtgctcaaccgataggcccaccttggcctcccaaagtgctgggattagaggcaagagtccactgctagaaatgatcatttaataaattgtaacctgctgacaccagtcatgtctaatttttttttcttttttttagcttgttaactgaaatcagttctacttttaatctacgtgcatttaatttttttcaggcattcaatcttactggttactcatgtttttcagccagttcagtgtgtcactaagaatagacatgtaaaataaggctgggcacagtggcttacgcctgtaatcccagcactttgggaagcagaggtgggtggatcacctgaagtcaggagttcgagaccagcctggcaaacatggtgaaacctcatctctgctaaaagtagaaaaattagccgggcatggtggtgcatgcctgtagtctcaggtactcaggaagctgaggcatgaaaatcacttcaacctgggaggcagaggatgcagtaagctgagatctcaccactgcaaaccaacctgggcaacagagtgagactctgtgtcaaaaaacaaacaacaacgacgaaagagtagacacataaaatatatatctggacttgctaaacagatgtaagaactttaaagttctacataggccatgcacgatggctcatatctatcaacactttgagaggctgaggcaggagaatgtcttgaggccaggagttcaagatcagcctggataacagagcaagatcctgtctctaccaaaaaaaaaaaaaagttctacgtaattgttgcttttattcccctttttcacaattatttaaaacacatttatttttaaataaagaattaaattctctagttaaaggattaattcaattaaagaatttgtaaataatgccatatttctgtaatgctttccattatcaatgcatcattgtccactggcatgagatttcctgaagatttttcctttattaagaattccactttcaggccgggtgtggtggctcatgtctgtaatcttagcactttgggaggccaaggcgggaggattgcatgagcccaggagttcaaggccagcctgggcaactagtgagactctgtctctaaagacaaaaattttaaaaaagaaaagattttcactttcgtaatacagatttctaatgctttcgttgcctgagttgatgtcttcttctttcaaataggagaaaaatattctgacagcccagttacaggaaatgaagaaccagagtatgaatcttttccaaaggagagatgaaatggatgaattagaggggttccagcagcaggaactaagtaaaataaagcacatggtatgcatttttgttttagtagctaaatactgaatagatgattattcactctgattttactagtcatcactctctaattgctgataaacatacaccagtaatatgtgatattaatcatatttgatattaatcatatttgtatgtttttaaatttattaaaatagaaaagttctgtttaaaatgttctttttctgttttgttttgggttttgttttgttttgttttgttttgtttttaactactgggtatataaattctcttataagcccacaaaaatgttatagaaatttggctattggtccacatttttttttttaaatagatggagtctcacggtgttgcccaggctggagtataatggctactcacaggtgcgatcatagcacactgcagcctcaaattcgtgggctcaagctgtcctcccactttagcctcccaagtaactggaactgtaagcatgtactgtaggtgtgtgccaccatgcctgacaagcttagatttttttttttctttcctttctttctttctttttttttttttttttgagatagagtctcactctgtcacccaagctggagtgcagtggcatgatcatggcccactgcagcctcgacctcccagactcaagggattcttccacctaagcctcccgagtagctgggactacaggcgcactaccatgcccggctaatttttgtattttttgtagaggtggtgtttcgccatgttacccaggctgctctcaaactcctgggcttaaacgatatgcatgcctcaacctcccaaaatggtgggattacaggcgtgagccaccgtatccagccgagatttaagtgtatttttcttttttacttcttttttttttttgagatggagcctagctctgtcacccaggctggagtgcagtggcgcgatcttggctaattgcaacctccacctcccgggttcaagtgattctcccgcctcagcctcccgagtagctgggattacaggcacccgccaccacgcccggctaatgtttgtatttttagtagagatagggttttgccatgtcagcaaggctggtctcaaactcctgacctcaagtgatccacctgcctcagcctcccaaagtgttgggattacaggcgtgagccagcatgcctgatcttaagtgtatttttcttagcatagcccaatgaaactttgtatttttgtgtcagcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagaggttcttgcttggtctgtggggcccttgggaagaggtgttagtgtagttctggctatagcctgcccacctttccccattgttcattacaccactttctgattccggtgctggcaaaggcttctggacacatccttacctgcctaggactcaggcctcaccctacctccaacccattttccccttcagctgctgaaactcaggacagttccaccctgctgaacaattcagtgtggttttagtttgtaaagtattaatagactaaggaaaggcaggtcaggatttctttcttaaactagggtggactttttctctttgggctcctgcttcagagagagccgaggctttttccgttgaaaacctgcatgtggctaatgatgcttgtagccctgacacagaagaaaccatttgtatttttcctgcagaagactgtatattagatgagatatccaaatttgttcattgtctgctttcttttgatgaagagatcatgtgatagcttcaaaaacaggtgcagaaagtaagatcacagccctggaacaaaaggaacaagagctccaagcactcattcagcagctttccattgatttgcaaaaggtaagtagaatatgaggagaagacctggatttctaagattcataaaaactaattctttcagaaatttctgcctgagagtagctactgaacatacatttctcatgcagtccacatggctccatttcctgtactagccaggctgcactcagatggaaatggccatacagctgaacaagggttgcttagcagaagtagtcagtattttcctgtcaggaattctcaaagtacaccatttggtcgactcaaatatgtctctcttttttttttttttttctttttttttgggacagagtcttgctcttgtcgcccaggtattataggcgcccgccaccacacccggctaatttttgtatttttagtagagacagggttttaccatgttggccaggctggtctcaaactcctgacctcgtgatccaccaacctcggcctcccaaagtgctgagattacaggcgtgagccaccgtgcctggcctgactcaaatatgtctttaagcacataatggaccttgagcatgaaaaatacaatagtggctgacatgaccagggctgtacctttgacatacttggctctaatccagtttgttttatggcacgtaatcaaatgatgtcattacaatttgttttttcatttcattgacatacatttgtttctacattagggctgtgctacactctgagaatataaagatgaatgataatatttttgaatataaagtagtgtttctcaggcccagcacagtgactcaagcctgtagtcctagcactttggtaggccaaggcaggaggatcacatgaggtcctcctcttgaccccatctctaccaaaaaaaaaaaaaaaaattagccagttgtggtggtgtgcacctgtagttccagctgtttgggaggctatggtgggagaatcgcttaagcccaggaattcaaggctgcagtgggccatgaccatatcacagcactgtagcccaggcaatagagcaagactatctttaaaaataaaaataaggctgggtgtggtggcgtgcacctgtaattccagtacttgggaggctgaggcaggagattcggttaaacctgggaggtggaggttgcaagtgagctgagattgtgccactgcgctgcagcctgcctgggtgacagagagagactctgtcttaaaaaaataataaaataaataaataaataaataaatataaataaaataaagtagtatttcccaatgacataatttattattggcattttgagcagaacaactcgtattgtatgattgtccattgcattgcgcgacatttagcattcctggcctctgggttctgaatgccaatagcatccttcagtcattgacatccagcccttcccctcacatcacagaaccaccccctattcggcagtgccatccaccctaccctcatctttcagaattgctgatctcaagtgagacagagccttacaacataattacagtacagtaagattttgtcaatagaggtcttagctaagtattatcatacttacagatacctaagtggaaactaagaggttattgaccttgttcacagttataaccgtaagtgacagagttggattctaacccaagtcttactccagaactcatgcttattctactgcactttgctgcctcacaataaggagcacccagtaaatatatacgtgaatgaatgactgtgatacaggctttttaccctcaatgaactaaaaatctcaatacagacattgttttccttcagaggcttacagtttcattatagaactcaaacctactgtaatcacaagaaaagaaatgctcaaacaagaagtctcaagtaagtgaactaggtttttcttttttcttttcttttttttcttttttttgagacacggtcttgctctttcacccaggctggagtgcagtgacgtcaacggctcactgcagcctcagcctcccaggctgaagtgatccttccacctcagcctcccaaatagctgggactacagacacatgccactacaacaggctaatttttttttattattattatctgtagagatggggtttcgctatgttgcccaggctggtctcgaactcctgggctcaagcaatccacccgcctcagcctcccaaagtgctgggattacagaggtgaaccaccacactcagccctagatttttcaaatacaaaagatataccataggggaagtacattccagcccaggagtcaaggaaatcttcctagaggaactggaatgtcaaggatcaggaggacagcaggaggcagaaaaggcagaaggtcagagagtacatttggggtcatggaagaagggggaaaatagatacacaactttggtttttgtattattttgtttttttctgagacagggtctcactttgtcacctaggctggagtgcaatggcgtgatcttggctcactgcaacctccacctcctaggctcaagcaatcctcccacctcagcctcctgaatagcagggactacaggcaccaaccgggctaatttttgtatttttagtagagacaggatttcaccatgttggccaggctggtcttgaactcctggcatcaagtgatctgcccacctcggccctcaaagtgctgggattacaggcacctggccacaactttgatagtcaagggaccctttgatgtcaattagaaccatctgttgtttttataattggaaaaatggggctcagggaagtccagactttggtcacagtaagtttcttcattcattctaaaaatattagttgagctttactatgtgctgggctctgtgctgggtgttcataatattatggtgagcaaaatagatacagttcttgcctttgtggtgcttatagtctagaagggaagtcagacattaatcagtaatcacatatataattactaaccgtgatgagtgttctgaaagaaaactacgagatttagtgagatcctattaaaagatatcagatcagggctgggcttggtggcttacgcctgcagtcccagcactttgggaggccgaggcaggtggatcacctgaggttgggagttcgagaccagcttgaccaacatggagaaaccctgtctctactaaaaatacaaaattagctgggcatggtggcacacacctgtaatcccagctacttgggaggctgaggcaggagaatcgcttgaacccaggaggtggaggttgcagtgagccgagattgcaccattgcactccagcctgggcaaaaagagcgaaactccgtctcaaaaaaaaaatatatatatatatcagatcagatccagttggagccgtagaacacttaaggaagtaacactcgatacagtgctcaggctggagagaaagggatgatgggagagaatttcaagcagggaacagcatgaacaaaaactctgaggcaaataaaaggattagcacattcaaggaactagaagaaagccagtgacatacagaataagagagaataacagattactctggccgttaggagactgagagggtcttccacttaggaagcttttgcagttgttcgaccgtaagatgatggaggctttgacaagtgtggtggtgaagataataatgggtagacaaatgtaagaactattgaagagattgacagacttactaatgtaatagatatgggaggacaggaagagaaaagtctgtatttttatgggtgatttatgggcttctggcttgggcaaaagaagggctggtattgtgtgaagattgtaaatttggaatttgtttttttcttgtctttattgagtatatataaaaacatatttataaaatatgagtatgatagaaagtataataaggcaatgagccctctgagctatccctcaggttaagaaaaagaacaatgtgtttatctttgaggttccctctgtgcccttcactattccatcccattcctttttcctttggaagtaagtactatttggagattgcttcattgtctactttgctttctaatgttgtcagttttatccctaaactatcttctttagtttcccatgcttgttaatgttatataaatcattctgtaggtatttttctaaacttactttttgtgctcaacattgcactcctgaaaaacattcatatgatacctggagctataatttattttttctcaattatatagtaatatagtagggacataccaaaattttaatttttgtcgatggtgggttttttttttgttttcgtttttttttttttttttttttttttgggtgtcagggtctcactctgtcacccaggctggagtgcaatggtgcaatcatggctcactgcagcctcaaattcctgggtgtaagtgatcctcctacttcagcctcccatatatctgggactacaggcttacactaccacacctggctaattaaaaaaaaatttttttatagttaaggtctcactatgttgcccaggctagttttgaattccaggacacaagcaatcctcctgcctcagcctcccaaagtcctgggattacaggcatgagccactttgcctggcttgtgaagatttttaattactgaatagatttccttaatggtaattctaagtttatgtatttcttcctaagttttgttaatttatatttttctacataattgttcatttgctataagtttaatgttttggcattgtatttcttatattctttttttagttgctcccctatcttcattcatagtagtatttatgcattttctatttttttctagtttattcttaccagatgtctgtcagtttggaaacaaaattttactttaattcttttcattttgtttttatttaacccacagtgttcagaattacacattttttactctactggatagcagttcctcaactgtagccattatctttcaacttcccaatttatgttcttcctaacctgtattgtacttaacacaatattttcatggaattcaccttacttttttttttttacttaaataagtatatttatgtatttatttatttatttatttatttatttatttagagatacagtcttgctctgttgcccaggctggagtgcagtggtgtgatcttggctcactgcagcctccacctcccaggttcaagtgattctcctgcctcagcatcccgagtagctgggactataggcacatgccaccatgcccagctaatttttgtatttttagaagagacagggtttcaccatattggtcaggctggtcttgaactcctgacctcttgatctgcctgcctcggactcccaaagtgctaggattacacacgtgagccaccacgccctgccatttattttattttatctatctatttatttatttttgagacagagttttgctcttgatgcccaggctggagtgcagtggcgcgatgttggctcactgcaacctcaaccttttttgttttcaatttttttacttttgtagagaaaagatctccctgtgttacctgggctggttttgatctcctggctttaagcaagcctcctgcctcggcctctcacagtgctgggattacaaacataagccactggtctcagcaccataaatacatttataatgaaggaaaaaaaggcatgttgggagaaccaaaaggatagacaagtggttaacgcttagaaaggaagtggaaacggtgctagatgaggctgggaaggtatgcagggccagttgtatagactaaatagtgaacatgaaatttcataaataatcattagtgaatatttaacaagaatagctgagcatttaccctgagctcagtattcaagagctttacagatagggactcatcgagtcctcacaactaccctttggttagacagtgttttcctattttacaggtgatagtaatgggcatctgacatcaaaggctaaatgatttgtcaagaccgtacagctggagtcaatgacagagccaggattcagactcatgtctgtctgaatcaagtgaccaccacccagaattgatgcagtccatattctgggactataactgtgagacccagactcgggagggagtaggtgaagagggtgatcattaggaaaggggcaggtttgatgtcagggagtatggcttggtaactgttcccgtagtccacatgaggtgtagagggcctgaagtaaatcagccagcctggagaaggagatcgcatatcagtatgttgcacaagaggcataagtggaacttggccactgattctttttctgtccctaactttgcctaacacagtgacctgtgtaagatgtgttgttttggttttaactggaatgggtcatctatacctcttgaattcagattgatgtgtaggggaacaaatgcagactttggatccagaagacctggatttaaattcttcatctatcgctaataggtatatgcctttgggctagtccctaagcttcagtttccttgtaaatggatgtgataaagagcatttgtaaggactagacataataggaagtgcttgcagcgttcccttgaccctatatgtctgtctttacgctattaccacactgtcttggtcattgtcactttagagttgaaatcaggtaatgttctccaactcttacatcaacagttactctttttctttcctttttttttttctttgagacggagtgtcgctcctcgctcaggctggagtgcagtggcgcgatcttggctcactgcaagctccgcctcccaggttcacgccgttctcccgcctcagcctcctgagtagctgggactacaggcgcctgccaccacgtccggctaattttgtttttgtatttttagtagagatggggtttcaccgtgttagccaggatggtctcgatctcctgacctcgtgatctgcccacctcagcttcccaaagtgctgggattacaggcgtgagccaccacgcccagcctacagttattctttttcaagattgctgcagcaatcttgttatagctgcttctgctatattacagttataactattgctagtattaacattagtaataagagacccataaagatgggtcaacatggccaaaactggctttttttttcctatcacactcactcactttcctgtgttatccaccttgcataatgttaccatttgcccaggtgtctgagccacagacctgagagttgtgttcagctgttctttcctcctcacccagcctctagccttgcaggacttgtctgttacctctttgtatgtgctgccctttatgcagaatgattgttcctcttccaccctctttcacctggacttgcccattcaggaggcctgatctgattctcccagttaatccctcttgcatctcatatctcatagcacggtgtgtgtccctctgttgaagcacagttgttttgtaattagttgtgtgtctgtctccaccaccagcctccatgctggaattaatgttgattgtatcctcagaaaacaacagatagagttcaggcttgatgaaagtttattgaattgtggggtcataaatctagtcttcagacttcccctccactatctctgttgtccacctgtgagaattcagaatggcaaatacttcttcccaaaaccatacaccctggttgctgcatcttatcctgaggagagatcggccaagttacaactgaacatgaaagtttatggcttgaaatggagcaacggaagtgtaagataagggaatttgagggaacagagtacatgtaaagaggtacaagtcttcacagtgagattttgttgccctacaaccttttctggggaagaatgggcatcctcagtggggatgtaagaactcatgtattcaaagcttcctggatcctctgctttgacattgagcagtgatatggttaggctccgtgtctcatctcaaattgtaatgcccacatgtcaagggagggacctggtgggaggtgatcggatcatggaggcagatttctcctttgctgttcttgtgatagtgagtgagttctcatgagagctgatggttttacagtatggcacttcccccctcgctcgcttgctctatcctgccaccgtgtaagatgtaccttgcttccccttctccttctgccatgcttgtaagtttcctgaggcctcccagccatgtggaactgtgagtcaattaaatctctttcctttataaattactcagtctcaggtattctttatagcagtgtgagaatggactaatacaagcagcagttgaagattagtagcagtaaaaggaaccaagttagtcccaacctgttgctaccaccactaccatcatagctaaagagatagactggccaggcacagtggcttacgcctgtaatcctagcactttgggaggccgaggctagtggatcatgaggacaggagattgagaccatcctggccaatatggtgaaaccccgtctctactaaaaatacaaaaaattagccgggtgtggtggtgggcgcctgtagtcccagctactcgggaggctgaggcaggagaatggcgtaaacccaggaggtggatgttgcagtgagccgagatcgcgccactgtactccagccaaggcaacagagcgacactccgtctcaaaaaaccaaaaataatagattgaaataaaacgggcagctgttggtctaaagccaaggtatgagaagcatggcagctctgctgtggtccctgtcctgtgagccaggtgaatctcatcatttcagaagttctctctttagccttaaagccactacatcagcactgttactgctttatccagcccctcagctttcaggagcattgttccataggtcattgcaggctgagtgcttcttggtgggattagttctgctgcctctaccacgtaggtaatgcctttgttccagactgtcagttgtttaattgggaagagtgtttgcttcttgctgcactaggtctgagctggatccctgagttttgccaggttctaatcttgcattttctgtatcccattttcaggaagatctcttagctgtttgttcttctaggatacagttgaggacagagttgcaggaaaatgtgatggcccaaaagaaagcaggaaggaaggaagagagggcttctagtatagagtgatctctgctttcacctgcaggtcactgctgaaactcaagagaaagaagacgttatcacacatttgcaagagaaggttgcatccttggagaagagactagaacagaacttatcaggagaagaacacgtgcaagaactcctgaaagaggtaacttctgttctctttgggctggctggtgttggaaaggcagggttgattctggtgacttcacaattcctagagtttcagagctgtagggccagcaaacagcatggtaacaaaagaagtgtctccaactttggcttgtcctgcttacatcagaaagagccttatgtcccctgtgggtgacatgcttttctcagggaaagggagagctgtattcagagatacatacaaacggatagcatctcatcaccaataaaccacacctagtgatttccgccacttgggctgccttgtctttctgcactgccctcttccccaccattttgtactctgcagtggccaaggtaaatagctacatctgccccttggcaaaagcaagaattaccttgggcagcattctctccttcccaagggaggctgttgtgcagactggcctcttccccagtggtgcaagggaactttctcatcaggctgagctcattgtctgcacacattctgctcttccctctctttctgttccagtgattggccacactgtgacaaaggtgacaaagcccaggtcatgaggctcctagattagaccctccctttctttcttcagtcagtttcaactaaatacctccatctccagtgccactggttgtacttcagggtttccagcaaatctagcctagtctatgttagaagtctccagattggcctacccagcatcagtctctcttccttcactctctgacacagtctcccacgctcactgccaaactgatcctcctaatcagcactggtgaccatatcactctcttaaacatcttctacaattcccttcaacagtctacaggaagtgtaatgtgggttctagggaataaattgatttctagaatcagaatgtccatgcttgcattttgcctcttctgcttaccagctttgacttggagcagcagttcccaacccttttggcaccagggactggtttcgtggaagacagtttttccacagatggggtcaggttgggtcgggtgagggggtggtttcagaataaaactgttccacctcagatcatcatcgtccctagattctcataaggagtgtgcaacctggatccctcacttgcacagttcacaatagggttcatgctcctatgaaaatctaacaccaccactgatgtgactggaggcagatcttaggtggtagtgcttactcaccactcacctcctgctgtgcggcctggttcctaacagactgcaaggtctgtggcccaagggttggggacccctgacttagagcaagtaatttaatctctttgtgtttgcttcctccccaataaaattggttttattatactattaaactcagaattgttgttagggttaaataagttacaatatgtgaagtgcttagaatgataaccggaacagagtagggtctcaatgtatgtcagctgtaaacatgatcaatattattattgtgccatcatcattattataatgtttaatgtgcatagaaattacttgggaagtttgtttaaagtatatatctctaggccaggcgtggtggctcacgcctgtaatcccagcactttgggtagccgaggcgggcagatcacctgaggtcaggagttcaagaccagcctggccaacatggcaaaaccccgcctctattaaaaatacaaaaattaggccaggcgcggtggctcacacctataatcccagcactttgggaggccgaggcgggcggatcacaagatcaggagatcgagaccatcctggccaacatggtgaaagcccgtctctactaaaaatacaaaaattagctgggcgtggtggcacatgcctgtagtcccaagctactccggaggctgagggaggagaattgcttgaacctgggaggttgcagtgagctgagatcatgccactgcactcctgcctggtgacagagcgagactctgtctcaaaaaaataaataaataaataaattagctgggcatggtggcgggtgcctgtaattctagctactcaggaggctgaagcaagagaatcacttgaacccaggaggcggaggttgcagtgagccaagatcgcaccactactttccagcctgagcgacaagagtgaaattccatctcaaaaataataaataagtaaataaagtatatatctctggccctaccctcagaaattctgatttccttaggcttggagcaaggcctcaaatctgtgcaactagctgagattaacaactatctcagtaacagctatctcagctaagtctacatttctttttttttttttttttttgagacggagtctcactctgttgcccaggctagagtgcagtggcgtgatctcggctcactgcaacctctgcttcccggggttcaagtgattttcctgcctcagcatcccgagtagctgggactacaggtgcacaccaccacatccagctaatttttttgtatttttagtagagacagggcttcaccatgttggtcaggctggtctcgaacttctgacctcgtgatctgtccacgtcggcttcccaaagtgctgggattacaggcgtgaaccaccgctcccagccccatttttttttttaagacagagtctcactctgtcacccaggctggagttcagtggtacaatctctgctcactgcaactccgcttcctgggttcaagtaattctcctgcctcaacctcccaagtagctgggattacaggtacccaccaccacatccagctaatttttaaaatatttttagtagagatgggatttcaccacgttagccaggctggtctcgaactcctgacctaaagtgatctgcctgcctcagcctcccaaagttctgggattacaggtgtgagccaccacacccggcctagaatttctactttgaaaaatgttgcttacagaatcaagttctaactcctttttgcaacattcaaaagcttctcatgagctggcccttttgcctatctttctagtcttgttttttgacctaaacccatcatcattttggcttctgaggagtagtagttccctcaacgtagcaggctgttcacatagccgttggtcatccccctgcctgggaggctccctgaaccctaacgactttgtgagttctaaagctgcctacctgccctgtggcagggagtatctcccaccctgtgcttcttcctctttgtggacacttactgtactctattgtgtaattttttattagtcttttgttccagcctcaaggtcaagggactatttcaaatttatctgtgtgtactttatgatatgtgaattatttctcaattagctgaattattaaaaatgtattcatgtctcttgtgcctagcacaagtcacaatatgttgtagataatctgtaaatatttattcaactgaggaatgatagtcttcttttactcttctttcaacttacagaaaacacttgctgagcagaatttggaggataccagacaacagctcttggcagccagaagcagccaggctaaggccattaacaccctggagactcgggtactgaccttactcctggtgtttcctaagtttgggtggtaacctggctgaatggcaacatggtgtgactgagaatcttcttggtcagagttttttcactagaagggattatttttggatcttacctatacagggatgagttagtcattttcttcatccttgtcacattactatgattgagttatatgtttatttatacccttttatccccattggcctccctcccataggataccattccgttgtggttcatatagatgctctttttgttgggttgccttaaaatatgtagcactgggtttttaatttctgtaaatgatgcagctatgggtatgttttctctattacttttagctgcctcaacttctgtctgtacccacttcattgtactttgtagttatctatgtggtagacatccagattgcttccttcttcctgccacctcagatcatgcataaaacctaaagagactaagtactataggagaagattgttcccagcaagcctgcacctggctctcctcctccagcatgcatgagcgttcctatatatgcctttctgacttttccagcattggcatttccaagcctttacaatttttgccagtttactgagtgtggagtggtatttcattgctttaatttgcattgctatggtgattaatgagtttggccttgtcttcatgtgcctgttaattcctgggggtttctgcttttggaattgcccattcatatcctttccttattttctttgggggtttcagtcttttcttatttggtttgtaggatttcattgtatattcttgttcctaatgctttatcagtttcagtcctgagtcattctgttaactttgtccatgtatcctttgttgaatagactttcttaagttcagtgttaccagattcatcacatttttgctgtggagtttgaagttccatttagaaaatctattcctgttcctaagtcacagagatctactgttttttccctattaactttataatttttccttcacataataaatctctaattcacttacaaactgtctttctgtatggtcttaggtagggatctaaatatggagaaattctgcatatttctcaaaatcatttactaaacagtctgtcctttctgaattgattcctcttgctaactttatcacgtattgtttccgtctgcacatgggtttgtctctgcattctctgtccattggtctgattgtctgctcttgtgtaaacactacaatgtttttattactatagtgatatctgtactatatctcaacacccaataagacaaattctctttttttttcaaaggttgactttaactatttatgggcctttaaaatttttaagtttttgagttactaaaaaattcaacttgaatttttattgggattgcattaaatgtataggctaattgggaaaaattgtccattttataatattaattattccttctaacaatgtaaatatattccatttattcagattattttctgtgtgttttattaaaattttacatttttctcaatagatgtcttattttcttgcctaagttgctaattcctagaaactttagagtttgtgttgatactgtgatggtatcttttttttcttttgagacagagttttgctcttgtcacccaggctggagtgcaatggcacaatctcggctcactgcaacctccacctctcgggttcaagcgattctcctgcttcagcctgccgagtagctgggattacaggtgtccagcatcacgcccagctaatttttttatatttttagtagagacagggtttcatcatgttggccaggctggtctcaaactcctgacctcagatgatccgcctgccttggcctcccaaagtgctgggtttataggcgtgagccaccgcgcccggcctgtgatggtatcttatttttaatctttctttttttttgagatggagtctcactctgtcgcccaggctggagtgcagtggcactatcttggctcactgcagcctctgcctcctgggttccagcgattctcctgcctcagcctcccaagtagctgggattacaggcacgtgccaccacgctaagctaatttttatgtatttagtagagacagggtttcaccatgttgaggctggtctcaaactcctgaccttaggtgatccgcctgccttggcctcccaaagtgctaggattataggcatgacccactgcgccaggcccttatttatttatttatttatttatttatttatttatttatttattttttggagacacagtctcactctatcccccaggctagagtgcaatagtgccatctcggctccctgcaacctccgcctcccaggttgaagcaattcttctgcgtcagccttctgagtagctggaattacaggcacgtgccaccacgcccgactaatttttgtatttttagcagagacggggttttgtcatgttggccaggctggtctcgaactcctgacctcagcctcggcctcccaaagtgctggaattacaggcacgagccaccacacccgaactttatttttaatcatatttataattggttatttctggttattctagagaactgccattttttaaagttgatcttggatatcacacccctgctgaactttcttactctactactgtgtgatttttttgttgtttttcttaggtagataatcatattatctatgaaaaaatgacaactttatcttactccttccaatcttcccacctcttattccattttctgttcatatagcattaaagacctccagactgagtgaagcaataaaagggttagtgggaatctttgttttgttcccagtcttaaaggaaatatgcctaaagtttcattatttggtgtaacatttgcaggtttttggtatgtatgtatttatttatttatttatttgaggcagagtctcactctcatccaggctggagtgcagtggcatgatctcggctcactgcaacctccgcttcccaggttcaaacaattctcctgcctcacccacccaagtagctgggttaaaagatgcctgcctccacgcctggctaatttttatatttttagtagagacggggtttcactatgttggccaggctggtctcaaactcctgacctcaagtgatccacccatctcagcctcccaaagtactgggaatacagcaccatatatttatttatttatttatttttattttattttattattattttttgagatggactcccgctgtatcacccaagctgtagtgtagtgtcctgatctcagcctaccacaacctccgcctcccaggcacaagcgattctcctgcctcaacctcccaaagagctggaattatgggtgtgtaccaccacacccggctcatttttttttttgtatttttttaatttattttattttatttatttttttttttttgagacagagtctggctctgtagcctgggttggcgtccagtggtgcaatcttggctcactgctctctctgcctcctgtgtcctggttcaagcagttctcctgcctcagcctcccaagtagctgggattacaggcatgtgaccatgcccagctaatttttgtatttttggtagagacaaggtttcaccatgttggccaggctggtcttgaactcctgacctcgtgatccacctgcctcagcatcccaaagtggtaggattacaggcgtgagccactgcgcccagcctttttgtatttttagtggagacggggtttcaccatgttggccaggctggtctcaaactcctgacctcaagtgatctgcccacctcagcttcccaaagtgctgggattacagatgtgagtaactgtgctggccaatttgtttaatttcttgaattgaatatttatctcatttttaaaatctttcttatttcctgataaatacattttaaactatatttttctgaaaagactgttttattataatttcaattctgtttctgaatatcctttttgatcagtgtacattgtcgtacaaccatcaccaccatccatctccaaaactttttcatcttcccaaacagaaactctatacttattaaacagtaactccccaattcctcctaccccagtctgggaaccaccattctattttctgtctctttgagtttggacactctagatacctcctgttggtggaatcatacaatgtttgtccttttgtgtctggcttatttgacttagtatatacatcttcagtgttcatctatgttgtagcatatgtcagactttcattccttttttttttttaacagaattttttttttttttagaatttttttgagatggagtcttgctccgtcatcaggctggagtgcagtggcacgatctcggctcactgcaacctccgcttcctaggttcaagcaattcccctacctcagcctcccgagtagctgggactacaggcgcgcgcctacaggcacgctccaccacgcctggctaattttttgcattttagtagagatggggtttcaccatgttgaccaagatggtctcaatctcctgaccttgtgacccgcccacctcggcctcccaaagtgctgggattacaggtatgagccactgtgcctggcctattcctttttaagactgaataatattccattatatgtatagaccacattttgtttctccattcattcattgatgaacacttgaattccatttgtcttttttttttttttttttttttggtctttttctcccctttttgtggagaacagggtctccctatgttgcccaggcaggtctccaattcctgggctcaagctatacctttgtttccctaagtgcttggcttgcaggcacgagcccccgttctgtaagcccagtacttagggaggcaaaggcatagcttttttttttttagacaaaatctcgctctgttgcccaggctggagtgcagtggtgcgatcttggctcactgcaacccccaccccgcaggtttaagcagtttttgtgcctaagccttctgagtagctgggactacacatatagaccaccacgccttgtatttttagcagagatagggttttgccatgttggccaggctggtctcgaactcctggcctcaagtgatccacccgtcttggccttccaaaatgctgggattacaggcataagccaccgcacccaacccacacccagcttttgatggacatttgcgttgtttctatcttttggctgttgtgaataatgctaccatgaacgttcctgtacaaggtttttgtgtggacttagtgttttcatttctcttcagtgtatacctaggaataaaattgcagggtgatatggtaactttttctttaatctcttgaagatctgaatctatcttgaacttggcttctaaattgagacttaggtattttctgatctcaggagtgtaaaacaacgtcttagttttggcgctaccaccaataaaatttgcagtcatgagctagtaacaatcctgttcttctccgtggactagtagcccctttctcatgggattgtttcggttaaatctaagatgtgaatgtatgtgaggagcctaggccttaaaaacgtcctctccttggctggacacggtggctcatgcctgtaatcccagcactttgggaggctgaggcgggcggatcacaaggtcaggagatcgagaccatcctggctaacacggtgaaaccctgtctctactaaaaatacaaaaaattagctgggcatggtggcaggcgcctgtagtcccagctactcaggaggctgaggcaggaaaatggcgtgaacccaggaggcggcggagctttcagtgagccgagatcgcgccactgcactcaagcctgggcgacagagcaagactgtctcaaaaagaaaaaaaatcctctccttgtgtgtctacctctccttcaccaagctgcatacagccttccttgtgcttatgtttaataataaagctccccagctgggcgcggtgaatcacacctgtaatcccagcactttgggaggccaaggcaggcggatcatgaggtcaggagatcgagaccatcctggctaacacagtgaaaccccgtctctactaaaaaatagaaaaaattagctgggtatggtggcagttgcctgtagtcccagctactcaggaggctgaggcaggagaatggcgtgaacccgggaggtggagcttgcagtgagccgagatcatgccactgcactccagcctgggcgacagagcgagactccgtctcaaaaataataataataataataaagctccccaaggccagaccttattcagtaaataagaaggctttctaagagaaattcatagatgtagcttgaatctggtaaaactgccatcttggagagccaagtgcaactcagtactagacagtgagtccctgagggccagtctacatctgtcccactcacggcactggcctcgtgcccaggtgcagttcctggtatggagtcagtcttgctcagtatttgtggaatgagtaaatcctgaatttgtattgtgaacagtaattccacttcaaggaatctgtcctaaggaagtgattcaaaccagttaaaaaaatactgtgtgtcctggccaacatggtgaaaccccgtctctattaaaaatacaaaaattagcaaccaggtgcggtggctcatgcctgtaattgcagcactttgggaggccgaggtgggcggatcacgaggtcagcagatcgagaccatcctggctaacatggtgaaaccctgtctgtactaaaaatacaaaacattagctgggtgtggtggcatgtgcctgtagtcccagctactcaggaggctgaggtaggagaatcacttgaacccaggaggtggaggttacagtgagccaagattgcactactgcacgccagcctgggcaacagagtgagactccatctcaaaaaaaaaaaaaaaaatagctgggcgtggtggcatgcgcttgtagtcctagctacccaggaggctgaggcaggagaatcgcttgaacccagcaggcggaggttgcagtgagctgagatcacgccactgcactccagcctgatgacagagtgacactccatctcaaaaaaaaaaaaaaaaataggccgggcatggtggctcacgcctgtagccccagcactttgggaggctaaggcaggtggatcacgaggtcaggagatcaagaccatcctggctagcacagtgaaaccctgtctgtactaaaaatacaaaaaattagctgggcatggtagcgggcacctgtagtcccagctactcagaaggctgagggaggagaatgacgtgaacccaggaggcggagcttgcagtgagtggagatcatgccactgcactccagcctgggcgacagagcaagactccgtctcaaaaaaaaaaaaaaaaaaatactgtgtgaagatgttaattgctgcattcttttagatgggaaaaacagaaagcctaagtaggcagcacagtaggcaaatgggtcagtaaattacaaaacactctagaggaaataataatctgaggtctaaagattacatggagacagaaggacatttaagagtagggaaaagatacaaagttttacattgtcctattaaaactttatataaagctataaacaaaagtcattaaaagagagtttaagaaaatacgttagaatgctagtgttttataatggtagacttatgcagtatcttttttctcaggttacatttttctataatgtacctgttttatttaaatcgctttgcattttaaagccatttgttaccactcttcagcttcttgtgaacagaaagaatgcttctgcttccctctcaggtgagagaactggagcagaccttgcaggcctctgaggagcagctccaacagagcaagggcattgtggctgcccaggaaactcagatacaggagctcgtaagtgcttattggagctgctgcattccaggcccttaatgctttctctccaggcctttgcagatgctccaaactcattccgaacttcggcaacggtacctggacctgcccatagatacagttcttgtgctggatgtgagcaggccagcagcagggggtggagggagtcaggacctaatggtcggcctgagttacctgggaggtgcaccagcagctcctttccaccttacatcccaccttctggtccagcctggtcctggggctgtcagaggtggcagctccgctaggagtcaagcctcaacttgcaatcaggggcggggagaacaagtccagactctggggaggatggcctgtgatgacaggccaagcgtggtgtggagttagaagatagggaaatcaaaccagccagcgtgtatttcatattcgccatgtcccaggcactgtgctcagtgctatgcacgtgttttcgtttagtccttgcaggagacctgagaattatgcactgtcatcctcatcctgtagacgaggcaagctcagaaagattggctcagtagcccacaggctcgcagccagtaaatggcagaatccacatctttctcctgtcaaagccctgttcttcattgctgtattatactgcctccccagtataatttctccccagggaaagccgcagccactgaggcaacactgagtagtgtgaaggaggcctgtgtctaagggctggctggtgcccagagctgtccccacacaccttgaggatggagtgatgacatcaagactccatcttctggacaggccagggtccaggagcaacaggcagagcctgcaggggggacctcagcaacgccaggggggatggggtcaggagagagttgtttctgttggatactcatcttctcacctagggccagactaagatcccccactggaaaccattgtcaccctgactgaccgtcctttggtctccccgcaggctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatggtgagtgaagagctaagagagggtgggcccaggagcaccagggtcccccacagcgaagtcagcctcgtgcttgacagtgtggcaccgcctctgcactaggaaaccactttagaaggcagctttttttttgtttgagacagggtctcactctgtcacccaggctggagcacagtggcatgattacaactgactgcagcctcgacctctcagactcaagtgatcctgccacctcagcctcccaagtagctgggactacaggcgtgcaccaccacagccagctaatttttaaattttttggagagacaaggtctcactgtgttgcccaggctggtcttgaacgcctaggctcaagggatctgcccacctcagcctcccaaagtgctggaattataggcatgagccaccgcacccagccgagagcagttcttatctttccagagacacctgctcatgagactggatgtataaaggctgctttttataaaacaaaacagatgggttttctttttccttggagtttccacagagacttcctactttctgaccagtcccctctgcttcttcccattggcttttaaaatgtatattgttcctccctatgccttcttcctggtccatgctccctgtgcccagggaaatatggtagtgaagacttcttttatatgtgttcttctgaattggcagagacaactggagcaagaaaatgcagcccttaaagaatgcaggaatgaatatgaacgttctttacaaaatcaccaatttgaactaaagaagctgaaggtatttatctaattgaatcaaagtttcataaaagtgttcatgttttctacatgtgtatttacagtgccccacttctcatacttacagtacaggaggaggagaattagcatttgttcaatagttctgttaggcatcggccagaaattgccacttcattaagttctctcagggatccaggacagtaggaagaattacattcatttggcagttaatgtcattgaggttccgagggtaaaccgtttgtgcaagttgcatagttggttagaggtgatgctggtctgacttcaccctaccacagaggccagcccttcctctgtggaatcaacagctgcttgaaagtcatgctgtcaaaacactgctcttgctgatatttccagggagaccttaaagcaaggccttaaaagatgataaggacctttgttttgcttgtttatatcagggaccatgtacagaaatgaagaaacaatctgctggattgttaaactttctcttctgcaaacttggagctttaatcagaggatgcctctttcattccctaaacataactggataaaaaggaggaaagattctgtcactttcttatatgcccccagactcccgtggcccctttcaaagcaccttggataatgggacattgtagtacttgcccagcttggtcatgactcaaagatcttattgatcccttggcagcagtcttctctgagagtgtccatagatgaatgcctgcacctagtaagcttccagtaatcagatctgatgagtgacataggtactaatgtagtagcattgcatcatgagaagcatggactttggagtcagatttttttttcatgcattccttcaataaacatttgagtcctgtaagtgccaggcatcactgtaagtgctaggatgtattaaatagcaatgagccagtgcggtggctcacgcctctaatcctagcactttgagaggccagggtgggtggatcacctgaggtcagaagttcgagaccagcctggccaacatggtaaaaccccatctctactaaaaattcaacaattagcctggtgtggtggtgtgcgcctataatcccaactgggaggctgaggcaggagatttacttgaacccgggaggtggaggctgcagtgagccaagatcatgccactgcactccagcctgggtgacagagtgagactccgtcccaaaaagtaaataaataaaataaaataaatagcagtggaaaaaataggtaaagttcctttcttgtggagtttgtaactagagatggtaaccaagttacaaattaacaataaatgctatgaagaaaatagagcagggcaaggacagccaatggggaggtgggagaggagaggtctcttttccatatggagttagggaaggctttgatgctggcagaagggcctacaatgtgaatatttgaggaggaatattctagactgaagaaataacaaatacaaaggctctgaggcaggaaaaagcctagtctgttcaaagaatagcacagaggccagtgtggctgcagctagtggccaggggagagcatggctggtggtgaggcgggacacaggcattaaaaagaatcatgggaagccctggcaggtctttttttttttgagacagggtcttgctctgttgcccaggctggagtgcagtggtgtgatcacagctcactgcagcctcaacttcccaggctcaagcaatcctcccacctcagcctcatgaataactaggactacaggtgtgcaaaatttattaatttttcttttgtagagacagggtcttgctatgttaactaggctgattttaaactcctgtgctcaagcgatccactggccttggcctcccaaagtgctgggattacaggaatgagccactgctcctaaccagctatggcaggtcttaagcagataagtgatgtgagaagttttgttttaaaaggatttctctggctgcctgtgaagaatgtttggtaagggaggcatgagcagaagcaagaagactgtttaggagactttttaggaatctaggccagaagtgactagcacattagtggtggacttgggaagaagtattcagatcaggatttattttagagatagagctgttttgtttgctttttgttttttgtatgtgagacggagtctcactttgtcgcccaggctggtgtgtagtggaacgatcttggcctactgttacctcaacctcctgggttcaagcagttctcatgccccacctcccaagtagctgggactacaggcacgtgccaccatgcctggctaatttttgtatttttggtagagacagggtttcaccatactggccaggctggtctcgaactcctgacctcaagtgatccacctgcgttggcctcccaaagtgctgggattacaggcgtgagccaccatgccctgcctgagatggagcttttaggacttaggaatgagaaaaaaataggaattgtagatgacacctaggtttggtttgtataactcagagtttctccacctcagcgctattgacgtttgaggccggatggttctctgttgtagaggttctctgttgtggatggttctctgttgtggatggttctctgttatagagggtctctgttgtggagggtctctgttgtggatggttctctgttgtgggtgggtctctgttgtgggtgggtctctgttgtggagggttctctgttgtggagggttctctgttgtggagggttctctgttgtggagggtctctgttggggatggttctctgttgtggaggctctctgttgtggaggttctctgttgtggaggatctctgttgtggatggttctgtgttgtggagggttctgtgttgtggagggttctctgttgtggagggtctctgttgtggatggttctctgtcgtggaggctctctgtcgtggaggctccctgtcgtggaggctctctgtcgtggagggtctctgtcgtgggtggttctttgttgtggagggtctctgttgtggatggttctctgttgtggatgggtctctgttgtggagggttctctgttgtggatgggtctctgttgtggatgggtctctgttgtggagggtctctgttgtggatggttctctgttttggatgggtctctgttgtggaggttctctgttgtggaagttctttgttgtatttgctgcaaatatgcatgataagatgcttaggagcatctacccactagatgtcagtagcagccccacttaggacaaccacagtgtctccagacattgccaaatgtctcgtgggggcaaaagcactgctggcagagaaccactggggtaactgaatgaatagggtacgtaccattcactgagatgggggtcctgggaggtatgtcaagagtggattccattttgggcatgttgagcttcagaggcctacccaacaggcatatctagtagtctgtaggctgacaagtctggaaaattggagcagattctgagtagacatataaattaggaagcctgtgtgcctatagttccagctgcttgggagcccaggaggcggagcttgcagtgtgcaagatcgtaccactgcactccagcctggatgacagagcaagaacctatttcaaacacacacacacacacacacacacacacacacaaaactttaaattaggaaaccatcaatcagcatagctcataggcaaaattacagccaaatggctatcaatgagtgcagatagaaaagaggccaaaatgaaggccagggccacacccacaagcacaggctcagaacaaaaggaggggccgacagagaagacgccaaaggagccgcaggtagggtagcagtaaaagcaggtgcatgtggggctctggaagtacagggcagaaagcgctacaagaaggattgagtagtgaactctgtgatatgctgccaactggtcaagaaaggagacaaagagctgaccattagatttgacgagactgagtttgttggcaacgctgggaagaatagtcaccgtagagtcgtagggaatatggttgacgagagcaggttaaaatgagactagagagatgcttccacttgcagtaaaggcaaactaggtaattcagaccagctcacctgaggactcccagaaaaactggccaaaataagagaacatctgcttgtaggagcctacaggactgaggaatggcccatcctgcccagggacgggagtccagcatgcaaagcagcttttgccgtggtggtatctgctgatcctgaagaggctggaagtttatctaagtttttcatagtttctcagagttaggggaataaaatttggagtttaaattttattaaagcttggatccagcctgggagatcctgaaagctttggttaggcacaccacaggactacacgctaggagtaagcttgaacgggaagtaaccagcaccccatctgcaccccgcccccagctttgattgcactaactgaaggacacggggtggcccaggaaaagcccattagctaattttggattaaaatgatcccaggttattagtgctcctgggtgactagaaaaaacaaaatcaaagataggtaaacaaaaatacaaaacaacacaaaagaaacagactcacaagggctcagatatcatatgcttactatgtttaaggagataaaagacaaaatttaaaatttcagcaagatgtggaatagttctattattatagttatgataaaagacagcagttttaaaaaaggaatcaaatagaactttagacctgaaaaatagaataactgaaattaatacaataaattacaaaaggacaggaggaagctttctgggggatgggtatttttactatttttattagggtgatggtttcatcacagttcatcaaggcatacacctgtagtcccagctactcaggagactggggcaggacgctctcttgagcctagaaggtcgaggctgcagtgagctatcatcacaaactggactgcagcctgggtgatagagcaagaacccatttccaaaaacataaaaatttaaatgtaaacatatagaaaactcttatatgtttacatttaagaaatacactttcttttttttttttttttgagatggaatttctctcctgttgcccaggctggagtgcaatggcgtgatctcggctcactgcaacctccgcctcctgggttcaagcgattctcctgccttagcctcctgagtagctgggatcacaggcatgcaccaccacactaggctaattttgtgttttcagtagagatggggtttctccatgttggtcaggctggtctcgaactctcaacctcaggtgatccgtccacttttgcctcccaaagtgctgggattacaggcgtgagccaccatgcccagcctgaaatacactttcaaataacccataggtcaaagaaaaaaatcacaatggaaattttaaaatattttgaaataaagttgggcacagtggctcacacagtgagctgagattgtgccattgcactccagcctgggtgacaagagcaaaactctgtctcaaaaaaataattataatattttgaaataaatgattttgtaaatactgtggatcaaaattggtcaagtataactaaagcagtgcatggaaggaaatttcagtctcagtggcatctcttaggaagaaagcctgaaaattgagccatgtatgcatctcaaaaagtcagaagaaggcacaaatcaaactcaaggaagaaataacaaatataagcacagaaattaatgaaatagaaaataaaatgggcccggcgtggtggctcacccctgtaatcccagcactttgggaggccaaagcggatggatcacatgaggtcaggaattcaagaccagcctgaccaacatggtgaaagtccatctctactaaaaatacaaaaattagctgggcatagtggcacatgcctgtaatcccagctacctgggaggctgaggcaggagaattgtttgaacccgggagtcagagattgcagtgagctgagatcgtgccattgcactccagcctgggcaacaaaaatgaaactctgtctcaggaatgaagtgaagaagggagggagggaggctgggcgcagtggctcaaaccagtaatcccagcattttgggaggccaaggcaggtagatcacctaaggtcaggagtttgagaccagcctggccaacatggcgaaacccggtctctactaaaaatacaaaaattagctgggtgtggtggcacatgcctgtagtcccagctactcgggagggggaggcaggagaatcgtctgaacccaggaggcagaggttgcagtgagctgagattgcgccattgcactccagcctgggaaacaagagagaagctccatctcaaaaaagaaaaaaaaaaacaaaagaatgggaccctctcatagtagcgaggactgctgaagcctgaggtggattatttgaaggtgaataaaatcgctaagctctgggtgagacagatcaaggccatatttagtttaacagtctacttgttccatcagctactaagaagggtgtgctcagtcttccactacgatggtagatttgtctctttcttcctttagttctgtctgtctttgcttcatgtattttgaagtgctgctattaggtgcacatacatttagaattgtttttctccatccacgctcttcaaagcagctgttccctaagcccatcctggagaatcatcgcagaggcagccgtgcatgggtggcctggtggcttctgcaagctgcaggccctgctttgtgccacagtgaacctgagcaggcactgtcaaccccacctcccacagtgctggatcttacgtggctctgaggcgctagggcagactttggagccacagagactcagttctgtcttgtcagcctagcccctcactagctgatgcttgaaggaatccattttcctgcagccttgacctcccggacacaagcaatcctctcgcctcggcctcctgagtagctggcactacaggcatgtgacaccatgctcggctaatttttcttattgtttatagagacagatcctcactgtgttacccaggatggccttgaactcctgggttcaagcgatcctcccacctcagcctcctgaagtgctgggattattggtgtgagccaccgtccctggtcattacttcttcttctttccataaccaattgttccagtcccccactccattcacgtggcctgcgagtctgacttcttgttcttggctactgtccttagaccagctcttcaggataggcccctagccttggtgtgggtcctggcgggggtgctcgtggggcaatcgatcctcagtggtgtgccatttccagagaagtcggtgggttgcctgccaggatagctctgagagggatactgagggcatggcagggaggggccaggctgggagcctgggaagtggggagcatgttggtctggctctgcaaagccatgccctgtctgctgggcttcttgcgtggcatacagctaaaaaactgtgaactaagttttggggctcagtggttttctgcattgtaggaagaatggagccaaagagaaattgtgagcgtggccatggctcaagccctggaggaggtgcggaagcaaagggaagagttccagcaacaggtgggccctgtttcacgctgaggggcgatgtccccctgcagtcccacaggcagcaggcccatcctgccgtgagactgttggagagggcctgtctctccagggtagggtagtagactcaggactcagggaatgcagtcagctgcgtgggcccctgtgctctctaggaagctgggagacaaatgttataaagaaactcttaccccataggatgcccttttctgatttttcaactataattacctggaaagtggtccatgtccacgggcctagtgggctctaattctgtgaggtgacctatcattgcccacctgccccagaggccacgtaaggttgggttgagtttttgcaggaagtatgggaaagcctcccttgaaggtagactttgcatctgaccccagagcttctagttaagtggctttaggcctttggtaagtccttaacaaatctgagtctcctctgatgaggactctagccttctacttacacctctgggaaactattctgtaatgaggcaacatatatcaaatgcgtgtctagtgctggggatgttgcaggcactcaggaaatggaagttatgacagcttgttgggctgggcagaatggccacgtctctggttgacccactgttggccagggggcagtgggaggcgactgcccctgtgcagggcccctaccaaggagaatagatttgtgcatgttcataggagcagagcttagctgggggtttgctctgggtcgtggacttcagggagggattcgtggtgtaccctggagagcggggaagtggagatttctgtgggaagatggagtcactgctcacaaccttccctcttgttgatttttctctccaaggcagctaacctgacagccataatagacgagaaggaacagaatctgcgggaaaaaaccgaagtgcttctccagaaagagcaggagattctccagctggagcgaggtgaggagtcggtccctggctgagccttctctccttttcaggcccagcatcctgccttgtgacggccttgccaccaagcagcatggagtcactgggctcacagtgccccctcccctcctccccgacctaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtaagtcccagctgcacctgcatgggtgctacagcaagatgcagggcaggtgccgagagtgcccctaaggaggcagcagtggggacacatggtggacacgacgctcccctgcatgtagggtcctttctttgaagtagggcacttggccaggcgcagtggctcacgcctgtattcccagcactttgggaggccgaggcgggtggatcacgagttcaggagatcgagaccatcctggctaacacggtgaaacccagtctctactaaaaatacaaaaaattagctaggcgtggtggcgagtgcctgtagtcccagctactcgggaggctgaggcaggagaatgatgtgaacccgggaggcggagcttggtggagccgagattgcgccactgcactccagcctgggtgacagagcaagactccgtctcaataaataaataaatagataaataaataaagtagggcactcatatggctaggaggccatgagtcctgaagagcccatcacagatggcacccctgtcggtaggcaggggagagcaagccccttcatcccagcaaagactagtcgtgtgattagttgtgggcattgggcattggatcttctccaggaattgcttcctggccagttgcctgttggagcacaacgcccatacctaagggacgagtctagctccccttccctgtgtacctgtggctcagcttcacctgacctgtcctggctctcaatttgctgctgccaccttgtaggtgacctcgagggccatgcaggaccctgtgttccagcttccaactgcaggaagaacaccaaatggtgaggttggggccatggatctcacacagctacagaaggagaaacaggacttggagcagcaacttctggagaaaaataaggtgaggatgccttttgcatggctgtttctgtctccaccaggtcctcaccctcaggcctaaaatgacccagtccatccttggaggtttttgtggtttcccccgcacctcctggcaaccatgacccctctcacccaaaggccttcctcctgatcttccgttcctcctgcactgtcctcctccacaccctccccagccctcttctccccacccgctggagaactggacaagtgtcaggcttgggcagctgcaagcctgcatgttccctgccagctctgctgtccccagccaggccatagcgacagtcctctttcgtctatacttcctttctacagctgtggaagtaaagcactgatagctgcctttaagggtttgtttgggtgggaggagggggttatgaaatgaaggtatttgtgaaccgtcctataaactttataaactctctggtatttggtagaggctcaataaatgtcatggtccccacccttcaccctccagcctttccacctatataaatgcaggatctcatttaatcctggttcttaaagtgtcctgtgaagcttagtgtgccagccggctattgctctggcctgacattctgcccccaaattgtgtgtgtgtttgtgtgtgtgagtgcacgtgtgtgtgtgtgtttagatcttttacaagggggaaagtgttcattatgtctaatataaaatacagaagctttgcagcagtggcagtatcgtagccaatgaggtctatccgaggcgcgattattgctaattgaaaaaaaaaatacacacaggaaagtgtacaaaacaaatgtgtgtctcagtgaattaacagaaagcagacccatgtaaccaccccgatgcgaatcaggatattgccagcatcccagaagcccagccccctgagcccctcccagccctgtcagtcactccgatcccagcccttctggcaatgactgccttgcttttttccctagtgtcacctcagctcgcattgctcaaccccacagtttcgttttgcctgtttgcaaatttcccgtttgtcccctaggacctccgtcccttgagcctctggccttaccagctgtgctgccttcctgcctccttgttcagcgtcgggtctgtgtctgtcacgggatcactgccttcccgacacctgcggtcctctggcctctctccctttcctcagactgtcctagccaagctctggttaaacttgggctaaacccaactcttccctgctccctgcctgcagccatggaggcagacctggctggagagtgccatcacctgggcattcaggtcccctcgaagctcaggaccatggtcctgcgggcagcccagtgttccccgcaaccccacctcatccgtgggccttcacgcccctctgcccctaaccccaacttcatgtctaccttctctcctctcttcacctcaaccctgcctcacccaccctggtgctcccacctcctgcttctctgagaagggacgtgccacagcctctcctcatatcctgttcccccacctccccaagcactacgccagccgcctcccccttcttgcctaggtcgttttttcttggaatcgtcccatctactgagaggtgcgccgttgtgcaggcaccttatgaaagccctcggcttgcacccctttgccctgctgctgcgtctctgctcacctgccgtgctgacatgttaaaacttcctatatctgccatctccattcccactcctcttctctctcaacctttcctccaccactccacagaaaaacactcttgtcaagctcatcagtaacatctgcactgctaaatccagaaggcagttcctaattttccctctgattggcctgttggcagccttggacaggcgtctcttcctcctcctgaagctcccatccatggcctgctccttctccgtctcctctgacaggccagtctccttcccactgccacccgccgtgcacaagggcagccctcacagctcttctctgcactgtgcgccctcctctgcgatctcagccatgccctgcgcagctgactcccctccctacctcccgcccagacagctccacggacactagcctcacaaacctgtctccacatgagctctaaggtgtctgaaactcaaaacatcggaaaacacacttcggcttcactgtgttccctggctgccatgccacctttcccatctcagtagacggcaaaagccttggagttgtcctatctgccttggttctttctctaccagcatccaggctgttagcagattccttcagcacccccttcacacatttcccagaatccaccacttcacatcgctgccacctgcttcaggttaccattgtctcttctctggaagatggtatcagacttctaactggtttccctggcactcttgtcttagccctctgatgaaagcctgtctctgttgatctcttatgaaagcctgagtccttgcagaggcccgcaaagccctgtgtggtgtggcccctcattacccctgccagctgagcccctcctgtcctcgtcactccctctcagccacaggggcctcactcccatcaagtaccctccaacctcagggccttggcacttgctgagccttccgtttggaagtgcctttccctggtcatcctcactttctttatgccaccctgaccagcctcaccaccagaaccccaccctccctcaccatgctgcctcttctccatgcctcttcataccctctgatacactgtggatttgattattgatttcttttttttttttttttgagacagagtctccccctgtcacccagactggagtgcaatggcgtgatcttggctcactgcgacctctgcctcctcggtgcaagcgattctgttgcctcaacctcccgagtagctgtgattacaggtgcccacgatcacgcctggctaatttttttttttttgagatggagtctctgtcgccaggctggagtgcagtggcgcgatctcagctcactgcaacctccgcctcccgggttcaaacaattctcctcctgcctcagcctcccaagtagctgggactacaggcgcgctaccacgcccagctaatttttgtatttttagtagagatggggtttcaccatgttggccaggatggtctcgatctcttgacctcgtgatctgcccgcctcggcctcccaaagtgctgggattacaggcgtgagccactgtgcctggctttttttgtatttttagtagagacggggttttgccatgttggccaggctggtctggaacacctgaccttgtgatccgcctgccttggctcccaaagtgctgggattacaggtgtgagccaccacacctggcctgtttattgattcttttcccctcgagggtgaacttttgacttttttgttgccgtttctccagcccctagaacagtgcagggactcagtaactattagatgaattactgagtgaggaaaatccaggaaaccaaaataacgtaagataaagtagccaatgtacttttggggcagtgtccagcctcatggtcagccaagagaatagaaatcaaagccacaaggtgccattttacaaaattgggtgtgttggaggtcacttaagatgcctcacagtggagaagttagaaactgtggtcttctgactcagtcattctatccccaagagaaacaatggggattcctcgcttggggaaacaaagcttatcccagctttgtttaaagtggaagcccagccacgcagtaagacaagggcatccccgggagttcctgtcacattagacattacaattaggaaagctggaggaggcagtgatgactctgatacatgaaaaatgtatttacaattccagccacgctgtgcaagaatggggatgtggactgggggtacatggaagaatgcattttgatatattaccattcagagactttgaataaatttttatttaaaaccgggcgtggtggctcatgcctgtaatttcatcactttgggaggccaaggcgggcagatcacctgaggccaggagttcgagaccagcctggccaacatggtgaaatcctgtctctactaaaatgacaaaaattagctgggcgtggtggcacacacctgtaatcccagctactcaggagactgaggtgggagaattgcttgaacccaggaggcagaggttgcagagagccgagatcgtgccactgcactccagcctcagggacagggtaagactccgtctcaaaaaaaaaaaaattttttttccctatattatgaagtttttagttgagaaaatgtctcagcctgtctagtgaataatggaatgtgtatggaatgtgtaataaatgtaaggctcataatactatttaaacatcaaagaaaattagccaggcgtggtggcgcacagctgtagtcccagctactcgggaggttgaagtgggagaattgcttgagcccaggagttcaaagactgaatccagcctgggcaacatagtgagatgctgtctcttaaagaaaacaaaaaaggccgggtgcggtggctcatgcctgtaatcccagcactttgggaggccaaggtgggtggaccacctgaggtcaggagttcgagaccagcctggccaacatggtgaaaccctgtctctactaaaaatacaaaaattagccgggcgtggtggtgggaaccagtaatcccagctactcaggaggctgaggcaggagaatcacttgaacccagaaggcagaggttacagtgagctgagattatgtcacctgcaatccagcctaggcaacagagcaagactctgtctgaaaaaaataaaattagctgggtgtggtggcacacaactgtaatcccagctacttgggaggctgagacaggagaatcgtttgaacccaggaggcggaggttgcagtgagccgagattgcaccattgcactccaacctgggcaacaagagtgaaactccatcttaaaaaaaaaagaaggagaagaagaagaaaaagacaaaaatgagtcgggcatggtggtgtgtgcctgtaatagctcccctagagcctgaggcaggagaatcacttgaacccaggaggcggaggttgcagtgagctgagatcgtgtcattgcactccagcctgggcaacagagtgagactccatctcaaaaaaaaaaaaattattttccaaattatttatctaaaactggatgttgatgagttgtgcagaaaaaccatgatctttttagggtgttcaaaataagcattgcagattattaatgtatttcaagagagcagtagtgatgagaaccgtaagtcctcgcctaagtatcctacttggggatcacagcataaaaatcgaattttgagggcaaaatctatggtccagagccttttccagctgggctgtgtgtggtggaccaagcccccgggaagggataggcagcgctggggcactcatgtcaacacagagggactgtggcccctgtgggacgtggagactcaagcgtgtgaaagcagtggcccaagagggatgacagcccaacagtcgtaggcacaagcatgcgacagctgagcaccagcctctcaggatgacttctcagggcagaggctcctcacaggtgtacaggggatcccgtgggatcttcgggtctgtttcctttggtgaaacatgcatctaatgattggctttctgtggggtggggcttgtcgcagaccataaagcagatgcagcagcggatgctggagctccggaagactctgcagaaggagctggtgagtactcgcatgggagctggccccacttcccagcactccccctgctgcctgtgcccggtcctcctgaggtccctcgccgcctgactatgctccctccaccccctaattaattgcaagggatcgctgggcaatccaacgttagctggtgggacagcctgccagcctgcatgcacctctgaagcagctccgtggctacagccctgttcctgccttctctgagcctgcatcctcatctggaagtggggttgcctgccacgccagcgcagtgatgctctaacagtgtgtgtgtgtggcagagtgcttggcctgatgcgggatgcgagcagcttcaggccccagggacgtgtgttcttgccatggaaaacggaatgtctgaatttacccaaacgatgtcactccctcctcaagcctacctggaggtgcttccttcccaggtggggccctttttgccctacgatagtgatcatagtttggaccaggtgaacctcccgtgtgattttttccacctgtctcagagggttcggtgtagcatctttcccactggtttttcagaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggtaaagggcttttgaggtgtcttttgggtattgaggccccgccctacagtctgtcctgcagggacccctgcccagcccctttctctcttttcctcgtacatcctggtttgacgcccttgtggtcacccagtcatttctcctgctggcgttggcctgcggagtgagcggctggcgggagaggccgtgcaggaactggctcctggtgggagacataggctccacttctaaatcctggcctgggtgctgaggccagaggccggaagccgggaacggaatccacccatcgctcctgggtcctgccaaagggtagggtagctgctggggcagttcccttaagcctgccaggcccccgaggatgcaggggaagaaagaacctatcattgctgccaaacttcagagtgccagagcgtcacccaccacctggtcctgctaaccaaagcaagcaggaaatgccacgtagctcccccgaccccaccccgcctcaccttcaccaaggcctatggcagcaaaacttactgtgtttcaggcttttcatcttataaaagctgtgtcagtgttgctgaacttttcccaagaggaggagaacatgctcaaggaaactctggagtataaggtagggttctctggtctactgttccagcttccaagatacgttgtcagttatcccagcagtagcagtgtaagaccccttagacccacacccgagtgtaggcaccagcacagctgcatgatcagcttggctgcttttggatgaacttgatccaagcactttttagcgatgacatcctttgtgcccaaatgtctgtgctgtacttgaccaacaggccacgtatttttcaaagcattttcattgatagcgctttatcgagagccccaggtctggctcagcactcagattccaaaagcgtctgcataaatgctctaataggaaaaaatacctgcagttccactaccttgttcctgtcaactcagtgtttttctctcatttccctcctgtactgagcacgggcctgcagactggttactggcaccatcttcttgctctgctcagagccagaggcaggatgtgtggggggcaggagtgacaggctcacgggaggggaggggcggttcagtttccctggcaccaagtcctgatttgcatctcagaagccttttctgtttcaaatgcagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatggattttactagtttggtgtgtcagtatttctttgactcattaaatctggtattttgtgtctcatatttaacactccaaggccaacctcaagggctagagaatgtttgtctttctttcagaaagaaccttcccagactggatttgggtgaataaatatacgtaatttaatgaagccaacagccccattctaccccccccaagaattgcagtggttctgaagagggactgaggaggggagagctgtggaggggaggactgtgtcactttggtcaaagtctgtatccaaaggctgtatgacccagaggagcttctggagtgtgaatggggccctaacctttaacagaatgcaagctgcagtcacatgtgctgaaaaggaaagaaaagcatttttgcccttcagagaagctctgttattggttatggggaaccaaattataccatctatttgctgattgattgctccccatttctgacgtttagttctttaaagaaagcttgtccatgcagcagtgattctgcagcacagccaacccagcatcaggagacgtgaccaggcacatctgaggccccaccctcaaaagattccaagtgcaatcccacaaactgaagacttttaaagcctagatcaattattaaatgtttggcactttattaaattaattaaataagctccaaaattaattacatacaaatcaaaggaataagaaacaataaatagtttattcagcaaacacctctctgcagcagccggcagctctgaggccgaggctggcgtcctgtggcagagggcctgtggattgccatgctcgctcccaggggtggctcaacagggacacaggtctactccttccacatcgggtttccggaacaacaactgaactctcattcattaccatcccattcattaccatttttttttacatacacgaaacacaccgcaatgtatagactaataagccaagagctttattgatgcagcaggcactttacaatgagcccaagagtgtccaccttctctgggaagacaggatgtctgtacaaactcttgggtttttttccacttcaaaaacacaagctctcccgtttaccacagcccttggatctgcacctgcccaaaccatccctcccccagtgcacacaggtgcatctgaccaacaccagccgccacgctggtagaccgtcaaaatgtcagttctgcagtactcggagacaaaggcatagactatcagatcctaaacaggatttaggaaacagacgattttcccctccaccttgaaaataaaatacatttcagcagatacatgtcctgaaatagtttacttgggagttcctaggaagatggtccattgtcaatcccttcttcaccagcctgggcatccagaattcttctcaaggtaacatgagtctttttattttttttaaacagtctttcttgctgtaagaactcttataatggagcctagtcctcctactgctaaggcctgtgggggcaggaaaagaaaacgtgtcagatgagacctggctggccaaggggagcctggcttgccagagacaggggggacattccctgacctagatcccgtcacagatcctcgaaagaggattcctgagatagagcacattctagggaaggagccctgtcctggagccgtggggtcccgagagctgttggctcttgggcagaactggcttgagaacactgtcaccagcacacaaagcagagccctcgagcttcccttttgagatggggtctcactctgttgcccagatcacagctcactgcacagccttgatgtcctgggttcaagccatcctcctgagtagctgggaccacaggtgtgcaccaccaggcccggctaatttattttttttgagacggagtttcgctcttgtcacccaggctggagtgcaatggcacgatctcggctcactgcaaccctgcctccccagttcaagcgcttctcctgcctcagcctcccgagcagctgggattacagg

SEQ ID NO: 15304 - DNA, 36954 bp, Human
tgcccacttcctaccaactgcaatcctggtgccccaattgacttcaggtctcagcttcgatgtcatcacactttgggaaaggccttcctgagccccagaccaggtcagtttccctggatatctggtcttatcgtactctatatgttccatggcacttgtataactgtcatgaaattctgtaattgctgtccacagtctgtctgcctcctagaatgcaagttgcatgaaggcagagaccatgcctgcctcgtgaattgctgtttcctcagtgctaagcaaaaagcttgaataaaagctggacagaataaataacctgtgggctgggcactttatggattccacgaatgatctcaatggcaatcctgaaaaagaggtggttattgctcccatttcacagatgaagaaactgaaacttggagcagtgtgacttacctaagcaagtggtcttgaactcacatctctctgactctgaagccacactcggtccgggaaacatccctgaagcttaaaagccaatcatggtgtgatggggaatggggagggaaggagggagggtagatttttctcctgcttgggtctaaggacagcgagagagcattgcccctctgcttggtgtcaaccagggaggaaccagcaggtgacagggcctatcagatccagcttaggttgtgcccactcaaaacctgaggacagggggaggggaaccacagtcacttttcaggaggggctttagggaccctggaggaaaccaccattaacttttcccgcggaactggcctctggtacttgtcctcgaggctgaggaaaggtgttttgtggggcacacatggcacccagcgagcgctgggtggccgctgcatttgaggaggcgtgaacttcaacaggggaccacaggcacggggcacctcctgcgtcccccatcgccaccccacctagagctgctcatcaactccttttagagacaggaaactgcagccctggcggggagtgacttgtccgaggtctcagagcagggaaatggcttcagttgcattttgggggccgctgttccaaggagagacagagaaagagatagcgagtccccctgagcaaggcgagaaaggggggagagtgaggggaggtagaaggaagccggagagggagggaggaagtggtgagagcagccgaggagagaggggtaagagaaaaagagagaggcagtgaggaagagagccggggacagccagagaggccgggagaggcgaggaaggaggcagagaaacgccgcggagaccgggagatggaaagagacagggggaggcgggcggggacggccggggggaccggccggtgacagccacgtggcagggggcgggggacgccgagcgctagcgggcgcgggacggcggcgggcggggtggggaggccggggacgcgggggacgcgggggacgccgcgccgccccctcccggcgctcgccgccgcccccgcccccgcccccggccgcacgcgcccgcagcctaatgaccgcagccagcccgcgccgcggcccgcgcccactccaggcggccggcagctggcaacgcggggcgagcggggagccgcgcgccgcagcccgggtggccgctcccggcgcccggctggccctgattgatttgtcagccgaggcaagaaaaacggcccctctgatccgcgcgcccagtcctcggctccccgggcgccgggcctccctcccgcgcgcctagcccggctccgggccggccccgcaggctggagcaccccgcccgcctcaggagggagccctccgccctccggcccgggccccggcgcccctccccggccccgcgcgccgcgcacctcctccggctcggcccggcccgcccgagggccctggggctgccaacggccccctcacccccgctgggcaccgtgcccgcgcccccagccctcaccctgccgctcccccctagcccggcacccccgccccccgccccccggccctggcccggggccgcccgcagagccggccacacccgctgcggaggactcaccaaggtaaggaagcgcctcggcgcgccccgggggcctggagggctgcgcgtggtgcggggagggccacggcaggcacccgcggacccggaccgggaaccgccgctgccactgagccgggagcacgggagggccccgtcgggccgggagggctttgggcgagttgggcttgtcaaagggaggacctggtggcaagtggctggcagttgccgctctgtctggagcgtgggggagtctcacgctcaggtacagagatcttctgtccagatctttttctcttttaaggaattctcttcctctgtcactatcctctccgaatccctaaaattttatagacattattttccagtgtctcttttgaggaatcacctctttgccacccttcttctcaagcaggagtcttttcccattcctcttccccaattaagcacatcccctccctcctccaatttagaaggattttcttcctctttctcactccccagtttaaaaggaaattctctctccccacaatttggaaccaccttctgtggctcactttcccatttccaaggctagacccattcctatgctgcccttcacccccataatcctggctgtgcagatcaatttgtcttcagctggagggatctaccttgtgtttttctagtgcaggggccagctgtggggactcctcacccaaagcagggcaccagcaatccgtagtagcccgcaggaaaggggcagctgcccagccgcagcccaggtgcaaggggcatttgtttccacggggcaagcaaggaagactttaccctgaaacaaagaattgagaccaaccgagactgtcccagcctcttcgacggcagaggaatcccagcttctggactgaggggctacatctatccccctcccccacctctttaactttaaaatagtttaatgaacacagagagagaaatcatttttttttttctgcgtggtgagcagtctacaaagagaaatgggaaaggagggagagagctttaactctgatccccgcaattagttccctgggattgttggtgtgtgtgtggggggggcaacccgggagcctcagttcttcagatacaaaagcatttagatcgctttagaccggttaatcctgagtctggctcgggtctcttttgtttcccaactccattgtgggttttgtgcagtttctctctgttcgcgtgattgactagccaatagatggtaattatccaaatgtcccctctgtcctttgactgacttctctgtattatgggcaactgtcatgcattctgtcattccatatcatattacacatattatcatatgaagtctccccccaccctttaaaggagggagcctcagcccagatgctgctgcttttaaaaggaagggccccgaataatttgtgcggggcacggtcgggaatacagagcaggggactcccgagatgggaggttctgcaggtaatttgttttgctggctgggggtagggggggtaggggtggtctctgaggttggagttataagaactgtgctgggggcttggagcacgcttgtgccagcttgtattcctctgcccaggatcttggagtagtttggatggatctgggataccttctggagaaacttggaatccattttttgaccccagaatatcagaaaaatctgcaggatcgggtcctttgggagtaattagttcttagcgacacatgctcaagacaacaacccttgggatcccaaaatatatctcttctacctgtggcccctcacaggatcagtcctttggactcttgccccggtttgctgccaagcaggctggggatggaggagccagctgtgtctgtttcaaacccccacaagctgatgctgaagctctgagaagggacaagcttttccagtgatgcttttgcacagataaacttagtgccccttggtgcaattgtgcttgccatcacttaagagggaggcaggatttataacaaggagactttgcaggcagagactctggggtcctctgaatctgtgggcaggactagcctttcttttgctaaaatgtgaaaaaagtgttttattattgcaatggatatgaagtgccgcccagatgtacagcctcgcaggcagttaattaccttgttcttcatcaaatatatgagcaataaattctccaggaagggaaatgtgtgtgtgtgtgtgtgtgtgtagataaataggtggatagatagataaatgcaggagagagaaaaacacactcttttaagaccacagaaagaggcagactattttatgggaagcttgatacactgctgcaagatgctttgaatttttcaatgatcaaatatacatgatcaagctgtgcatgttagggtgcgaggtgcaccgacggtcaatggctattgatcaggctgttaagtatttctgttcagttttataaatatagatggatcccagatgatttaaacaactagatagttaagaaactagccttctacatttctttggagaaggggaaatggctggtcagttgcataaacccaaaccattgttcacccccatacttcctccctgcccccaaaataccttggaaaatgtgaggctcattttcaagagtgttcaaaaatagagtaaaaatattccagatgttttgtttggggtctgccaataatagtcaccttacctgagcctggccttattcacaggctgggagttttcttctctctctttctctctctctctctctctcacacacacacacacacaattttgcaaccacaattttgatccagactgccagagagatggggagggtgccatttctaggagtgggtctaaggtccctaaaacccttctggttaggaacctggtaagccaaccacatgacccttcccaatgaactaatttctcactagtctaaagatctatttagaaaggtgtggagggggtgaaggatggagatttaaaggtaacctctaattggtctggaaaaattaagctgatgacaccttgaaaatctctctgtttctttttcattctctgtctctccaccatcaagagatgacatcttgaaaatctctgtttctttttcattctctctctcttttctatttttctctgatattaccttctagaaattaaaagtggacttgaaagaaaagggcaatgaaaaacagtggggggaggagagaaagcgaactttttatttttttttttgtggtgcgtagcaatcttaattataaccacccaattagctattttgtattttgtaaaaggattcaataaatcagccttctcccagatcggtaaaacttaagcatacagacaattgatagttatgttttgtttccacatcttaaaaaaacaaagtgaagatttttgatttttctatctgcagaccagtctttaccagctaagtgcccctcaccagaggagctgaggcatccctattgataaaaccccctggaaattgaaccaaaattggcatccctcaaaaaagttgatccacctagaaacggatgaatcagtcctgattgggtggacatgccctttcacctcattgtgtctgacctatcacttaattaatctctcccagagcagagctgttgacaataccaaagataagcagtattttgaacaaagcaggaagcttttaaaagaacaagccacagtgaggtttgaggctcttaaaaatgtgtaaatcatcagcattaggatgtaaggtacctttataacgtagctgaagctcagagatgatcccacctttgccagaaactttctgtgcctttctttagccatggatgtctttagacattcatattctgcctctcccctctgctgctggttccctttctcctgtctttccctttctctggattcatactctccatggctactttcctgaaaattgttctctgctttccagccttgcctttggctcttcacatcctttttttagtgttagggctgtcgaggtagtcagcttctaaggctttgggggacaaactatcgactgcatctgctggtacctatgaaggaggacatttgtgctgcaggcaccttggtgacatacagggaatagttcattaattaaaagacttgctaattgctgcttgaattactgtacagaaggaatgaaatgagtttgtaaaagatgacgatttggagaatgcatttttttttgtttaaaatatttttataaacagctcctagaaaatgtgttgcttttgctgttgactctatcgtcaacaattcaactgagcttcaattaatgataatatatggtctgggatccttcgctgggcccgactgatggaagagctttgttgaatttggtgcaggtggcactgtttaataagcacaggaaagagtgaataatgtagtgcttgcaaagagaagtaaatgcaaaatagatcgctctaattatggcagcccccagaaatggagatgcaagctgaaatggccaagtagctgggaaattctaaatagtgtcgattgtcccctgcctttttactttcgagggctgacatggtagcttaaaagtaaatttgggtgagctcatctcactcaacacaaacagaaattcaaaacctgagtctgatgacctatcaatgtttgccttcactgtctagaatccattaccagatagtaaaactcagcactaaaacagggccatctgaacatttcttcctgcaagagatcggcacaagctctttacaactagcattcgtattttattgcaaagtgccaggagattttgtttttgtttttgttttgttttgtttgaatttctttatgcttgagaaaattagcctataggaaatcaaagtgtgaatacttaagcaaacagaatttctcatatacctgcaagggcttgtagtgattttcattcatgcaaagataatcaatgggacattagttgtcttaattaatggaagaataaaaatgttggggaggggtgccaagggactgggcttcagctgaagcatgtgtgggaaatgactcattcctcacctaaagagacaatgccaacttcccaaaagcaggagagatttgctaatcaaaccagtggaaagttggacttgggtgtgggaggggtcctgttgaaagtgtagggggagatatggtggtcacactgggcatttttcctcccctgcaacctcagtgttccccttggaaaactaacacatcctacatcatcttctaggagaggaattgtcttacttcctaggaagttgcactttgtgctgggagcctagcatgctttgtgatggtaaaatagtgccagtggctgggaagctcaaatcaacattctttagcctggactaaagagaggctggggctgaatgggtgtgctagacatggggtgatctgtaaagcgtggctccagcaagtgggtagagaccctcgtcctctgattgagaacccaaggaggagccaagtccagcatctttagctaaaaactccttttttgttatgtagaaatgtttaccaaacccaactccagtcagtgctggctgggcactccagtcgattggtgttagcgtatgggaagctcataaaagctttatggggaaacctgtgcttagaaatggagtttagaggtgtcctgctgtcagagaaggatggcagagatgcctttgaatgaagaaggctgtgataggaaaaatttttagtctcaagtgcatggaaatatgagttgtcagacagtcaagggttcatctgcttcctcctcttcccccgtccccactttttccatacaaaatcttttggattctcctctaagcaaaatgtggtttcctatgtgaggaaatttgttgctagtttttcttgtgcttcaacctgaaaggctggcagagcaaccaggttagcaaaatggccctactagtactggatatcattctgggctagattaaaaagaaatgattgtcaataaatgactgtagttataccagttggggaaaaaatggcatctttttgcaacatttaccttttttggttttgcttccagggaaatttacatcattgcatggaaattagccgtgaggggatgcaattagctatagtgtattttgttacaattgttctttcagaaaaatctgatctgacagatttatattgttgacaatgtgatttaagcaggacctagatacatactttctgcaccctaatcaataatggtaaatccttttgctgaggtgaacaatctctgacctagtattcatatttcttttaccaattccctgtaataaaattgaacattttgtcaccactttgagaaacactgccaaacaccttaaaacacatgtcacatgccagcagcccctcatttccctcctccgggagtttctacatctggaatcataatcacagataaaaaccttgacaaaattgcatctgagcacattcctctccgcagcctttactttctcataacatttaatacaatattaatacctgctactgaaaagcaggagggaggaaaagggctgccaacctccacgtttcctgatgcatcatgttcaaacctgaaattcacacttcgtgtttcattttaagttcagtgcatttaacagggccctagagagagagccctggttagttccccaacctgctcagctgacgcccagggaggcggtttcagaattgttcagatcgctgcagggagaagaggaggaggaattgggcttctctctgcctgcaacaggccaagccacttatctattctaatgtcacagacacggggttcctcttcggaaacaactaaggctccactaatttttattgtcgatagcggtgataagcagattttctgtgtagtgtgaccaaggcaatgagctgatttcgtaaagaaagagatagctatgcctgaactgatttactgctgactgacagcctctcgcatcaatataaaacactccctgctttgctgaatgaggcccacaagcctgggaaaggtgtgtgtgtgtgggtcctcattgaagatacagagcttttctgctctccctgtgactcagcctcaccccaccctttcttggagataaccctaaccctgcattcctgtgcagtggcaaggaatcacccttcctctgccttacaaacaggagacagaggttagagagaaggggaaagtgcaggaagcatatcccactgggggtttcctgggggcatgcatgctactctggagatggacttttgcatgttggtggctttgttcagtccctgccactctaaccagaattgggattgtgacagtccaggagtgtcccctccctttacaaaatgtaaacctccaggattctggaaggtttaaattggtaacatctctaacagcagcctcagtgcagaggggacacacacacacacacacacacacacacacttccctgagcattcccactttggtaaggaaggagtataatttgctgaatggtgcaagcaagccaggaggacagaagatgttacactttactcagggaacagaggcgggcaactggccctgtgactgcagccaacagctttaagaacacagtcctttctgcttcaaggttagggagacgttctcgcctctttcttctttgcagttattattcaagaggcttcccccgaccccagtccccagcaccatcctcagagcttcagaccatacattgacagtgagcaaagggggccccaggcaggcgggtctggggccaaggagggcggctcccctgcgcggatccttccctggtggctcccaaatccggcgttttctctgccgcctctccctcgggggagactcggaaaggctgcaaaaatctgggcgcccgttcgctcgcttgtcaagaagcaaactgtcttcacattctccaagagcaacatccctgcctaggaagaggaaggaagaggcaaaataaataaaaccagttaatgttgtagttaacttgcaaatcaagtaaatctgttggtgccgtatttgagaaataaaccatcacagcgtcacagcaaacacacacttctgaacgtcttcattttgatttaatggtatatcagcgtcaactatcgcttcctctgctggtacacacggcctgatgccgcgggaggagggtgcccatgtttatcaccgagtgagatgactaattacaccttgtcaatcaccggctatgaagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagccctcccgagagtggagttgcaccaaggacaaacactctagcgtcattacaaattttttctgccccttgggcgacctccagatgaaccctggtgactctcagattggattttcattccttactttctttgaaagaaagtgccccagatgcgtcaataaaacatgcctatgtattcgtgtaggcgtccgcatgcctgcgcgccggccgtgtgcaggcgccgaagcacacgtctgtgtgaacacacgggcacgcgcgtctttgggtttagtggtccttccctcgcgttggggcatctgtacacatgcagaatatacacatatgattgtaacttcaagttttttcaattatgcaaaacgacctcgtaggagcacttgcagtgatttaagtagaatcgcctgagcacgcaagtgcaggtataacgtgcaatttaccattttgcagttgcatccttcttcccagctctagacacttacacctgatgcgcatgtgtaagaccctagctcttcagtggtgctggctgtgattttgccaacagagataaaattcgtgctggctgtgttattgccaacagagatgaacatgtgtatttgcacacatgaacacaagttcatgtgcttgggcattacacgcatacatatatttgtgcacacatatatttgtgtgtgaaagttacttacacacgtgaaaaacatgatttcatgcctcaactctgtaccctgtgaggtaaaccgcaggtcctgactatccccttacctgtcctggcaaacaagtcatttcagactgacacccgccttgtccctattagacggagccaaacctgcctccgaagcagacccagatgggactctgtaaccgaagtgcttattcagtttttgtctacaatcattttatttcctaaatccctcccccaccagacacctgggtatttccctccagtccccaggagactctagggtgagcctgaaacctggaggctgggggtagcagttgggatttacccagcacgctactttgttggcccctggggaggtggtgcagccaggcgggtaaggaggactcgcgccatcagcggggtctgagacatggtgtgcccagtgggcagagaataggcctgtggtttttaagaacctcactgatatcgaatgtgtcttggagtgagaaagtttttaatggaaaaggagcaagagagagtaatgaaataatttgctaagtgcctactatgttccaggcattttacatccacagtctctttcaatcaacacgtccatgcggaggagagcttcttgtcgcccattataaaggtcagaaacaggctaagggaggataagtcactgcctaaggttacagtgcatgtaaatggcagagctaggattcgaaccctggcctttctgagttcctaaagccatgctcgcccccactcttccaggctggggagagaccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcccggagcacgcgctgccagggcctggggcgccgagcggccaatggcacggcggcaggacgtgatgtcaggcgcggctgtagaaaaggcgcggaggcttgcgctggcgcggactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacggtaggcgcgcggctgtggggtcggggctgagagctgggatggggccgggccagtcagcgcctctgctccccgaagtttggggagcgtccttcgtgccgcacgggactgggtgctggggatcctcggtcagaatgcaaggccggtggctcccggttcgggggaaacccggctgctgggacgcagaagggaaacaaggttgaaaccgaaatctcggccctgggggtagaggagagcgtttcttccgaactggaagcgaagtcccatccgcggcccggggcggctcccttctcaccttgcccggtgccggggtcgacagccccgcgctctcctccacctctcggctccggttgctggcggcgccgcgagcggcgccagggaagggcgaaccagctgggagcattggggctccagccggcttgggccgctcccagctttccggcaatcggggatcctcctcaacccccagcgcagtttcagaggccgaagtcttcggggccaacatttgtcgttgatcgcgtccccagacccttgactggtcagacttagccaggccagggctgggagttcaggctccggcctggccctcgccgaaggagactccatttggatctctacacctggctccgcgggcccagccccaaatagccagttcctcgcctcaggcctccctgggggccagacgagcagacactgcccgaccagcgggcccagaagtgacctttaggaggccgcggaggtggggagcacgggagaagcttctctgctccgggagcaggagcagcggcgccagtgtcctcccggcctctgagcgcttcttcggttagaccttctctgctggtcagtttggatagggaagtatttgggttgaacctgtccttcacccacggactttgagggtgtccctgcaccccacttacctcatccccggacccaagagggccccagcccgtgtggcagaggagccagaagttggctgacttgtcctggccttaacctctggtctaaggatccagggatcactggagctggggcccaggaactccgctgtctctccaaagaggattctgtgtggagggtgacttaatggtcaccttatcccccgggtggctcatttaagaagcagtttagggaaagctcttggagggcttgactggagtagctgtcctggtccctaaacacagcccgagcattttgggggaaaggacagggaggactggaaggaagagaggtaagcaccagagccatttaggccaggagcccggcctgggcccgtggctggcgagggctgcgcaggcaggcctgggttctgaaccgcccagaaatggaaatgggccttttggggtggggggaagcgcgccgcatgtcctggcagccccctccgcgttcagggtagccaaggccacagagggagttgtgggtgccggtttcccggcggcggaggggccgctggctgacgcaggcgctgctgtcttccgcctccctcccttcgcagaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggtagcccccccacccaactgcccctcaggacccctccccccaatctcaggcacagtcttacagtttggccctctcctttccgtttagtcccaggagagggttcactactcaggactcccccgctccccccccaagttctccaagccaccacaagttgggtgataaccttttaaagcagcaatttggggagctcttggaaaggtctacgaagtaggagaaccagaaaaaaagcagaagctgccctcctgctcggagcttagaccacaaaaaagcttgagttgggatccttgctcccctctctctttgaagtttcttgagttaatccgaggttatagaaacaggcacccccaaacctaggcagcccaagctggagtgaaacacagctggaaagagagctgtgggagtgggtgcatttccaggtcttttgagaaaatgggaatgaaaggtggccaagatcaaagaaccagaatcactagtagactccaagttctctgtttctccttctccccagttttaggattagggtctatgtatattctctctgtctctgtctctacgtctgtgtctctctctctttccctgtctctgtgtttcttccaaattataaaagtcagtaggattcccaggcgctggtttggagggaggagtaaaggttgaggagggggtaagtggtaagtgtctccctccactcccaggtaaaggctttcctagggcttgcggagactctgggtgaagtagaagtctctgtaggcataagtgtgttaagggaaactattttaggacaggaccaggcctgggtcaaaatctagttctctctcccccccatcctccaaataaaggccgggttgttcgtcttgaggaggggattgccccccgcagcagcagcggcacctggaggaggaaaaggggggtacccaaccgtgtgttcccacagcccctccctccatggtccctacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctggtgagtgcgcggcgcacgaagcgcccccatagggttgggggaaagtgtgcggcctcgacggccgggagctggattgaatctctgtgtgctgggcaaatagcgagccttaagcaccggacggcctcgcagaagggacattagccccctgggcttccagactgtgcgtcctcggctggagcgggaggagagggtgcagtggtcccttgctgctccgggtgcagggccttgtctctgataaattgtttttttggagatggctttttggtttgggcctttgccccactttgctaggcaggaagtggcagggatggagaaagcaaggcggcgctgacgccaaacaggttttgggttggcgcggctgagggccgggaactggggcagcgaaggaacgaggcagggcggcgagggtcccaagagaaagggctggctgtggcccggggcgccgagctcggcctggagtgcggcctgacctcgtgaaatgtcccaagggcggcaggcttggggaactcgggcttggggaactcaggaaagcaaaggctgcggttccttttgctcggcccgatcctcctttaaagacaggtctcagttttcccggactttttcctccgagtttcctggcgcctgctggggtgagggccgtgaccctcggaagcgagccccccgggcggggacgagaccggagcaggcctggcctcgcgccggggtggggtggggtggggtgaggtggggggcttggttcggatttccggcatctttgaaccccaggccattcccggagaagctctgccccctcccgcgcccctccctgctcaggacagctgcagaggttctgagttccggcaaatgagccgtcaacatctgcccgaagtctgcaaggcccggaaaggtttatgactctccgggcttccgaactagagtttatgtgcaattattttctttctttcgtttgcaacagaattagatttggagattttgtgttcttcttccttttccctttagtctaatgcacaagcagaaaaaagcaaaaacaaaaacaaacccaagactgtgcagagggtgctacggcgggaagaagtcagttattttcatcttaaagaatctgagttgaatagagagggaaatgaggggcgggtgttcgctccaacgaaatcgcttggaggatcatggggcgtgtgtccctgtgtgcggaactgggaggaaaacgcagcccccagtttggtaaatggtgaagcagcggtaggccggtcggtggcgcggatttaagatttgctgaaggcactaccacagatgtagctctctggaacttccatccctcctctcctaccaccccccaaaaaaagacaaaaccgagttcagaccggctcccccaacaccaagccgcttctatttatcaagtgggtcaacttccactcggaagcacctcgcggggctcggctccagggcacctggtggctggggagctgtattgttttcctgggcacggaggttcggcgccggttttaggattgtgcaaaaagagagtagaaggtacagagatttatttctgctttttgctgttcagccgccgtttgccccagcgaggtgggctggaggctgaatttcaagccttgtttaacctctacaagagacaccctccattcagccatctcactttctctctggcctccctctctctttttttcctttccgttctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccgggcgctgggcttacagcagagccgcgggccgcggggtcggaaagtccttccggggcggggccgcagcggcctcttcccgcagcccctcgggcccgggccccggtggaacggaaacctccccctaccccgggaggggctgccagcgggctgggggtgcgaaaacggcggcaggagcgggcgaggggcccgggccgcgcactttgcgcctgggtttgcgcgccgcggccgcgggagtcccgcgcggaccggccggacgcccggcctcccccagccccagctttttgtgtgtgtgtgcctggcggcgtaattactgatttgattccaatccattatttagacaattgaacctacaatctcgtctttagtaaaatgaggcgaagtcagatttgattacaggttcagtcccagcgacaagagctcgaaacccgatgggttaataacagatcacgagtaaattattcatgattttacgagctctttagctccattgaatcggcctaattgagaggaaaaaaaaaaaaaaggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttccccttttctctactcccccgccaataacggcttcggaaaaggcctcccccgcagggaccgggtctcccggagccccgggattcagctcggccaccggaccctcgccacaagctgcgcctgtttccgggactcgctttcccctccgctctccctatttcttgctgtctttgtagctgtctctctgtggttctcctggctccttcgctttcttttcctctgtctgtcctctctttttcctggctctgtccatcttccgtccctaccccctctctctttctctccctccattctgcctttctgtgtttgtctttttctctcctttctctgccctttctgtccccctcccccgcactactaccccacctaggcggcactcagggcaggtcccttgggcccatgggggcgccggggtccccacggagctcattaacagcagccaggcccaggcgggggctcggtggagggatgggcccaaagataccccgtagggaggctgccccacccccagtggagctggggactgggggaaagaaaagggttgctcacctcagcgggttccaagcagttctggtggatcaggttcagaggcatcctctgatcccctttaaattgccggacccgcgctcttcactctgggcgtgctctctgtgggaatgcagccccgggggtgaggggacctgagtgccggtggaaagaggcccctaggaggtgtagcccctagctaacagctccaaaggcaggggcaagacttgtatcttgcaaattctctctgcaaggggctcttccccatctgggcaggggaagggggaggtcaccagcagagtaaaagtcctttggaggtagtgtggccaggcaaaatgcagcatccccagttaaattggaattttgggtacgtaacaaatacatttttagtgtaagtgtccccggcaatatttgcattttggaaaaataacgaataaatttgaaatttgtagtataagtgtcccgtgtaatatttgaattttagataaatgacaattttttagcatagctgtgtcacctgtagtatttgaatttcaggtaaacaacaaatacatttttagtataggtatgtcccatgcaatatttaggacatgcttatactaaaaaattacttattatttttctgaaatttatatttaactgggcaacctgtattttcatttgctaaatctagagctctgttacgggtatgtgatgagggcacaagataccttctcagttctcactttaggcggaccgaatgtacaccccttatgaggcttaccccaaggcaagaccttaagtgtggcatggctcgggaggtgccatgaggaggcgaccttgggaggggtcctgcaggtccccatcagcttccaggtggctgagcaattttctgaggcccaggttttcacccatattccccacccccaatgccagccaggcattggcagcgtggcccccatgaggctccttgtggttagggacaggctccctcctcccttcgtggtgtagtggaagaaaacaaggagtactccagtgctaaatctaggctcaacagatcaagatcaatctagctggttaccggtggtgtggcagtgtgcaagtggcttcatttcccttagcgttagtttccacatctctaaaatgggaatagtcatagccacctctctgagaggtaatgatgtacagtgacatttgtaaagccaaacacacaccataggtgtctactacatgtttatttctgcctcggacttccttccccgtccactctgccgctctctgtggactgccgcagatctctgaacttccccgagcctaatttgctccacttgttcacggagaaacaatcatcttacagggtagcgatgaggattaaactgcaaaatgcagtttccaacctttggcccagtgcccaaggcccaggggtccctcagtacttttgggtgtggcaaaatgaacatgaatctctgtttcagcagtttctaggtgccggtcccagacacggtagggggagacggcagaaagcactcctccttagagtgccttggaaaacaggaggagggcaggcccagagaccctgtcctgctgtgtccaaagtcaagtgacttcccttgctgagcctcagtttcaacatctgtaaaaacgggaaaaataatacctggtgctcctaggattgttttaagtacctaaagaaaatgtgcctggaaagccctttaacacatcacctggagttcaatcggccatcaacaagtcgtagctgttgttgctgctgctgctgctgctgctactattgttcttattgtaacataatggctcagaatgatttttggattctcccagagccgggattcagtgctgcagttcttagcagtgtgatcctgggtggatcgctgtctctgagcctcagtgtttccatctataaaatggggatgatgtccccctttcattgtggcgcagacatgcagcagggttaaggattgaaatgtttggcagtgggtggggcgagtgtggatttggcatggggggcgggtcaggaagttcacccaccggctctgtgtctcctccctagcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtcagccagggccaggggtgagggcatctgcgaccaccagggactggggtggaaccctgcacccctcgccgtgggccttggaaggaccttccaccctgtgtctgcttctctgtgtgtttaatctttctcattctctttcttcacctctccagcctgtccccatctgtatttcagtcttttttttcttactttgtcttttctctttttcagtttttgcctctctgtttttctgtttgcgtatcgctccatcctcattgtctccacactcggtctcttttctttcttctaaacaattcttagtttctgtttattattcaagtgacactcattttacacacattcacatcataaaaggttcaaacatttcagataaatctagaggccgccccaccccatcccaggacgtacacccaaggtgactatcattagctcctgcttcttgcttcttacccactctagtttctcttctcttgctgtctgcctctgtctcactcccccctctctcttccttcaggcatctctctagatttatcttctgcctcccagactctcctggaagcaaggtttggtggtggggatgtgtgtgggcagattccctgggtgggcaggtgggggcgggactgcccagaggacatggtggggtgggggagcggctgggtgcctgtgaaactcagcagaactgcacttacatgtgcgagtaacttcttaatagagaagatccagaactttcaccaaattttcacacccctagagatgttaagaaccctagtctggaggcacagaagcaggtcccaggctcctgcatgacccaaagttgtggcagagtcgtgggccacatctcaaacggtcagctcctccttttactcattttagggtcttaggcaagtcacttgactttttgtagcctgtttcctcatacaagaaatggatacaataaattatgctgccgggttatccaaggagccactgaaatgacgtgcctgtggtgcgacctgacacttcgttgctcagtggatggtagccaataacagcattaactagattcattagctggcatgattcactagtatgagcaattattctggtagtggacatcagtttccccattcgtacaaagagaaggcaagacaatgcctcccttgatagcaagtttaaccaatttattcttcagaacgtgtggttacagtgccagcgacacacattttgagggaagaaaaccgagggatgaagtaaccggacagcctcacaacaggaggggaggtggtgggattcgagtccaggccagtctgacccaccctccagccccaggtctctgggattgagggctgggaggtgacacagagggatgacggagacggagggctgcgcagctgccctgagaaagttcttgtgagtttgtcagaaacaaaaaacaaacaaaaaaatgccctctgtggggcgggtggaggctgtgacgcggcgcaactgcagctgcagctgcggggggagccgggagttggggcccctaggctcccgaggcgcccccttgagcagcgctgcccacggggagcgggcgaggggctgcgggagagggaggactgggtgacgtagccgagggagggagcgtcggccaatgggatgccgatgcgcccctctgggcccgcccctccctcatggtctgttttgctttggagtcccagtggcctgagctcctggtggatggagaacgtgactacactggctggggtagcaggtccctctcgtctgtttccttcgttgtttgccttcttggggttaggtcaaggaccctctttggcgtcccctcccttcagccgtgggtgagttcggactgaggacttggggttgggctgccttttctctgcttagtaggacccttcgtccttccccaacccagttgctctgtggcagggatgtccaatcttttggcttccctgggccacattggaagaagaagaattgttttgggttacacataaaatacactaacacgaacgatagttgttgagctaaaataataataataataataatgttttaagacagtttacgaatttgtgttaggccacattcaaagccctcctgggcatagacaggcttgctctatggagtggggtcaggggagggagggcagttctatgaattaatgctttagctggggatggaaccgggttcaggaagacctgggctgggttcactggctgtgtgtcttggacaaattagttaccctctctgagccatagatttctcatctgtagaaagggcaccattagggcacaaacctctctcagttatccagattaaatgaaatgaagagtaagtacccatagttgaatcagaatttccagtgaggagccagtctctgttggccttggggaggcagaaggcttggtcacctgacttaggaacaaatcagatttccaggagagttacctcttattctttcatctgatgaaacatatattggcaccaggccttggggacacagagatgaacaaaccatggtcctggccctgaggaaattcacctgttaggtatagacacagacccatgtacagtttcctcatggtgtgatccgttggggcacctactgagggagcccagaggaaggaccaaccatgctgtgtaccaggcagcatgatccctcttcccccaccatccagatgagaaggcagaggcccaaatgatctccacttgccccaaatcacactttatagttacctgcagagctggatccaaatccaggcctgcctgatcaatggacatagttctttcttctttgagccaatctggcaatgactgtctgggtgtgagtttcatttagggtctgtatactgggggtggggcatacgtgtagcactgttctccctttttcccagaccacatttgcacaaatcccaaatattcctattgcacatggtgatgcagcagtttacaaagcattatctttccagccacgtatctaccttaccttaagatttttctgcccattttacagatgagaagcttaagacctagtaagatgaggtgatttgctgctggatacaggagccaggcattggcagggtggggcttgcccccaggtgccctgaatgctgatggggaatctggcagacatgggatgggaacagtttgaggcagttggtagtatgcctttgaaaggtaacagactggttttaatcctgtctgacttaccagcagtgagatttggatgttttaatttctcctctctgagcctgatgccttatctatgaaatggggatgagaaggataccttactggtggttgcacggagtaaataagatgacatacagtataatttacagagtgtagagtcaggacccaggcatgctgatctcatgcactcatttacacagtacagttcagtctcctgcagtcatttacacagtacagttcattctgcaaccctctttgcacacattttaaaaatgtgattatcttcattttgcagatgatgaaactgagattctgagagtctagaaccctggccctgagtctcacagctagtaagtgatgaagccaggagtcgagttcagattggtctgaaatttccaaagctctttccaatattgcacacgaagggattttgacttttttcccttggatctggctgcagagtgcagcagtacagtgggagaggagggaaggtgtgggtcacagatgccatgtcttggtagggaagcagaaacctctagtaaagtgctcgtcacataaaaggtgctcacatttgccatcagcagcagcatggcaactacaatactcactatcagtgggcaaggtgactaggagacagaatggccccttagacggaggtcctttaagactttaagccttggccgggcactgtggctcacgcctgtaatcccagcactttgggaggcaggccgaggcgggcggattacaaggtcaggagatcgaaaccatcctggctaacacagagaaaccccatctctactaaaaatacaaaaattagccgggcgtggtggcatgtgcctgtagtcccagctgctggggaggctgaggcaggagaatggcgtgaacccgggaggcggagcttgcagtgagccaagattgcgccactgcactccagcctgggcgacagagtgagactctgtctcaaaaaaaaaaaaaaaaaaaaaaagactttaagccttacaaatgcatggagaccatttctcaccacatagaagtctctctgagttgctttccttccttcctgtggaagggccagggaagcagcatattaagatgccctaagcttggggaagtgagtgatgagctgattgatttgggtgggtgaaggtctccataggggttccctggtgtgactttggaagaaaacacattttaaccaccaacagcttaaaaaccatctttcagtctgggtgtggtggctcacacttataatcccagtactttgggaggctgaagtgggcagatcacttgaggccaggcatttgagaccagcctggccaacatggtgaaaacccgttccctactaaaaatacaaaaattagccaggcatggtggcgcacacctgtagtcccaggtactcgggaggctgaggcaggagaatcacttgaacccaggaggtggaggttgcagtgagctgagattgtgccactgcactccagcctgggcaacagagcaagactctgtctccaaaataaataaataaatagcatctttcaggtgactagttagttattactaacctgtgtgagaatttaggagttgagtactctagctttcctctggccactcacttgtttgacagatatattgacctgccatgtgccgggcagggctggaggcactgaggattcagtggggaacaagacaatgaacaagactggctgggcgtggtggctcacgcctgtaattccagcactttgggaggcggaggcgggtggatcacctgaggtcaggagttcaagaccagcctcaccaacatggtgaaacccgtctctactaaaaacacaaaaattagctgggcatggtggcatgtgcctgtaatcccagctacttgggaggctgaggcaggaggaggatcgcttgagcccaggaggtggaggttgcagtgagccaaggttgcaccactgtactccagccagggtgacagagcaagactctgtctcaaaaaaaaaaaaaaaagacattgaacaagaccccactggaacatccacccagagggcatgtggagcaaggtgtgggataaacaattgacaaggtgccaagattaatctctgtgtttttcttttaaatgattctaagctcaaataggtttgggaaaggctcaaggttgactgtgtctttctcttggagatcagagcatgttagcattaatacaggcactgagaaatctggaagagactcaactttgtctaatctaacatttcccaaattttatttggccatataattcttatttaactcttgtaaagaaataaaatggtagacgtgctaggtaggaaaaatgcaagggtacaattagagcacagagacctgacctgctgaaggaggtagtcagggaaggcttccctgaggaggaggtgtggtttatatcagggcaagtcacttcattactttgaacctccatttccctacctgtaaagtggtctttttcctgcctgtctaccacccaggtgggtgataagtgtccaatctagtcctagatggcctaagctgtatggagtttcacagacaatttggcctaaacctctcagttcaaaggaaaggaaatcaagactcagagaggtggagtgactttcccaagaaccacagcaaagtggttctaggcctggggctagaaccaagggtttctgatttccagttcagtgcttattacttttggttctttaaagaaaacttctttaaaagtttacaaaatactagaactgccataccaacagtttagaaaaataggaaaaacagaaaacaacaacagcaaaacaaacaaaaaaaaccgtacccttctaagagcacaggaatccaataattaaagtgtgtgatttagaggttaagtagtggttaagggcatagaaccagtctgttggaagtcacatctcaattctgtttgtgcagtaagaggcacacagtttctactcctgcaaattggcaataatattcacatctaccgcatagggttattataaggaccaaatgagttaatgtgtaaagtgcttaggactttgcttataaaatgcctggcactggctgggtgtggtgtctcctgcctgtaatcccagcactttgggaggccgaggtgggcagatcacaaggtcaggaggtggagaccatcctggctaatacagtgaaacccatctctactaaaaaatataaaaaattagccgggcatggtgccacatgcttgtattcccagctacttgggaggctgaggcaggagaattgcttgaacccgggaggcagaggttgcagtgagctgagatcgcactactgtactccagcctgggcaacagagcgagacttcatctcaaaaaaaaagatgcctggcacttcatgaggaatagtattcatcattattatttgctttatgaaggtacaataccagaaggcatagtttttttttatcctttttttcacctaacagccatcacaagacatttcccctgtggcatcgtggagtggctgtgtcatgactcccacttgccgcatctgagtggacactttggatgcagccattagtttgatgttattaaaaatgccatgatgggcatgaagctttcatcttttggctgatttccttagcatcccaggtggggatttgctgggggcaaagtgggtttcccactggccctcctggctttcttgatgaaagaattctggggaaggaggtttgtgaggcaaaacacaacttgcatggtcaggtagtgcctgggaaggggcaagaagcaacgtgtgcttcttcatctacccagggcttattggagatctaccgcgcaccaggctggggcaccccggcctggtgttagttgtgtcctgatgattctctgtctgaacttcgccttcttgtcccagacacacagtccagagaacttgaggcatgtgaaaagagaaggcctgtcagtttcagaagatgggtgggtggggcagactgcaccttgttgcttgcagctgcctaagaatcccagcctgtcagaaccctgagagccatagagatcgtatgatgtggtctaaccctcttgttgtacaagtgaagaaactgaggccggtccagaggtgagggacaaacccgaggtcacgtggtagtcccaggactggaagctgctctttccactgcactatagttgcttctctgtttcttcatccatttattcactcattcatggacttgctacctccctcaggaccatgtggcagggagagcatggactcttttagggcaagtggtcctggattccagtctcaggttgccctctgtgtgacctttggcaagtggttttaccactctgaccctctctggtttttaaatctatacagtgagggcaggcacggtggctcatgcctataatcccagaactttgggaggccaaggtgggcggatcacctgaggtcaggagttcaagaccagcctggccaacatggtgaaactccgtctgtactaaaaatacaaaaaaattagccaggcatggtggcgggtgcctgtaatcccagccactcaggagactgaggcaggagagaatcacttgaacctgggaggcagaggttgaaatgagctgagatcgtgccactgcactccagcctgggtgacagagcaagactctgtctcaaaaaataataataataataataatagtcaataaataaatctataaaatgggaataataatagtcgaatccacctacttggcttttcatgggaataacctgtggcagtgcatgctggagggtggcatggagcctggcacatagtaaaaggtacatacatgtcagccattcctatgaatacatattactgattcttaatctctgccagtctctgccatgcaccgggggacatgaagatagcatagaaagggtccctgctcccatcaaactctcaggagtggactttttgaaatacctgggagagaattctagtgaagccctgacaacatgaagaacaaaccccacacaaccccagagcagccgggcttttaatgaagttgttgaattttcatctaccagattcccagtgcctcagctctggaaagcagagaaggtagttgtggacgatggtgtcattgtttacaagcccactgttaggggcaacagcctgagaaatagcaaacagccggcaactaaccgggtccagccctgcccgaggtcttggagccccggatggatgagcaaatgagcacccggcaaagcaccctcaaaccctcgacccaggctccccgctccagctactgctctgagagtcagacgcacagagcacaggctgctcaggggtcacacgcacacaggccaggacagtggcaaggcagcggcaccaaggctccggccttctccaccccaatctgcatgactttggggaagtcacttcctctctctgagggcctctgggggcttccccatccattttctttaggccaccaggacacagtctctcccctacagatttctgctggccgggaaagggaaggacccccccaccccagggaaagcatgtcaagggtggtctgagaagcactgtacttatttgccagcccccagaaggggtgatgggctttctttgggcggagagccagggaaaatgtgccttcttcctgggaagatccagcactgaggagggagcttggtttctccacttcacagggtctggatctcccactttactccaagattcttgtggatttgcttttaattgagcccaaattgtgttacgccaccagaaacgggggtttgaggccacaggcccctgcagccggggtggtcccaaggggtgcgtggggccaggagtcagccctccctctcctgccagagacactgggaagacaggcagatgcaggacatctggaaatgcgcaactggacaccccagaatctgcagagtgccctgaggccctttgttttatggggaggcttctggcgggtgttttcctcacgcaaagggaagtgaaggggccctgcctttcaggactttttccttggaaggttcaacccccccagagtggcctggatttcctaagcccctcccaaagtacttcgtggacctctgggtacagcgggtccctgtgtttgtgctgttagatgggtggtggtacttaggtgctggctgtgtagatgaatttcatttttcttttcttttttttttttttttttttttgagatggagtcttgctctgtggcccaggctggagtgcagtggtgggatcttggctcactgtatcctccgcctcccgggttcaagcagttcttctgtctcagcctcccgagtagctgaggttacaggagcgcaccatcacacccagctaattttttatatttttagtagagatggggtttcaccatgttggacaggctggtctcgaactgctgacctcaagtgatccacctgcctcggcctcccaaagtgctgggattacgggcttgagccactgtgcccgtccttagatgaatttctgtgtgtcttcctgaatgcttacaggcgtgtgtgcaaagatatgggagtggacgcgtgtgtgtctgtgcccaaggaaaaatgaaagtaaacccatgttctctcactgacattcttttcagacagagctcagccccagctctgcgccccgccgcacgtccctcataagtcgatacgggatgcagcaggtcgggagagagactctgcgggtttcaacttccctggcctcactttaatttggctgccgttcccacgctgcctacctccacccacctccaccctgagacctgacacccagtggcccagggtacctggtggctcccccaaccgatgatggggataggttccgtgtctttcacttcctcttagtaactcattattattgcctgattctcatgtgttctttatcgcattcccagacttactgaccacaaaacatttaaaacattttaccaacaagaacttgtggggtttattgtctgctgaaaggcaactgccaaaaaaggaaaaagaaaaaaaaaaaaggaatgtctcaaagaaccattaggaaaaggatcaagatttgtctggtgtgtgtgtttggtgtgtctgatagaaatgcaacatgaggcacacatttaattttaagttttaaatgtcctagtagcctccttgaagaaatgaagagagacaagtaaaagtaaaattaattttaataatgtattttgcttaactcagtatagccaaactattaatcatttcgacatgtaatcaatataaaaattattgagatattctacctgctttttttttcatattcagccttcagataggttgtgtgttttcacctgcagactggttgaatttgggctaatgccattttaagtgctcagcagccatacgtggctcgtggctgtgatattcgggagtacagctcagctctggaaccacctatcagaaagagaagcccaaccgtagcccattagatagagtgaaatttttgttttattttattaagagcaaaatattggccaggtgcagtggctcacatctgtaatcccaacgctttaggaggctgaggcaggagggatcacttgaagcctggagtttgagaccagcctgggcaacattgcaagaccccgtctctacaaaaaataacttaaaaagttagcggggccggtggtgctcacctatctatagccccagctacccaggaggctgaggcgggaggatcgcttgatcccaggagttagaagctgcagtgagtcgagattgtgtcactgcacttcagcctgggggaccaagccagaccctgtctgcaaacaaaaacaaaaacaaaaaaaccaaaaaagcaaaatattgccaacctgactttttggatcctcttggcaaaacacagatcagcgtccccagaggcagcagagctctgagtgaagcagtcggggggatgctctgcctgccttccgctcaccagcccttccctgtcgtcccccgcaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaactacttggggctgctgccatttggttgggtgtgaaattgacaggacctaagagttttactgaggcccagagatcaattctaggtcttcacatattcatcagatattcctggggctcctgtcttgtgccaggctttggacggattacagagatgccgagacaaagatccaattcctgctctcaaggaatcagaatggtgacacgggacagacaaaagatatcttaacagggtgtgatatgtgctcaagtggaggatatgcaacatcccattcattcattcattcattattcattcattcattctttcaaatatttaatgagcacaccctgccagatgcttgtgatgcagaggtcagaggcccttttctgctcctggctgggctggaaagaaggcatgtcaggcgatgagggaggcctcctgaaaaacctgcagcttttccctacgaggagtgaacgcagttaacaaagggcagcttaagctccagttttcctaatgacacaaaatttcaagatcgctagagagggcaaaagcaaatgaattctgttcctttcctaaagtttcagggaacctcagaaacccagagaaaagacacacccagagaggagggagggttggagccaggcagaatgaagttggaattcctactgttgagcagggtgagctgaaggaagtcatttcacttcattgggcgtcagtttcctcagctatgagctgaagataatgaatggcccttgcatggcagttgtagtgggggcaaaaggtaagatgtgttgaagagcccagcagaaggcctgacacagagtagggctcgatgcattgtagtgaacgacagacaggtgatgtgaggactctgtgggtggagagcaggaatgtgtgtatccaggcaccctctggcattgctgaatgcaccaagcaggtgtggtgtctgtcccccagacttctgacacccctcatttctcactctgagccctgcttcggagtactctgctaccagtttcattggatgtcagcagttaccaacccaaatgcccctgcaatggcccaccaacttgatcatccagatggaaaatcatggccacctggaggaggaaatagccaggcaagagtgggcagaggaaccatccagcccaggactggggtctctctctcctcctccctctgccatcattgttgggatagggtggagggagtgagtggggcaggaacgggctgagtgtgcttcaagcccagactcactcactttctgaaatgttttttgaaaaccccaagcacattgcgtgcgcgcgcgcacacacacacacacacacacacacacaaacaaacaaaaaaacactattgttattgctataatgtctggcaaacagtaggagcccaataaaatttttgtaaacttttatattacatatacagtgtacacaagtctgtaataaacagcctgattaatgtctttcaaatgaacacacccatttaactaccactcaaatcaaggtataggacactttcagcacccagaagtctcccttaaggccccttccttcaatccctcccaagatagctcctattttaaaaaatctgtttttgatcgatacattttttgctgaatgaattcaggaggcttagcaagattagcctacttacagctagtgatggaagagccaagctttgagccaggtctatgccctcagatccaaggctcttaccctcaagcagacacatgttcatagttacccacgcaagcaagagggttaagaacctcaacttttctacctgcccaatggggtcatggaatctgtctcccattgatgactctgtgagggaatgcaatcagagggcctggactgcagacagacagacaccatgacgccagttac

SEQ ID NO: 15305 - DNA, 18824 bp, Human
gccgcacttgcttcccctgtccctgtcgggagaattttcaggtctactcgaatgaatatactcaacagtacaacattatgttctgatcctccgtactaactcatccctaccacatatatatatatgtgtatatatatgtatatatatatgtgtgtatatatgtatatatatgtgtgtatatatgtgtatatatgtatatatgtgtatatatgtatatatgtatatatgtgtatatatgtatacatgtgtatatatgtgtatatgtatatatatgtatatattatgtatatatatgttggtttcaagaaaatccttgagaaactgaactgcccctctttctgatttgtgaggaagaaaggaaaggagaggtattgaaaaaaatattgtacctttttacgactctaatatcaggaacaattaaagtcaggaccatatctgaggcagaaacaaagcaattgcctatccgtacaaaggtgacgctcaaagaatactctgtcaggaacacagtgtagggggccgtgtcttaagtaggtgaagagtaatttcaagccatcaattatttttcagtcttcactgagtccttagtttagtattgctggataacaaattatcaccagctttagtggattaaagtatcacaaacctattatctcacagattctgtaacctggaagtctgtgtatatcatggttagggtgatggttaattttatcggtcaacttgactgggctaaaggatgcccagaaaactggtgaaacattgtttctgggtttgttagtgtgtttctgggaaaagattagcatttgaattagcaaactgaataaaaaagcccccaccaatgtgggtggccaccacctaatccactgagggcctgaaaggacaaaaaggaaaaggaagggtgaatcctcttttctatttttttttaatctttaacttttgtgggtacatagtaggtgagtatatttatggggtacatgaagtagtttgatacaggcatgcacagtgcaataatcacatcatggaaaatggggtatctatcccctcaagcatttatcttctgtgttacaatccatttatactttgttatttcgaaatgtacaactaaattattattggatatatacacctgtagtgctatcaaatactaggtcttattccttctttcttttctttttttttaaaaacccgttaagtatccccacttccctcccaccttttcttttttcttgagctgggacattcatcttctgccttttgacattggagaccctggttttctggcctttggactctggacttacatcatccctacccctctccactctttttccagtaccttgcatagcgcagcacctaacctgcacatattcaatgaatgcaattaatgcatgaaatggcgcattaaggaattatttctccaagtgcttgattattctggtgaaatatcttcaccaaacccgggctctcacggaggagtggtgtgtttacttaagtttctgtttcagtttttcttattgttcttatactatatatgaaaagatttatcgtatatctcaaagattaacgtcctctccctataaaataatgttatttgttcgatcaggcttttctccgttatgcttccaatttctcgcatcctgcctttctaaagtccgcactaagcgttgtgattcccggacttctagccgctggccgcactgacatgtattcggaaaagcaattccaaattctgtaaaatatcttccggcagtgatgcgatccgaactccggcagtgggttgtcaggcccaggtcagtcctgtagtgcgtaacggaactcggttccggctggctctgatcgcatcactcctgcatcctgcaagtaacgccctcgccagcttccacctcccgatctaattgtcccagaagtccccgcacttccgctgtacggctgagtgtttgccaagatggccgcgcccgtgcgctattaccgaagggcgccgccatcgcggctgccggacccgctaaggccgccctccgggtagccgccatgtcggtctccagcggcgtccagattctgacaaagccagagaccgtggaccggaggagaagtgcggaaacgaccaaagaggccgggcgaccactggagatggctgtgtccgagcccgaggccagcgccgcggtgagagctgtgatgagacagggtgttttggcggtcagagatggtgtacttgcggggcagtgattggagtagtctgtgacgataggtgatttgggaattggtggaatcgatgctagatggtcttttgggaggtcggtgttctgagttatctgtggggttaatgatttggctttaggatatcagtattaggagggatctgcagagacaatgatggggaggcgtctgtggcagtcaccgagtgtcggagtttggaaggagatcagaaatggaggctttgtgatgtgtcagagatagggaaggaccgtgggggttggcggtttgggatgtctatgggagccagcgattatgggtgcctgtggtggttagagcctgggttatcaaagagggtcagtgttaggatttgggaaattcagtgattgggagcatctgggagcatcagagattggggcttgggagtcagtgacggtgatgtctgtggaagtttgattagcagtatctttgagggtcagtgggtaatggaggaatcggggggccagtgaggggggaatatgactgttggagtttggggagtcaatgttgaggtgtctctggggatggtagatgatttgtatgtcatctggggagaaaaggtaattggggatgtatgcaggtcaataattaggtggtgtctagcagtaataactgtgctttgagtaatgaggtgattagtaggaattaatgattgaagatcctctatgattctgtgactagaagtctaagggggtcaggagtttgaggggattgctgcatttaatgattgagggttctttggtggtcagtgattggagatctgtggaggttaatgattgttctgtggagagtgatagttgggaacttgcagagatccataattgggagaagtttgtgaaggttagtgattggggagtatttgggtgtcagtgattgaaaacttgcaggaacagtaggaacagtctgtaagatgagcatttattttatgccagggggtattttttattttatttgtttggtgttgttgttttgcagtccctgctttgtcctcaaaaccagggaatgttttaaatgctggagacacaccaggaaacaaaaccagaatccctccctcaatgacttacattatagaaatatgaaagatatcataaaatataaacaaataaaattattccagacactaataagtgctgaagtaagtaaaagaggatggtgtggtacagagtgattgagggtagggagtgcatgactttagccaggttagtcatggaaagctttccttagcaaatgacagttgggttgaggcataaatcatcacaaggaggcagccatgcagagatctgaagaaagagtgtttcaggaagaaataaacatcaactgcaaaggacctggggtaggagtaaacttggtgtgcttaaaaaagagaaggaagattagtgctgttggagcacagtcagagggaaagtagaaagctgtgaatcatagtggtaggaaggtatcagataatgtaggattttattggctagtgtaaggatttggattttattctagatgcagtgagaagccattgagtttaagcaggggaatgatctgttctgactgacaccttgaaaagatcaccatggctacctcatggaagacggactgcagaggggcaagagtaggtagatatagggaggtcagttaggaactttttgcaatagtcaaagacaagagattatggtgatttagaatagagttgtagcagcaaaatgaaatcaaattcagaatacatctggagataagcaatagaacttactaatgtattgatatatggagtatgaggaaagagaagaatcgagatttacatctagacttttaacctgaagaaccggatggatggtgattctattttctgaatggaaagggttatggtggaaaagactagatttggtggatggaaatgggatctggggtgatgtcagtggctctattttggccgtgtcaaaatgctcattgcacatctacctagagatattgggtagccactatatatatgaatctggaacttaggaaaggggtgagctagggaaccatttttgaaatgcatcacaataaagatggtatttaaagccttaagattggctcgggtcacctaggaagagaagacagatagggaagagaagagagccagggacagagggctgggtcactctgacatttaaaagtctggtagaagacaaaaaacaacagagagaataaggggtgcccattgaagtaagaggaaaactgtgcaagtgggtgtcaaagtagcatagagaagaaagcctttcaagacaatagaagtaatcaattgtcatatatgcttttgagtcctaaaagcaggactagagatcatttgattttgtcagtatgtagctcaatggttattttgattgattagaactcttttattggagttaaggggataatatcctgttagagtgagttgaaagaatgagaggtaatgaagtggaaacagcaagtataggcaacagttatgaggagttctgctggtaaaggaagcagagaaatggacgttgtataggatatgaaatcaagagggggttttctttagatgaatgatattaagacaactctgtgtgtcaatgggaatgacccaaataaaagggagacacagatgttacaaaacagaaagaggtacttgcaggagtgaagtctttgggaaggcagttggggatgggattgagagcacaaatggagaaactggccttaggtgagagaaggaagactttccattttaacagaagagaaggtatattgtatatgagtttggaaacaggttgctggaattggtggtaacaagacagggtaattcttgtccatttggatttattttctcttgaaagcataaagcaaattcatcagccaagagtgggaaaggagtagatgttggagttttcagagttaaaaaggagaatgttcaaaataatcacctaggaaaaaggaaaggtgtattttctagggttaggtagtaggactactgacaggattaggtgtccatttggcatgtgtgttataaatttgaagttagtccactcagcagtttgatttttctcttgcaatgttcagttgcaaggtttcaggcagagattaagaggagagttggatttaaccaaggttgaggctttgacaggtgagtacagtggagaagaagagaatcaaggaagttaaaactttatagtttttaattgattgtgtatggtgctagaacaaggaatctgaacaagaaagaaaggctaggtaaaggtggaagattgtgaaaaagtggttaggatcagagggctcaatgagtttggagaattattggagtgaaagtactagaaaaagtagcaggataggaaatgatggtcagagggcggaatgtcttagagatttttgcaggtggtacagtgatggcaaggtgtaagtgcagataattgatgaataggtggctgaatttgagtggaagaagaggttgctgacctcatgaaaaagagaggcaagggtgttgaatggctcttccacgttgatacggaggtagtgcagcattatggcaggaatttagctggtgctaaagttttcagtgaattgggtgggatgactgcagaacagagttaacatagaagtgaaaaactgctatccttagacaggcctgctgcaaggtctgctttttgctgtcatctgggaaattagatttcaggaaggatcccaccattcctggaactgattaagagtagttccgagtgcttaaagaatacacagtgtggtttatgctgaacacctgctttcttctgggagtctggaatttttgtacatgcaggcagagagtgcctacttgaccagcccccagtgaaacccctaggcagtactggtctctaatgagcttccctagtagacaacatttcatacatgttattataactcatttccagaggaattaagcatgttttatatgacttcactgggagaggactcatggatgctggtgcctggtgtcctgtggactttacctcatgctgattaactgactttgtacacttttgctacaataaataatagctatgagtacaattatatactgagtcatgtgagtcctcctagcaaatcaccggacccagaagggttaatggctgaaaacctggtgatactataaataagctatgaattttgaaggaagaatgagaaattgttgaaagtaatcatttacctcatctttagaccctgaggtacatgggtcatggcagggagaggggtggtgcaggaaagacagcctccactcctctgaggctcctataaggaagcaggatcctcaggagacaggtagatttcaggtgaagcatgcaaatgaagggagtggctaaagaggttgagggaggagtggaatttgctggcagtaattagagtttctataaaggccactgcttgagaattctgtttagtgattggggattgataagatgagggatttggggtaataggagatagattaccagtgtcctgtgggtatcattggttgaggaacctgtgagaatatgtgattggagtgtctgtgggggcaagtggctggggagatctgctgctgctactgattgggaggtttgctttacccagtcattttggaactataggcccagtaattaggcaaggctgtctgtatcagctcagtgattggaaggccagtgacaatcaatgatgggaaattattggtagtcagtgactacaggtctgtggggctaatttgatgacttttgcaggtaattgaatggtggtctggccaggcacagtggctgacatctgtaatctcagcactttgggaagctgaggtggaaggattgcttgagcccaggagtttgagcccagcctgggcaacatagcaagaacctgtctctacaaaaaaatttaaaaatcagtcaggcatgggtgttgcttgcctatagtcccagctacttgggaggctgtggtgggagaattgcttgagtccaggaattcaaggtgtcggtgagctatgattacgctattgcacttcagcctgggcaacagagtgagactttatctgctcccccaccccactgcaaaaaaaagaaggaaaaaaaatttggttgcctgtaaggataagggattatctttaaatgttagacaaacatgtttgaatatatttattagtatcaaaattctccaatagctgtgccgtcctcccccacctgcctaataagaggacttcaacatactttaatttcttccctactcccacccccctagttagggttctgcttattttttaatatcatacctcttgattttaaggatactttcataacagttgtacaagcacattatcaagttacttagatttaactagacattttactggttgtatttttcatagctctgtcttgcatattaagtctttcccaattttgaaatctttattctgatccatttttacttcttttaaaaatcattcattctctttttctgctgcttttcctctttctcctccccttcccccttcctctatttctccccaactttctcctttatttctaaagaacattggtagtgtacattctgcattcttacatgcctacaatatcttacttttgctgccaaacataaataactttttttttttttgagatggagtctctgttgcccaggctggagagcaatggcttgatcttggctcactgtaacctccacctcctgggttcaagcagttctcctccctctgcctcccaagtagccggaattacaggtgcctgccaccatgcctggctcatttttgtatttttaatagagaccatgttggccaggctggtctcaaactcctgacctcacatgatccacctgccttggcctcccaaattgctgggattacaggcataagccactgcacctggcccataaatgatttctttgactggttacaaaaatcaagggtctcaattcttctacctcagaactataaatactgctcaatagccttttagcatcccctgttatagaagaggagacaaagattgattctgttccttttttcttttttttttttttttttggctatttgtctttctctccgatatgcacgtgattctatcctcttgaataaataaattcacaatagggacatttctgtttgtcgagacagggtctcactctctcagccaggctggagtgcagtggtgtgatctcagctccctgtagccttgacctcctgggctcaggtgatcctcctgcttcagcctcctgagtagctgggactacaggcatgcaccaccatgcccagctacgttttgtattttcttgtagagatggagttttgccatgttgcccaggctggtctcaaactcctgagctcaagcaatcctcctgctttagcctcccaaagtgctgggattacaggcatgagccactatgcctagctcagtagggacatttcttaatatggtttttgtttctcaaaataatgaaaaattgagtagagaataggtatcctttataatatcatgatcaacagtgagtagtcaaggtaagaacaaattattatcttgtccaaatcactcaccaaatgtggataacattagcatgaacaggaatatgctatcacaggtatcagtaacattcaaacatgtgactatggcctttacccagaaggaatggaagcaactggatcctgctcagagcaacctgtataatgatgtgatgctggagaactactgcaaccaagcctcaatgggtaagaacaattcctttgtaattcaaaatgtgtccactgtgataccttctctctggagtccttgataagtttggccttcatttttgtgggtcaaagggctttcttcttttttgggtactaggcaggatatttgtgcccctgcctccaaaatggaaggtctatttagctgacctggcattcatattgtgaaactccagaagccatgtattctttaggccctgaagtacaaatgctgcggcttcatttctgggatggttgttctaacactcagtttctgctatttctcatgagcagggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaagtaagttgtaactttgaaatttttcagcaaataatttattctgaaattcttcttaaagatcctagacctttctttcttaactagaaaatagcaatagaaaaaatcaggatttcctgaggaaagaatatttcaaactacaaagattctgtaacctgagagattctaatatctcttccttttatgaacttgttcacatgagaggttctttgtgaggttcgctatagtagtgagctagtgttaactacgggagtttggttatatcacctgtatcagtcaatttccactcagttttgctccatgaaggaatgagcccctgaaattttagttacttacaataagaaaaattgattgcttgctcaagccacagccctattccatattatctttatttggggacctatgctgaaagagcattctccatttagcaaattctggtctcatggcagaggcaaaaaaaaacagggtgagtggaaccacatggtaactcttaaagtcactgcttggaagttgtagatatccctttcagctcatattttattagtcaaagcaggccatctggccactcctgagttcaacatggtaggaacgtataatccttccactgggaagtgcgctataattcaaaaggctatgcatttggaaggggctgggaggtataatcttgccacaggaagcaataatactatctgtcacaccactcaggttgtggtaggataaaaggtgaaaatcaaggctctgaaacttggtaccagcccctcagatgcctaactgacccttccatatagccacatatccttattcctgtgctcaattgctcagtcttcagaaggagcagtgaccctcttagctattctcgatcccactcctgcttaccttatataaatcagtgctttttaaaaaaagcatcctcccttttcctaatatcctcagcttttctccttttctccacccatactccgagaccctacggtatcaaattttctcctatgtattggacattcttagatctgccctctttgcaaatgtcttggcatgatgctcctgccctgagttatttccgtttctctcctttcactaggaaattctctagacccatgatctatagcacatcatcatttccattttctccttaactcctgcagtcaaatcccacagaattcatgcctctatctaaatttctgactttaagatcaccactgcttacttttcagtgcatactttaatcgtttttgttagcttgaagttctcacttacccagtttgaattgtacaacttgaatcagatcttatcttctaagtgcttctttatcatttacttactagcttctcttccttctcattttgctgaggtgtccctaaggttttgtcttctaccatctgttcttctttaaaattgtattgattattcattgtgcaaataaaagctatttattctacactcgtgacttccaaatgggcagctccaattcctttgtcttatactcatatttgacctacttaaacaacagcttattcttaggatatcagaaatggaaagctttgtctttctctctaaattagaggttcttttcatcttccctgtttttatcagggtgtgctctgattataggactgtctcccatagagttactatcctgtcttcagtttctggttctttttctcaattttcagtgtcatcacacaaatcaggttcatattatctcatacttaatttttccaattcttaggtaaatttgctaaatccatttttttccctaattttttctcttttttttcatagagacagggtcttgctgtgttgcccaggctggtcttgaactgctggtctcaagcagttctccctcctcagcttcccagtgttgggattacaggtgtgagccaccatgcccagctttaattgatcttacatgttaccaccaaacattaaaatattcagttattatttatgttaccatagtccccaaattattaatagcagaatatctgctatgtcttttaagtttcttttgaccccgaattgtccaagactgtatgaattccctgagaccagaggaaccagtctttcaaatgacaaatgaagagactcaatggagtttctgattcatccattaatggctccagttttggctatccttacttttcttgttgacatcttaaattacagctaaaaaacaatcctgagtcacttaatacatctttataattgctacagtgactctcttcttggttcaggttctctttttttttttttttttagacggagtctggctctgtagcccaggatggagtgcagtggcgcaatctcggctcactgcaagctcctcctcccgagttcacaccattcttctgcctcagcctcccaagtagctgggactacaggtgcccaccaccacgcccagctaatttttttgtgtttttggtagagacggggtttcaccgtgttagctaggatggtctcgattcctgaccttgtgatccacccgcttcggcctcccaaagtgctgggattacaggcttaagccactgcgcccggccagttcaggttcttatatactacttaggaggctcttcaaagaaggactgttctattctctccaataatttgctgggccaagtgagctccatatttgtttctgaagttacagttgttttagcttagcatttatgttttagttactgtctcaaattcaggaaaaacttccagccatagtcaattgctcttccagacccatattactataccaatttactcgttcaaattctcctcctttccttcatggtgatattttcttgtagtatcttatgtcttttcctgccggcagatatcagttgggaccagccaaattcatcattgtaaaggttcttataatattacatgtcaaggggaaagttttcagttttgattcctttctttccagaaggaaatttttcctcaatgttttccatcatccttgggcattgaaagacacagccttgtcatggtacctaaaagtttgttatactctctgcatcacttaaaatttcctaaatgaaaaagcagccagcaactgcacttctctagactccctaatatatatatagatatatatctgcctgtatatatatagatatttatctgtctatatatatatagatatatgtctatatatagatatatatctgtctacatatatagatatatatctgtctatatatagatatatatctgtctatatatatagacagatatatattttatttttcaaaaactgatcttctgcaacatgggaattaatctctctaatgtcctttataaaagtaataatatttcctttctatccattcagataccgtaactctttttggtttgagtccagttttcactttctcagtgtaatgtttctttaccatcaaggtggctattcacttcctgcttctttctctctgaagtcatggggatttttatatctgcttctctctaagactgtttaattctcactctgaagctttttctgctattccatgctatagcatgtagctgaaaaatgacacccctaaatggtggccccagctcttaagattataggtttttatacatgtagtatccatagctagctaacagaagtctataaatttcaatttcaggttcttaggcaaaagaatattattggactacctggtgtttaccacggtccaatcaattgtttttagccagaatttggattatgtaatacaaacatagtggcccacagctttcagtgtgggtaatggtctcagagaagggaagcagggattaagaagacatctcaaaatgtgtaagtgtataatgtatggcagaaagaatatgagcaaccacttagagctgggaataaacttaaaatttataactgacaattagaaagacctgaaaagaacaaatatatattccatagcaaactattggaaaacaaaacaaggttggatgtacactacaaatcagattgagtaaagtttgtttgctaagctaattactatgaattttatcatttgatgaaagcatcaggtaatttagagaaactagggatttttaaagtacaagaatatcattttaggggtcatttcagtggtagcaatagaaaggaaaagatatgtcagcaggaaaagatctaagcactacaagaaaaattcaccatgagtagtataaagtggataacctttcctatttattctcttagccacttatcagctcatcagtacttcttggtggactcactttatttttcttttctggcttttttggatataataacaaaagtttatgttagctagcttcagtaaatacaggaatttgtgataaggacctgggtacatcccttacaagctaagggcaagatagttcagccagtcctcaccagggactagaaataggaactaggaaggaactaggaagccattgggaattgaaattgtgcaaatgatctctttaaagacgcagttcttatgtctctgcttctcggtgtgtggatggttcatactttgacttgacgagctttctgtttacgtagagaaaatatggtttactagtacctgctttatataatttctaaatttaagtaccaagtggagactaactggagtcaaatttgttagaagaaagaatcttgttggacatcttggtttgagtcagatttgtctccaactgtgcccatggagaattggggtaatatagtataggctgcaggagcaatatattatggccagcttgggagttatcagaactgggcagcttgggcttataagaaacctcaaaaagtatcagctacaatcataagctcttttaactccatctattccctgttcacttctccctgtgtttatttcatcttctatcccaggttgctcactcatatttttaagcagcaaaaactttaaaaaatcactattgtcacttttcccacctctttttactacaacattttccccctcaagtccattcaccctagttgtttcattcacattggtataccaggcttgaataaaaatttaaccctacaacaggtcatttctttaccagttttattccaaaatataagagtacaaagattcacaagaatatctcactgaattccattttagaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagcagaaatctttttaaaagggttgttatatatgtaaaaaatgttaacaggaaaatgagagaaaataaagcagctgaggatacaaatgtgctggtagggagcgatattcaagatatattgtgaagtgtgaaaaagtaggttgctgaaccatgtatatagtatgttcccctttgtgtacaaaagggtatgtttgtttaacctctgtctcttatctctgtatgtgtatgtatctttgtatgcatatatacatgtatctgtatgtgaatagactttgaaaaaatacagaataaacttcatggtggttgccattgggcagaggagtataggactggggtctaggataggagcaagacttccttgtatatttggatttttaaatcatgcacatgtattatttttataattaaaatattttaatatgcataaatcaacattatttaaggttgtcactgagcccctccacaacatgtgagatcaacatgtgagatctcagattttgacagagttaaaatctttgtatgcttattcatgaatgatgatgaatctaaagtatatagtatgaaacttgatgttgaattcataaagactttttctatcacacacaagttctttcattaacatagtgaattataacagcactgtttctacatttgccattttttgatgttgaattgtgattgcaggtgatgatgaattgtgattgcaggtgaatgaaagtgattttatgaataatcaccctgttttatctcatattcaaagaactaacacacaaacacctcaatcagggaattcgaatgaaacaaatgtcacccctccctgttctcgctcaatattgggcattatttactggatcactgtactctttctgagtgaacccagagttggcctcagaatcattgtgcagcgtgcattccagaaggtactatgcatcaacttggactgtcacaggagacctatttgccattgcacacctggattttttttactcttgagccatagattaaaaatacttctggctgggcatggtgggtgcctgtaatctccagcactgtgggaggccaaggtgggtggatcacttgaggccaggagtttgagatcagactagccaacacaatgaaaccccatctctactaaaaatacaaaaaattatctgggcatgctgtaatccctgtaatcccagccactcaggaggctgaggcaagagagttgcttgcacccaggagatggaggttacagtgcactccagcctgggcagcagagtgaggctctgtctcaaaaaaaagaaatacaaaaaatgcacaaaacttctgaactattttgaaatctaagttgttacactaaaagcagagacataagtacagaaatggttttcaaaaacatcatacctttattttaatacaatattaatttacataatataaaatattataatttggcatgttatcttttatattttttaaagcacaatccctacattatttcatttattcctcagaactaacatatgagcagtaatcgggacttgtctagtcatgttcaatcctgttgagtaaatatttcacctagacagtaatttagcataataatgggccccaaagaaatatgtgcttaaatgccatctttacaaatatttatcattcaagctccttccttcctgacctcatttcagagaattataatgtgttaatataatatattgagaatggaatatgtgttcgtgtatgtgcatgtgcacacatgcatacacatgcacgggttgaaagctcaactcatgaatatatcccctcatttccaagtaacttatttatcacatgggaagaaaatgcaatatgaaagccatttctaccagtaatttcttaacaagtggaaatatagcactatgcacagaatgagtcatcactgtctagagctgtagaaagcctgcactttttagatggatgaaacagttgcaggttatggctatgttgaatttccacatgtcttggggaacccatagtattgccacatctgagacagtgagaattataggtatgcctgaatgatataaatgaatgctgaaagccactttgtgcagtaataaaatgaattaaaagttagcattgatgaatgaggaaaggatgtctaaatacaattggaggttagtataggaaaacagacacacagtggtaagtctgaatcgatacgtaaactctagtgtgcataaaaattgcctgaatgatttgttaaaacacagacttgagaatgcaaattcttgggcctcgtcacagacatattggatcagaaaccctgtgggtgggccttgagaatttgcattttaataagtttccagtggattcctgtgctgctggtctg

SEQ ID NO: 15306 - DNA, 9382 bp, Human
ttgttctggataccagtgaaagagggatgtactgactgaatcttacagaagggacatgatacaccatttgtttctgcactgactacatgggggaatcctttgattctcacataagcaggggtcttaatcttgggactgcctgcccgaaggggtcattcccagctctaacagagaggtggctgagagtatggaatgttccatgccaagagcagggaggaagtaaggacagtagatttaaccactggagaagggaaattcatagagaggcctttggtattgctggcaagagtgtgagctcacagacaacggacctggggttttaaaaaattctcatttaaaatcttaaatttaggctgagcgcagtggcttacgcctgtaatcccagcactttgggaggctgaggtgagaggatcacctgaggtcgggagttagagaccagtctggccaatatggtgaaacgctgtctctactaaaaatacaaaaattagccaggcatggtggtgggcacctgtaatctcagctactcgggaggctgaggcacaagaatcacttcagcccagaatgtggaggttgcagtgagccgagatcgcaccactgcactccagcctgggcgacaagagtgaaactccgtctcaaaataataaataaataaataaaaccttaagtttaataactactgtattagtttcctagggctgctaggaaatgtgtcttctctcagcactggaggtcagacacctgagaccaaattttcagcagagccatgttccctttgaagattctggggaaaagtccttccttgccttttgctagcttttggtggctgccatcaatccttggttatttttgacgtgtcactgcatccctcccatctctgccttcggcgtcacgccacatcttccccgtgcttctctctgtgtccctgtgtctgagtctccctcaccattctcttataaagataccggtcattggatttaaaacccctgtcatccagttcaacctcatctaactaatcacatctgcaaatcaggttcattctgcggttcggggtgcacatggattctggagggggcactgttcaacccaccacaaacactcagctcttactctatgctgggtactgtcctagcgcattgcaggtgctcactcaacaatgctaggagctaggaactattattatccccatttacagatgaggaaaccaaggcactgaaaggtaaagtgacttgcccaaggtcacacagcagtgagtgccactgtaggctgcctggctcccacgtccatggtctctaccacgcctttcccagctactccactcccggctgagggattctgggcaagtcacttcacttcttggagactcaactcctctgcctgtaaaggggacaaatagcacctacttcataagcttgttgtggggatttactggacacctgtggcacgtgtaaagtgcctggtacacagccagcacatagcaggtgctcagtgaacggaagctcgtaacagtcatcattgttaatgtctctattatttgcaaaggctagggcaagcctgggggctggagaaggaactctggagacaggatacctgggttctggtcttggctctgcccatagacttccctgaggtctctggcaagtcacttcctctccttgggcctcagttttttcctgtgagaaatgggcccaatcaggcttgacctgctggctcacagagctgtgaggtccagatggcatgactcagcagaaaggccaggtcgctccccatcctcgcatgccctctgtgggggacttttggggggcggagcccaaccctggtgctccagggccctattgtgcttggccaatgcctcttctgaagcagccatcccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcgggtaaggctgccgctctctgtggtagggtggatgtggtgatggggagtccaggcagatgggccctgctgggcaagtgcggcctgtctcggggtctcaggcttccactcagatcatctgggattatgggatcctttgaaggtacagctctatcccctgccattccgtgggcctcttggctgacattctatgagtcaaacatcctcaccttctgcactgtcctcgtgggctccaaggggaacccttgtgttaatgggaacctgctccagagaaggctttgtcctgcctgccactgccctgcagcccccgtgcagacacctagctttgcccagacctcccagcccttccttctctaatgactcccctctctctgtggcatctttcccttagctcttcctgtgtcccctgcccacatcctggcctgactgtggacagacacctggggtggcacagcgtgggcatgtggccagcagcttttgggttgggcatgtggggcttatgggaagaggtgaagcaggacagagattagggttgggagacattcagaggcttgggcacaaggagagacctggactggggcaggacactctcctgtgagtgtggagtgccagagctgccttccagcccccactctgccctaaatcccggggtggctttgagaatacccttgcccacctggggctgtctccatgtctgtatgaagggtctcagaaccttctagctgtggtgtcatgtgggttttgtttacttttagggacaaggaaaggtcgtggcagaggggcaatgaggagcaggtccctgtggcagtctgggacgcaaagggtgtggggcacattggcctgttccgtaggagcctgagggctccttcagctgtcccgtgcactttcaggaggaagaggaagcaggcctatcctgaatgaccccatcatgttcattatacttttgaaataattcctaacatggggctgtgggctgccttgcaaggtggggagcaccccatcattggaggagtaaaagacaggactccagctcttggggagcagtggttgatggagctatggacagatcccacatcttgagagagttagcccttctgcagggcaggttgggaccccagccgcacacctgcttcctgggttcgctgtgatgcctgaaacgccactcttagggatctggcctcccttgaaggtgtgtggcctctgattagttgtaagacattatcccttaaaaggataagtcattttgaggagaaggaggaggaagaggaggaggtggagggtggggagcagatgtcagccaggtctgctttgaggtctgagactgatgcagacccccagagctcacctgcctcctagatctatgggaagtggtacaacctggccatcggttccacctgcccctggctgaagaagatcatggacaggatgacagtgagcacgctggtgctgggagagggcgctacagaggcggagatcagcatgaccagcactcgttggcggtgagcactagggtggggctggaaagctgagagagacccagagacccacaaccttcccagccccgtccatcctgggaagttgcagatctctgcttccagtcaggaccttcccgctgaaccccagatccctctacgctcctccaccaggacggcccttttcaggtgtcctatctattcctcgagggcagtgtcccagcactgtgcctgttctgcaaactgctcctcccccttgggcattccttagcccagtgtgggtacttcagccccccagggacccaacctgggaactgggctcctctctcccctgtcacccatcatcaagtcctgcccattctcctcctaaatcccccccaacctgttcacttctcccctctccactgccaccatcctggtccaagccacctccctttctttcctggttgtctgccacaacctctctactctttcctcacctctgacctccacccttccaccccatcccctcttcacccagtaaccagaaagaccttttgaaaactcacatctgctcgagacccttccatgactccccaatgccctgggagtaagattcaaactcttgatgtggctttccaggaccctcccagcacccagaactcctgccacacactctgctatgtactctgagtcctactcacgtgaacctgctttcagttctggaactctcacgcctccaggtccttgcacctgatgtcccttttactgggagcacctctcctcatttccctgggctaattagttcctgtggattcttcagaactcaggtttcatgtcacctcctccaggaagccctcccagacacccaggttcaggttacatgcccttctttgtgcccgaagaggacctcacacttacccccatgtggtacttctcacactgattgcatctgcctctcacctgcctgcctgacccacgcaattgcaagctccaggaaccccagggaatggggtctgtcttgctctctcatgtatccctgccatgtagcacagggcttgccacataggtgctgcccaataaatatccattggataaatagtgctcattgtaacaataatagctaattcgtatatagtgcttcctccaagttctttacatatgtgtcagttgaccctcacactaaccatgtgaggtagaaactatcatgatccccattttataaatgagaaaactggggcaagagagacacagaacaatacatggatgactgtaggaattcatcactccagctcctcctgcctcagtataatgtgtagatttgattaaggaaggcggcattagtgctggctttgccaggaggatggcatggatttgtctcttcttctttgtccctccatcatatggaaaatgggggtctctcagggctagtgtgaggattaaacaagacatttggaaatgttcatttccgaattaaaaagcaaacaaaaacacacaaacaaaaaaaccccaaaaccaaggcatttggaaagagccctgcaggagggttgagtgtcaggaccatgatctctaccaggagtgaccttccttttgatttgttcatttctaggaaaggtgtctgtgaggagacgtctggagcttatgagaaaacagatactgatgggaagtttctctatcacaaatccagtaagtggagtggaaagagacacatgcattctctcctttgcttgaaaataccttgatgtcctcagctccctctgcctctgtaacctttcctcccatttagctgagatgtcatctagccttcccccaaacaactcctcctcttcctcctcctccttctcctcctctcctcctccccttccctctctccttccctgcccccacccagtgcccatgcccagagtagggtgatggtgctgatttcgccagtcttcatgtcttcttaggcacctgctatcagctgataaaaatttactaagcatctaccacgtacagtgtgcatgatgctaagtgagagagggatttggacattaatttatttgttagttcagaaaatgtttattgaatatgctctatgtgccaaacaattgtgttacggctgaatatatgaatgtttggctagatagatggatgaatgaacaaatgattggtgactgaatatatgtaaggataaatgagtcaaagagtcagttacctaataggtaaattgatggagtgataggggaaagaaggaaggaagggagaattgatgtatggagaggatagatggattgagtgatggtggatgaattaatgtgagtacatggaggagatagatgggtggatagggagagattgaatatggatgaattgataaatggagatatggaaggcatgggtggatagatggatggatgaggagatgatgtgtgagtaaacaggtgacggacctccagctagaagagtctactgaccactgatccctttggtctgcctgcacctcccatgcagaatggaacataaccatggagtcctatgtggtccacaccaactatgatgagtatgccattttcctgaccaagaaattcagccgccatcatggacccaccattactgccaagctctacggtaaaggctcattactagatgtgcccattggagttaagggtgggaggacattgatttatggacagtggagtgggtaagcacagggagttttgctttttccttctgacaaaactccaatttggagaaaggtacaatcactgagtctccctggaggaggtgaaattctctctttttgatctctaaaattccaggcccagagaattacagagcctccaggcccttaaaagaaccagtggggactgggggctgtggctcacacctgtaatcccaacactttgagaggccaaggcaagaggattgcttgaggccaggagtttgagaccaccttgggcaatatactgagacagcatctctacaaaaaattaaagaattagctgggcatagtgcatgtgtgcttgcagtcccagctactcaggaagcttaggcaggagggtcacttgagcccaggagtatgaggctacaatgagccatgattgtgccactgcatttcagcctgggcaacagagcaagaccctgtctcaaaaaaaaaaaaaaaaaaaaaacagggattgagaccatcctggctattgagaccatcctggctaacatggtgaaaccccgtctctactgaaaatacaaaacattagctgggcgtggtggcaggtgcctgaagtcccagctactcaggaggctgaggcaggagaatggcgggaacccgggaggcagagcttgcagtgagctgagatcacgccactgcactccagcctaggcgacagagtgagactccgtctcaaaaaaaaaaaaaaggggaagagtcctttgtggggactcaggagacctgggtgggaacctgggagagacccctcttcctcttgggagcctgtctttccttcagtgtatcaaatagattaaactgcatcaatagttttcaaattttccctaagtgaaaatcactgggcaaaatcatttcaggcccttccactccaagcacctggtggttctaggcgtctcctctgcttcctccttgcagggcgggcgccgcagctgagggaaactctcctgcaggacttcagagtggttgcccagggtgtgggcatccctgaggactccatcttcaccatggctgaccgaggtacatagcacccctccgcctcaaattcctgtcccctcttcgtcccttgtgggcgccagagaccatcccagcccctgggtccttactataaccctctgagataaaaaggcgccacagcctcccctccatagtgaatcaggaagccagtggatttgctccaagtctcacagcttattcctagcagagcttagactagaacccattcagtgttcattctactgccatgtgtctcagggaggttgtagccagaatccacagatacctcttaggaggcaaaagagttttgggattaagaaagtgggctcaggaatcagagtgttacgggatctttggggcattgcttttctggctggaaacctctgtggccagtggtgcctttgcctgagttttgcttgggcctgctgggcttgttccacccacttggcctggtagaccgtgcttggctcatgctactggcctggatcccacacctccaagggagactgcaactcaggcatgaagcggcaagggatgtgtgagtgagggtggggtccagccactgcagtcaaacatactggctgctgccatggggtgggcagctccaggtgctggcatggtgccagcactctgtaagggtatggctggaccaggtgcaccacaagcagatttcccagctggcgccagggaatggagtggtgcttggaagctcggagatgccaagaactgcagggccccaaagagggagttacagtcctggctggtggagctcccaggtctgggctccccaaagggctgcagcttttctctccttctcttcacctgcaatgtggtgagcaaagggcatgtttcagccctgtttgtgttacagttagccttgccattttgtgggtcccaagttcttgtcctgtgaccagaaagaatgaggtacacagacaaatgtagggtgagcgagatgaaggggagctttactgagcaatagaacagcttggaggggacctgcagtgggcagctcctttctgcagccagggtgttctgatgagtgttcagctcctagcagagaggagaccctggaatgggaagctcctttctgcaggcaggtcatctgctgaggctgcagctctcagcagagaggaggccctagagtgtgtgtctcctctctgcaggcaagtcatcccattgtctccccttgtctctctgtcctctgttcgaatctggctgagtctggggtttttatgggtgctctgtacgcaagtttgtactgactggcccatgggcggccatgggtaggcccagggaaaagcaccccaacttccccatctggttcacaggactggtggcccaggccccaggcttcaggccctccccagcttgaaagtggggcttcactggggaccagcctccttccactcaggagcctgtcagcctcctgctgctattcatggcacccaggctgttcatgccaaggggcgcctgcaggccagtgtcaggctgccatcagcccccactcggcctcccttccacgcttgttggcacccaaagtctggagggggctgaggcagctgggagctggcacgtcagcactgccctgagcatgtgcatacctgtccaggctgcaacagcaccctggctcagccctgatcttgctccaaaataaagcaggcaccaacagcagagagaagccaggcagtgggagcaggcatcctagagtctgtggtgggcaggggaccttcctgggccctgagagtgcagaaatgcctgggtccacagccacagcagggcggctgctgctgcacctggggagctcctatcccaccaattcagaaggggcagggctcccacttgtgcccagctcccaccagctcaatggggtgtgcagccccagccacacccctttgcagcctgaggcaggggctgtgggcccttgctgggcccaggctggtgtctggggctggggtgacatcgtggcaagctccctccatggccccagcactcaggggtggcctgaggctccccttgcctggctc

SEQ ID NO: 15307 - DNA, 138282 bp, Human
aaatatcatcagccgcaaatcactcgtgacacatgccagaagtgaaaaacacaatgtagagaagtacttttcatactcacccttttccagagaactacccccatctacttagacaatgactggatagccccagtggactgggatgtagtctgaagaaaatttcttattttatatcacaatgtggccgtttaaaaaatataaagcatgcctctgtattttagaaaaaaatgaacgcataatacaaggcatgtcatatttatcatgtacctttgtgtatcccctgggattgttacttttttctccaccccactccagttttagaattatcaccaggtgaagtatatgctcattagtctagatgtggataaagtagccaataagctaaatgaaatcataaaccctataattctatcaacaaattaggattcgaggtttacaaaacaaccatcattcatgcataaaaatctctcaagatattggtatgtccacctatttcatcttcattggcagagcactaaatctccagggatttttggtctacccacaatattagcagttccagtgctgctaaaacaaactccctttggggtaatacatccaacattctcaggaaagttgtgttctttcccagagtccttcaatgctcataaactccagctcattattgtgttgagagtctgaagacattctctgtccattgcccctgcacctgttatcttgttggccttaaccaaacagcccaagtcctaacagcagctgaaataacagacgggcaggagaacttgagattttttgacatcatccttttgtttatgaaatcccccccaatgctggaatctgacaggaattctcttcattatcattttgtgttttttcccatggtactttgttgttattaaaaaattattactaaaaataattgatgcagaggtagatgaaagataggaataacatcttcatttgaaaattgtcaaaaaggacatagggagggggatgtggtcgtgtggaattgacataaacatatatttgccttggaggataattggcagtagctgtgttcatttggtggtgtgtttgtgaggaagcccaagcaggtactaggaggtctttaggtcagaggagagatgcagtctaggcaagttggaaatctggcaggaagcagtccttggaattgcgattcccaggacatgacccaactttgcaaggggtgaggttattaaaacagacctaaaatagggataagataggcagaatataggatatcacttaatagcatatgattgtaagcaagttgctttaccttcctatgcctcagattcaccatctgtaaaatcaacatgtaaatactagcagccatgtagggatgttttgtttctcaaataagaaattcatgaaaagtgtttagcctaaggccctatattctattaatggatgctgctattattattattattttgtcgagagtgaaagaaatagggagaagcaagtggcagggaggcagagagccactgtacacacagcatcagaaaagggtttgctcacgtgtaatggagtttctgctcaggtcttaaaatgaggaaacatgatcagataatgccctaagaatctgatgtggtgctttcccacctctgtgcttttgtttatatttatttttcctggatggcttcctcacaaacgtcttcatttttagtcatttgccatctgatacttttccaacagggttgctgtataggttaaattaaagaaaaaaacaacacctagtaagtacatagttatcagtcaattgatgctggttattactgtacattttagtgtagtccattatacttagctaactgatgtagccatagtggacaatagaaagtattggatagctaaatgtgcatttgatttcaaaaatgagcaagactgatagaacctactccaggggatcaattttccattctctctttgtctgcccagtattgtaattgtataattatgtcttctttgtattttccagggatctaaatcttggcagtgtgtaccagtattgggtcataactatttcaggaactgaagagagtgagccatcacctgctgtcacatacatccatggaagtgggtactgtggcgatggcattatacaaaagtaagtagatctaattaaagaaagaagaggagggatgctggttaggtcaagagatggttagggtgctgaacagaagagcttatgacatattcttcagtgcatgagctgtgagctactagtggtccccagcagtctctggattggtctccaaacaatttgctgaactcagaagaaaagcaatgactctttttgaacacgtacattttgcgactatgtaatacaatatatgatttagacagaactacccttatgtacctactaccatttgctcttgctctcagttgctttatgtgtgctacaaggattccattagatttttccctcacagtcacagcgtacattcagttaacaggacacagttcatctaggttaaaacacttttaagttctttgctggttaccattcacatttatgaaaactgcatatttatttgttatctctattgtatcatattatacaacaatttacaaaatgggtcaaaggcttataaaaacagtggagtattttaactcactacaatgtttaaaccataaataataaacagtgctctggagtgaatattgaatgtgaatatgagtacactgaggcaaatgaagcatcatttgtgggtccaatcagtaagtgtggattttatcagattatcaacccattcatcttcctgttctcaggacaagatgctatgcaactggcaaacaggggtgaggagccaccaagacttttgcattgtttaaaactcaataaataaacttttaagtgcttttcctccagaataagaaaaaaagttttctagtacaaaatagagaattttgtctctagaggtggaaaagagaccaataattattcaaaattaaatctcttattgctaaaattatgttcctcattgctaaaatgtttatttgcaagtcacactattgctaagagactttttaaactattgacagatttaatgataaacattacatgtggagaaggcaaaacaagctattggcaaaattccttcattaaatagcactgttgggtgtcacataatatctgtgcaatatggaattgcaattactatttctataaggggaggggtggtatgaaaaaagaatttgcttcacagttggatgaaaccactgatgtgtagaacatgaatcaactcgtaggagtagtacatatatgaaagagacacattagatgactctttctttctgttcatcactaacactaagctagaggggaagaacaatttaatttgtttctgatgattttgtggtatggaatgtaaactggaaacctctgctttaggatgaaaggaccagctaggaatacagcaaggatgatgcagtaatgcaagtgaaaagagctggcatataaatactcatccacatagacatcagttatttgccagcagtgttctttctgaacatgatttaacattaaaggcaatagaaatattgcaaacatgatcagatgattggtaaattatatcttttaaacttgctgtgtaacaagatagtagcatgtacaagattctgttcctctttgctccccactccacaactaaagtttgccaactgttaatgaaaagataccaactcaagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgggcgcctgtagtcccagctactcgggaggctgaggcagaagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatgtttatttcttaaatgtcctacacctaaaattttatatctgaattgtcaaaatgtttaagattgaagagattagtgtaagggtttataactgttgcattatggtgcaaatcagctgattgccaagaatttgactcctcaagcacagaatagaaagctcctcacttgtttgagctatttaacatacaatgctgtatgtatttaagatccacattcatatgaagcaacagaacaagaagatacagtttccaatgcagtaaaattggggaaagggaaacttctcactgttctctcccacattaatacatcaaattccagcttttgataaagttgctgtctgagggaacattgaacaactaaacagaggactctccatggagaaagtaccccatcatttgtgggtccaagattgaacttcatatctagactatccagaaaacatttgcagtcactggtgataactcataattgtgatttgggaatttctaatttagcccaattttttttttaagtcatcagatttggagcctcatctacagctcatctcagctcatggtggaaacagatatagatgaattggttaaacactgcaaatgatatcattcttgctgatctaaaactattagtatcataattattattaattttaaatagtatacttaatttaatacagtttttttttagtatttttacctagaattagtatctttcataaacatcaaacacatgttcagttacctgtagatatcaaatatttgttgatatactttgtagaaaactaaatttagcttatggatgtttccctaagtaggggtgggggggtaggggggaaggaaaactttggggaaaagaaagggatatcatcttagctaatacgatttttcatggaatgatgcaagttaatttgctctgtctgtaaaataatttatgaagaaatatggatagactcagcactcagtgaggcccttaatggatgagtgctgtcttaaatgatccatagcaacaggttctacatttgatagatcgggtaaaggtgaaggcaatggatgaacgttttgataatgacaataatatttatacacacttcttgagtctctactgtgcatgaagcactgtgctacattattgtctccttgagttctcccacccaacagccatgtgagataggtcttattataatactttacggataaacaatgaatacacaaagagattacagaggttttctcaagcttccacatctggtaagatgtagaaccaatacatgaacagagggcccagattctcatctggattccccattgcattgttgtgtgatgtgacaactctgcaaaactaacaagtaaaggagtggctgcatgctgtctgttatatcctaggcactgtgccagaaactggggtgctaggatgatgaagactctgtcacttcctttggcaaattacagcctcttataaggggctctcaagtaacaggcaaaggcagtcagtttgacaagtgctgtgatagatggagcaagatgtctgtggacacagagaaagatggccacccgctccagccccagaggtcaaataaggtttcgcagaacttctttatctaatgatagatctgtcatgcctagaagatatttgtagtgacccgaatattttgtttaaaccagtagaacactgtttgggtggcgatggaagggaggttgaaagtaagctttgtggcttagggaaccagcccaggtatttttttgtttttaaagtcttttccaaaacaacctatgcattagcttagaagcacaaggtcatcggcaatttccagcaagcaagacccactgccagacaatgctgagaccagctaaaaatacaaacttcttctttgctcataggtgtgcagacaggagaggacttgggtggctccttggagatcaattcaatgccctagccatcttaaggattgattgcaaggcattatcctgctactctgacacctcttaaaagcaacaaacattgcccagtgttaattgcctgggtgaaaggaaaagtctaaggcctcttccatgctgtgacaggtcccagctggtctctggggagggagggacagctgtcacacactctgcagagacctcccaacgcaaagtgggaatggggactgtgattccttgagcatcttctatgtgtcacccactgtgccaaccactttaagctactcagaggcataggactaattatctccattttagcacatgagaaaactgaagttcagcatccacaggagcactgttcaatggatttttctgcaatgatggaaatgtgttctatgctgtccattacagtagccactagctacatgtggttcctgaatacttgaaatgtggctactatgactgaggattggaattttaattataattcatttcaattaatttaaatgtaaatcatcacagaaatatcagatcaagaggtcaagtgactttgtcaagattatacagttagtttgagacatggggttctaaacccaagtgttttgttttttaaaggatgaccgttttccagaaagcagtaacccatccagactttcaggtgttgttcctccttctcatcacctaagcccaattcaaagatcattgctcattttctgcccatcccaaccctttgcaaaatcatccttaggtggtggaaataattccaacaaaaacaaagggggcattagtatttcataacagtgtagtctcgcagcccttggagttcttgacaccaacaaatgacacacccgatggagaaagcaaaactttccaatggaaggatgactaaacttgaatgcatgaatgaaaaaaaaaaagttacctttaagtatattgggggaataagaaggatatcaaggcagggagtggtgaaggaccagaatctctacattttccttcaaatatgctttttttaagatcagagacaaggaaatgtctgtgagacttcctagacactgtgggagcaagaccatttatttgttcattagttcttccatgtcttactcccatctgacttaactgacttgagatctcagagaatgagttggaatcaggacttctactttgtcatcagaaacacaaagcaaggcaaatgtgaaagtatcttataaatccataccttttagaaatctcattttgaagatgaagaagcagagactcagacagagaaagggatttgtgcaaggtctcactgaaggttcatggcccagggagggacttttccatgtccagccatggttttaagactaaattggcaaatttctcttccatatctgctctgcagagaccaaggtgaacaatgcgacgacatgaataagatcaatggtgatggctgctcccttttctgccgacaagaagtctccttcaattgtattggtacgtctttttcatttcttgtggccttcatgaagaaatgaacggtgcagaatggttggtcaatgataatgccaacaatagttatgactaaatgatgattcactcctttgtattacacctgtttattgagtgcctcctacatgccaggcactgttttcaatatcgggaaatacagcagtgaaaaaacaaacaaacaaagcaatccctcaagagcttaagctctcatagatgatgccaatgacgggtaacttcttttgatcaagctttaccttacaaacatccctgcttttcttcacactaactgtccaggatgggtattactggagatgttttaaggcttttattcctacttcagagataagaaaaaatcaaacgccagaaaaatttcaaaagttgtccagagttatacaggtcaaaagtgattaaagacagaatcaggacttgaacctgattttgtctgattctcaagcacgtgctcaactcattttgctttgcaacctccagccgtgatgcaggaaccaccaaggtcccctctgcagactcagaaccttgggcagtctctctgatctgaggaaggaggaatagcagaccagcctgtgtttagaaagcaaatgtccttttcccaccttcaccgagtcatttgggaaatttgttttcctctgccttctcttggagtctggctgatcttgttgtttcagccccacttgggaggccctggtcagccccgggctggtaaacagacaggggttgggaggggcaggggtggaattttgagctggcccagatgagatcatacttcctttaagatgcaaatcgatacctgaagatcaaaggtcccccagctaatcccctgggctggaggtgaaaactaatcacaattcatttgcaagtacaaaagacagaggtgctctatctgaagagagaaggggcagttacaagcggatgaaaaccttcgtgggaagatttctcactgacaggcaattttctaggactaaagaggaaaagatagcattgcatcctcgcatctgcagtgcattacaggggtgcatttagacattctttctcccagtagattgtgagctccgtgatggtgaagaccatataccatgtgtctcttattcaattctcaacacgcatttgttgagcacctactatcttcttggcacccagtaggggttgagcaacacaatagaagtgctctgtaaatatttatggttggaagataggtagatgccccaggagaaaagacatgggagtttctaggcagggccttgggttttaaattgccaaaaaattttctctcctctgttgatttgaatatggtccggtccctagtaaaagcttgatattagcctagtgatgtggtggaaagaactttggattaaaattaggaaaaccaggttctagtaccaactgtgctgagaacttacataaagctggccaagtggcttccctagtcttggcctcagtttacctactgtaaatttttaaatgattgggttaagtggtcctaactcttaacttaagagccttacctgcacttctgttgtgtgattttttgaggtgggtgactgaattccttctaattgtgaactctacctgagccaaactcttacctttgtcgtcatccttatggcaaccaacactagtcccagaccatgctgaaaaatatctgcctgtttgacttgcactaatgtggcatgtaatttatgtgcttctggaaagaaagtaggatggggtgaaggtaggatatggtaccctgaaagagatgcttgagccttgacattcatctgctgtgttgatttagagctatgcaatgatcaggaaaaataaggacatctctaataggtagaagctcctcatccatggaaggggtctgcaaactatggtccataggccatagccagcctgccccctgtaattgtaaataaagatttattggaacacagtcacactcatttgcatattgactgtggctgctttcatgctacaatgagagttcagtgatgacagcagagattctatgacccaaagaaactaaaatatttattatctggtattttacctgtgaagtttatcaacccttgttccatgaatttgggatattttatatgcttgtttactggagccaggtgcagagagtaggtgaaaattataatgtggttcaccatttcttgttaacaaaaaactgaattttaaacatacagtgtagctgggagtggtggcgggcacccataatcccagctactctggaggctgaagcaggagaatcacttgaacccaggagacggaggttgcagtgagccgagatcatgccattgcattccagcctgggtgacagagcgagaccctgtctcaaaataaaataaaaaagatgagggagtttccaagaggatgagactgagatcctcctagattcattttatagactgttgttctctaccagattctgtgttctgctgctgatggtgatatttgcttaatacttcttatataccaagcacatttataaactcttattctcgtaacaactcttttactgaactgctctttcaaaagaggaaattgaggtatggggtgatgatctaaggatacacagttaaatggtggagctggaatttaaacccagagagcctgactccagagctcactgtggtaagctacctgcaaaaaaaaaaaagatagctcctggtcttgcaggctttcagggtgaatgaaaaaaaaacattgcaaaacaagtcgtatcacaaattaatggaatggaatacaaaaccatcagtgttgtggacagtgtctagggaaggctctctgttacccctgtatgttcagtggaatttgtattacaggaaagccttcagctacgcccttcactggccacttaaaatctcattatagacactcacagagatacaggcatcccagagatcccagctcccagggactacattccaaggacaaatcgtgtagctgaagtctagaaaactatcttcctccgaaaggaacagctgaaaaatagacagtgaatctttactcccagcagaccaatctttaatgagtcagagaagagagacaagtgtgggaggctgtgctgaggttgacattgttcccatgattgcatttgttaagacagtggtcaagataacagtcaggagatcaggcataccatgacttagatgtgtaactttggctaagcctcagtgttctcatgtagaaaatggtaaaagccctagaacccaacagtggaagatattgaccaatatttttggatactttctatcagaatttccttcttagacttaggagataattattctaataaggaagagcccaacgcttagtatagaagttgattatccaagcatctccttctccccgtcttctgggtagcttgagtgtgggtatatacaacctaggctttccctctgccctccagtcagacacaccaacccaagactttgaattggaagctagtagtgattagacttagggatactgtagacaccattttgctgaggatggtgggagtagccacatccataccagcctcctaagtaccagggaaggcatctagcatcaaagctgagctagctatgcacagcaccagctctggatcccctcactaaactagttctgggacctaatcttgggcttggaattgagcttcagagcatgcaagcctggctctccagagagtgttccatacgtaaccaatattctttgaacaaattttgcttgtttgttttgcttaagttatccaaagttggtttttgttgactgtcactcagaatcttgactgaaaattattgccataagataatgtgagatttaaccccatttctagcaagttggatgtgcttgatgcacagatgcacattagctattacttttctctatgtgtgtttgtgtggaatgttgcgggcacaggataccagcaacaaccaccatttatggatacccactaggtgataggttcttcatacgcatctttgttttctgtgaactacgggtcgtctcttgtttccgtatgtgagatctgaggtctcttatgacatcttaacttgcaccaggtcacacagcacacagaggtatgatcctctctccagtctgagtagagaacctggctttttctactctgccactctgcctctccatttgaatgactttcttccttccactgttctttctttgttcttcttttctcttcaccccttcctcttccccctttttcctctcctcctcctcttcttccttcactccttcttctgcctcatattcttctcctttttctccttctcttcctccacctcttctaccttcttgtccttctcctgcttcaatgtagaagggctgatgttttctctggcttagtaacaccagcgttagggtgggtgacagatttatggtgacattcccattcacttttcagaagcccacacatccggaagtattcccaaggtgccagtgtgttattatgcaacaccctggggacttcccgttctcaatttcccacccctggtgccctcatcccccagcacataataagttgcttgttaaaatgaacaccacccacatgacctctcaggcaaggcaggcttcatccctttgcaatgtggaagttatcttgtctttttttcccctcttttaaaaatataacatacaccaggcctgaggtttcagtgaaaaaatgtggtatcagtaaaatgataactctccccaacaggcactggctgcaggcattgttcacagcattgggaattctgtctctaaagcattgagtcataaactacagacaggctgctgataaaagctgaaggaggtgggataatagtcaaattagtcagacaaaatgtgaagggtccccaaaaggggttatactgtgtaatatatctttagctggtgctggaaatgtgttaccttctgagatggaatctagtgcattacaggagatgcagctgtggagaagccctcatgctctgttttgactttccaccctgtattcttcagcatagttgggtccagttcccagtttagatctagaggcctcctggctgcagcttagcacctcagagcctcagtttcttcctttgtgaaattagggagactggactgaggactctaaagcttcttccctcatctgatactgaggaatctccgatttgtcaaacagctatttaaaggctttaggtttcaaatcctgcctgacgctgatatatagttaagaaaacaaaggaaagggacccccacgtcgtctttcccagacgtggaggcattccctgtgtgtctctttttctccctccctccccactcctcttctctcccctactcctgccattagcatcactctgtgatccctgacacagcatccccagccctgtcctagagccagggccagtaactcaattagcaacccccagccccagctccctcccctcccctgtgagggacatcgaggagaggagaagaatcggtctgcctccccaccagttgctgggaggggcaggggttcaccgagccttgtggcccctctgtcaggctgctctggcctgctctgagccaaggcgagaaaggaaaacaagaagatgaatcgccacgtcttcttggtggaggttccgatgagactttagaacaacagtgactggaaagaaaaacagcatctgctggaggagagggggaagaatgggctctgctgggagttgcatttattattatttttctttctaacaacgtgaaatcataatagatgatccacctctcaccttaaaaaaattaaaattaagaaaacaaaataaaacttctccagactgcatgtattcaatcagacctccctccgtggaaaaagtagtaactttccccagaacacgtttttgaaataaagcttcccttggcttgaaggcaggcctatgaaagaggaaaaagaaagaggaatataggtgggggtcatggtggtagtgattaaggtgacgacgagggtgataatatctcagctaggttggtggcattcttaacactggagtaatgacatagggtatccattgttaagaacacggattctgggtggaaagcctgtccctgacacttagcttgtgtcgcagttttttcaatcataaaatgggttagtaagttcctacttcttagaattattgcaaggaaaaacaagtttatttttgtaaagcatttaaaatggtgacacctgcctgacaagtgttatagatgtgtttgctactgatgctattattgtcataattaatattttattttttattttaattttttattttttgagacagaatctcactctgtcacccagctggggtgcagcagcatgatctggactcactgcaacctccgcctcccaggttcaagtgattctcctacgtcagcctcctgagtagctgggattacaggcgcgtgccaccacacccagctactttttgtagagacagagtttcaccatgtcggacaggctagtctcaaactcctgacctcaggtgatctgcctgccttggcctcccaaagtgctgggattacaggcgtgagccaccgtgcctgactgaatatgattaattcagaagttatatccatcttcccagaaaccctatgagataaataatgttatccccgttttgtagaggaaaaaactgtggttcagagagatttagtaacttgcctacagttacacagagacatagcagacgtgagattcacagcatctaggcagagtctacacattttaaccatgaagttattccatttattagatacccagctgtgccagtttttctgctaagaactctttgtaaaaatgatttcattcaccctcccagcaactctgtagagtcaaaataattgcaccattttgctggtcagaaaattgaggcgttgagaggttaagtgaatatccaaagtcatatagccaggtaggtcagagaaggagacttcagagtttgtctgtctgccctaaagcctatgtccaactccagactaactcttgaaatagccagagagtgtttctcttttccactatttctgtttggtgccattgaatcacagcaggaaacaaaagtgaatgcacatgtccttgtgccattttcatgagtcatgaaacaacaattttcagttattatcaccctagaaatgttccatggcataaagctcatacccccaatggagggtcattctgtattttaggctgtattttcatttttaacagatcaccctccattgacagtagccaaatcgttttttttttagcatagaatgtgtttggcacttaataaagttgtcatagcaatgttggagacagaggagcttgagttcaaatgtctattggttgcaattactacatgggtctttttaggcatctctcaatacctctgagtctcggtttcctcttctgaaaaatggacgtaattataacacctatagttttgttaaggaaaagaatgacataacatctatagagtgtttagcacaatgcacagcagttagtggacaatcaaggatgtcagttaacgccacctcttcttccccttcctcattgcctatctcaattgtgactgatgcaaaggcagccaacccatcatcagcaaaaatggtcctgaaccaaatcctgatgctaaattacagtggtgccatttgcaaaatgatcaaacctcctagttctcagtttccccactgtaaaataatgagggaatttgatgagctcccagggagctttcagctccgatttttaggatttaaatcccaggttgttattgttttaaaactggtacattttaaaagaaatcagggcttggggaagagaaaggaattcctttcacccaaagggtcaaagggggtcactgaggggacaaaagagcaggaaaaggaggcgatggggcggaaggctgacgtgcgggcagcaccaaagatctgaagtactcaacagggaggtctgatggatgcattcaaacacccttgagtcagcaccggttaggatcaagcttgccatcctgcctcagaccaaggcttaccacctcctttggaaacccgggaggcctaccccacagagaggcagggctggaatgaaaagaaacagaacggcctctgacgccagaagggaggaattctagcccgcagcccaggtctgcttcctgactctcaggaaggggtcaggctcagggaaccgacttggtgcttgcttgaatgtgaggaatcgagaccaaactttgatgtgtgcctttgaaaggcagccagagtccaaggcaggtgaatctgggtagccaagaacaaggacttcattgtgatatttaaagtgaccagaaattcatctgcacatacatgtgccttgatgtacatctgtgcagttatgactgaggcggactgggagagggtagaggcctctaggctgggtatcagggccttttcttagctcctggctctcagttgtttcttggagtccatgttgggttggaaaagacatttaatattcatgagctgtgatctctacttgaagggagtgccctgagggaaattgaaatattaagcaagtgagggatatagacctaattgtagcctccttttctttttggacagaaaagtaatgtgcctaaaataaaatgatggatgggcagtaaggattgtgtgaaaacctcactgctagagcctgcaggaaaaaatcggctgcttgccccaacatgtgcagtcggacccaggcagaagattctgcaaattggctgctggatgatgtcattcattcatttagttcatattttttgatgcctgctgtatgccaggcactgtgcttgtttcaaagaaaacagcagtgaaaaaggaaggccagggaggttaggaaaatgatacaaataattatttaagtgtcattgtggaaaatggcactaaatggaaatacttggaagtatataaccaaagggcctcctttacattgagggggtcaaggagatctccttgaagatttgacatttaagctgagacttgagggttgagtaggatgtggactcattagggagatatggaacaggtaactgagcaaggattgcaagaagttaagactattcaattcccaaggcagagaagaacttttgaagagggaaaaggaagtcagcattgctggactgtagtgaacaaaggagggatgaggctgaagtctagcagtctctgatttctcaggcccttgaggactatggtgaagctgctatttacggcatgaaggaaggagaagttgactcaagcatataccttctacactctctaccaagccctgccctgggcataatagccatgtgcatgcttgcacagaccaggtgtcagtaaaccaccacccatggccaacccagcctgctgcctgttttcatagacaaagttttactgaaacacaactatgctcctttgtttacatatttgccactacaaaggtggagttgagtcattccaacagaaatcttgtatggaccacaaagccaaaatatttaccatctggtcctttactgaaaagttgttgactgctggcagaggtggatgagtacacagttggcctgtcatatcctcagatcctacatcctcagattcaaccaatctcagatacaaaatatttgaaactaactggctaaataaataacactacgacaatttaaaaacagcacaaatagaaaaaacaataaagtatttccaatgtattaagttttatgagtaatctagagctgatttaaagtacatggtagggtgtgcataggtcatatgcaaatactaagggactttatataagggtcttgaatatcttcagatttttgtatccaagggggtccagagaccaatgcttcgaagatacctagagatgactgtgtaagcgggtaaaagtatagccagttgggcagaataagccagatgagagagacagcgcgaggagttagacaatcatttcatccatctccctcctgagcctataccagcatagctataatttcactgactcctcatgtattttacttccacatctgtgtcccttacccttaagggaagaagccttgccatctaccctcgtgtcccaacatccagctcgagccaatcattgagacactgaagcaaatgacactctgaggctaaaaagggtggccagaggaacccaaacagatgaccttccaaacggtttaggcagcatccaggatcctcccctgaccagtagaagggactgtattgatatttatggagaacctgctgcagtagctcatttcaaacccacagcacccctggctaccaggtattgttaacaccacattccaggtgacacaacagagcccccaaatgtttaagtgacttttgagaatgtggcctccattcaataaatatttactgagctgggaaaccacccaccagacaagcaaatcttcctgagtgctgcatcttatgccaggccaactgcctcacaccccacttaaccatcctcttgattttcccaaggctacgggaaggtaggggccattatcccccactttacacgaggagaagttcaggctcaagaagatgaaatggcttattcaaagcgggtgcttattaagtgacagagttgagatttgaaccaagatctgcccaacttcaaaactaaagtcaccagatgacctcctccaaaatatgaaacctttagaacaagaaggagccagtgagaaatatacagtcatccctcagtatccttgggcgatttctgccaggacctctgtgaacaccaaaatctgtggctgctcaattccctgatataaaatggagtagtatttgcatgtaacctatgcacaccttcctatatacttcaaatcatctctagattacttctaatacctaatacaatgtaaatgctacataaatagttgttatactgtaatgtttagggaataagaacaagaaaaaatgtctatacatgtttagtacagatagaattttattttgcatctcttgaattcacagatggagaacccatgaatatggagggccaactgcatagactgcatatatttccaccctttttccatctcaccatctcagacaaaagtcataatagtatacataactcaaattattaatttaattaaattaattggataaaattcactcaagctttttctctattaattccactggttaatcacattaatgctatgaggtagttttaacattatacaggcattataagtaaggaaatggaggcacagagatgttacgttcccagtaagggattctagccctggaagtctctggctcttaagccctcaggcttaactactaatttatgctacatctccatcattaaggttatctaataaagtgtgtactctcaagagctgaacagcctagcagcaaacagataatgagaaggggaaacaatgcaggaagctaaagaaatcttcacataacaaaaggatcccagggtctttttaagaaacactgtctgaagtgtttgtttacagatcattaaatacttaacagaggaagaaactaaaaaccactgactttctctaagccaatactgattaagtaccaaagagatgttaacataaagcaaataagaaattataataattattaaaggactgagtttttttcattttatcttactggacagaaagataaaatagcccaggtccagtgcctgtcactctgccctcatgcacacggttgcttttctctctcctccaggcagcagccatggtggtcctgcaatcagcctaaaatgcatgtgaccaggctcacactgattattgtctatattaagcacctgctgcatacaaagttctgtgcaatgcagggttaagcagcagaaacctttgttagagggctgcagaagacagtggtcattaaagatatgaagggattggcattagaggccccctgggagcagtggaaagcctctggtgcaggggttggtgagcctgggaaagatttctggacagtgggactcagataagaccaggtttgacactctgccactataaagatccagacagagggtttttctctatacagtgagtgcaccagtcctaaaggaaactactccagggaagtcacagggggtgagtgggcagttctcatcccatagcaagcagtagtttctgggcagaggcataacatgataggagcagtattttaaaaaagatcaacctccctgaatgggatgctcttcaagggccaacaaaatactcttggcaaactgacccaaagagaaatcagggtgattttagctttcaacagcagtcagaaacccagcccaaattatccgtaagtttaaatttaactatcagccgccattggcaggactctgaaaggtcctggctggagttggttcctcagtttaggagtccaaaaccacatgtatagcttgagttcagcctcattaccaaggaagggtctccacaagagtctgaaatcccttttccatttgtcccgtgtgcattttgccaagagaacttctaaagggacagggagggaggaaaagctgattgaccagccccgaagcacaaggaccacttgtctgcctcagggttcatcccccaaatacctttttccacctgagaagtaggagtgatattcctgacttcatatgattgttatgatatattgttttattaatttataaacttattcattcatcacataggcttttatttattgagcacctcttatgtgccaggttcatgctagacaccaaggatgcctgtgtttgtgacagttcctgtcttccagaaagtgatcaacaaatattgattattatggctaacaaaaataataatctagttcttactcacaagtagagagtgacctgtccccggaagagattgagcagaaatttgagaatcattctttagggaagtcatgcatgagattctattaaatagcatgttcaaacagacatatttcaatatttttctcttttgtcttatctggctctttcttgaaattcagaactcctggtacctgtgaagtgttagcctcttctgtttttcttaacttttctgaccatccctccacagaccttctttcacctactctttaagtatcagcagtctccaatgttccataataggcacacttctcattctccattctctccttgtatgactccaaaatctctatctttagtctgggccttttttttttttttttttttttgacccatgaacttgtatatctaattgctctactttgacgccccaagggaactcacattcgacacatcttacacaaagcttgccatctttctttccagacctgctgcaagtgtttttcctaatctcaactggtggcgccagtagccaaccagacatttaaacagaagcttgggaaacatccataactcttccctctctgccatttcccacatccaaataattgccattcttcccattttactttgaaaacgttatcttgtctgcgtccaaatcagtctctctcgccccatgatcattactctacctgaggccctcttcagctcctgattaggcttttataagagaaagcttgtaaaatgaacatgttgcttgttcatttttttgcttgccccaatctacctgcccataggtgagagcaagtttcctaaagtgcagacaccttttgttgctctccaattgagagtgtcagatggctccatgttgcccttgagataaatttaaattccttactgtgtcatttaagaccttgcgtgatctgagcccaggatttgcttttcttttctttttcttttttctttctttttctttttcttttctttctttctttttttttttttttttttgacagattctcactttgttgccaggccagagtgcagtggcactgtctgggctcactgcaacctccacctcctgggttcaagtgattctcctgcctcagcctcccaagtagctgggactacaggcacataccaccacacccagctaatttttgtatttttgtagacatggggtctcaccatgttggctaggatggtctcgatctcttgaccttgtgtcctgcccacctcggccaggatttgcattttatactccaataccatcttgtgctttatacctcctactatattgctggcctcatctcatttgctcacagtgtccccctgctggaatgtgctcctcaccacccgttcctcctctgagagatacagcccaggtgttgcctcctaagggaaaccttcttaaatctgggttagattggattgggggtccctcctctgtgctcccacagtatcttgtacctcatgagggtcagaatcctgtgccgtcatcatttacatatctcccctctcactaggacctgagttcttggagcactgagacctgctttaattcatctgatttcccaagagttagtccagggactgacaaataatttgcagttcagtaaatatagaataaatgagtaaaagaaggatgtatttcttaagagacagttttatttttcaggcaagaaagtgtagttgagctttgctggtctttagagtcagacaatcctgtttgaataggagactttcccccttagctgtcatctcgggcaggttatcttgggtcaggtggcttggggtggtggtttcatgctcagacccctgaactgggctgcttgtatccaaatcctagttcccccacaaaaggggtgggggcttctttaaaatgttaatgttactatatcgatacaccaagaggtagaaagtatgctatcttagccagcagtacttttttgaggcttcttttactaagtagagacgggctcaaatgctgcctttccttctctatctctatactgacagaggtcattactctttggtaaggtccaaaggctttagaattttagaagaatgggtgggtggaaccagtgattttggtggtatttggatcaccccataagactctcggatggccccaaattgagctgctttttaataccaaatctcagtctgcggcttgcttccatttggggagagagcctaattaactcgtagctggaaagaactgcaggtctgccaccccccaggcagagaattcaaaaggaagtggatagctgtgtaaataacactgctttaaggggcatttaagccaatgctctttgttaaggaaattgatggctttgtaagtactgcgtctgaagggagtacttgagctgaaggtccccatctcgcctcgtaaatttcctaatggactgtgggcctgcaggctgggcccagcgtgttcaatcacttgccaacaaaaactcggatttcactctaaaaaaattaaaaacgtttaaccaaaacataagttattgagcctgtgcagtttaactgtggcacaaggtagcagagacagattacttcctttaaggaaagggaaactcctcatcttttactttaaaaaatttgttttttaaatgctggatgtggtgctacgtgctttctcaacagcttctcatttttttgtcctcataacagttgggaaggtagtcattattttgccaatttgccaaagaggaaacggactcagggctaaagtgtgctggtcattgacaccagctaattagtgaagagccaggttgtgatcacagctccatcaggcccctgagcccccaagtagtgccaaatcatagggcatccgagagagaatcagatcagcccatctcatcagattctcctgaatatccacatccattcaaaatagattaactggacagcatgggaatgacttaccctcttgaaacctcaatttcattgtctgtaaaatggggataataataggaccaaacacggggctcttctagatttgaatgccttatgtacttgaaacatttagcacaatgcccagcatggagaaagtcatccagttattcatttcacaaatacgctaagtacaattttaactggggaagcggatgatggtataggaagacctagtgagggtccattagcccttctgggggtgggtttccaggcaggtttttgagaggttaaactgtgaataaaggacaaatggggactagtcacagaaaaggcagctctggggatttgaagaaagcttctgcaaacgtggggaggtgagagggaacatggtccactcagggcaacgacaatttgtgtctggagcttagactagagtgcgttcgagaagagagaagcctgcagaggcaggcaaggaccagagtacaccttgtcaatcatcatcaagctcctgttgggaaaagttgaatgaataactcagtatcttctagggcaaccactttcaattttagaccaactgtactttgttagaagagttttccattgtgtcctccctgagccttcttttcttcaggttaagcatcttcatacctacatgattattgctcagtggttggtgcctatccagggtcctattctttgaccatatcctaccacatcagtggcccagaattggcctcttcagccatgactggtccagctaggactggagacaacttctctggcctctagcttggaatctatagccaatgactcaatctgcagtctcatgcttttgtttgggcaaacacatccttcatttggcggaatctgacttcagagtgactgcttcttggaacttttcgtgaacatgaatagttatgatgactcttatcatccctgatcaaaaagggcagtggttttgattgatattttcaaatgttcccagttaactcttaagatttaggaccaggccaggcgcgatggcttacacctataatcccagcactctgggaggctgaaatgggcggatcacgaggtcaggagtttaagacaagcctgacaaacatggtgaaaccctgcctctactaaaaatacaaaaattagccgagtgtagtggtccgtgcctgtaatcccagctacttgggaggctgaggcaagagaatcgcttgaacccgagaggcagaggttgcagtgagccaagattgcgccaccgcactcaagcccaggtgacagagcgcactcaagcccaggtgtcaaaaaaagaaaaagagaaaagatttaggaccaatttatttctgtaaacataatacaaaacatccctccctcccttccttccttccttgctccctccctccctccctgcctccctttcttccttctctcactgctttccctcttcttactgagagatgagaaagacatatacacaccttgttaaagaagaaaattacagctaagcaatacaaatcagaacatatagatttaagttaatataagtttttattctaagggctgaagagtaacccattcattacataagaaaaagaaaacttacccaagagcattcttgtgcactgtctctcttctgttctgtagaggactgcagtgtgtctcaccagcttggagatagaagacactgtggcttgaatggctcatctttttagacttatcgaaaccatatagcaggaggatggtctttgaggtgaaccaaaccagtcagagttcagggtgggagggatccattttaacactctggtttctgcatgggagccctgccaagaacatagcatgctgcggtcaccttagtcacaaccagctatgccagattggggtaactggcttggttttcatgtggtgcctgactcatcctcgagtccttggcccactggtagacatagcatccacttgtccaagcttctttctttgctggactcttatgcatgccctatcagaatgacgggctgcttgttttactggattgcagaatagatatgcatatacatatatatatatatatatatatatatatatatatatatagcatatatatatagcatatatgtagcatatatatagcatatatatatagcatatatgtagcatatatatatagcatatatatatagcatatatgtagcatatatatatagcatatatatagcatataaatagcatatatatagcatatatatggcatatatatggcatatatatagcatatatatggcatatatatggcatatatatggcatatatatagcatatgtatatatagctatatatatatagcatatatatagcatatatatatatagactttcatttgcatgcattgttttacttaatgcttacaaacatgcatttctcacagagcaatttttatttgacattgaatattcccaatatttgtataataagccttaatcagccagtcagaacccttgacctctaacaattatgcagcattcagtgagttacttaatctttctaagtttcagttgccactttatacagagaagcacaggaattagaatcatatagaatgtctagagaaccttgcagtgttaaaacgttcattcgttcagcaaatatttctgattatcttctatgtactagtatctgactgcaacaatgcacacaacagcctatgtttctgctctcaaggagttgccattctgttttagagagaatacaattatcaagcaaacatttgaagaagtgagatcatgctatgaagggaataaaatagactagtggtatagacactctagtgaaggtgaaaactattttttgatagtgtgtttagaaaagtcctcactgagaaggtaatggttgagctaagacctaaacaaaaaattagaaaagccatttgataattggggagatgaggtctggattgtatctgcaaaagtaaaatgtgaaaacaacacagcttatagtttttatgtttgagtagtttttagttttcacagcattattttactttatctttacacccacttttgaaaatgggtaggaaaataatgctgtcattttttttaataagcaaaaagaatcagatgcagaatgatgatgtatgttactggtaccatgaaagtaagttagcaacagagttgaggcacacactttaccttctggccccttattccatctgcttttcgttatagttctatgcatgtttttcagaatgggttcatcatctacacgcttctcgatcttcattttgctgatcatgtttctccatcttttttttttttcatgtttcccctcttaactgaataactgatttagtgatcaaagggcaaaatgtcaagaaccaaatatatcttagagtgacacagctaaaagggatcacaaagctacttgatttaactcttattctatacaaggggaaactgcagcccagagagggaaagtgacttgtccaaagtcatagggttgatcagggcatctattctaatctccagttcccttgactccctgaccattactgtagcaggctgcagagtttgagaaagtgtctcatattttctctcttttctttctctctctctctttctttcttccttcctttctctctctcttttttttaatatggagatacaatcacactaaaactgctgaaactccctttgtagtttgccatcttttattaccctctttctttgccactttttgcacactctctgcatatccatgttttggatttttttttccgtttattagcttatattatccaggccaaatttcatttcattatttcctgcccatacttttatagacctttgggtcctaggtattgctcttccttctgtttgtggttagaatgccagcctatctcttggctgctatataattcatgtgacactggattttaccgcctctttcatatcttgagatatcattgaaacccaaaagagaactggctgaaagtcatttagggctttgaacattctgctctgttggctgcattgtcatttataaggattactatctttgcttacaatctttttaagccattcaaattactatactaaatttaaggtgatgtaaatgcatcttcaagttccaattcataagactgtcaaatctctttattaaattttactctaatatgtgctacctttcctatccagatattccatttcttttcaaattcagttaggatagaaaataaaacaatatataagacagatggtgaggcatgatgtctcataggaaaaaaaatatattgtgggacaatttgtgtagaattggattttccccctaatatgtgcttggatttatgctctgacctctttataattaatattttcataaaaatttttacataatactatctgctaaagcagattgaaatcaggtttgggacatcttcagaatcattgataacagagattctaaaactccaaaataactttgttaattcatcatttactgagtatctgctatgagattgacactatcctaagtattcgggatattaattaaagtaagacaagggccagaaatatctgaaaattcaagagctgtacaaaatcattcatttattcacttattcatgtatttttaaacatgacataatatagccaggtagttttcttgaccctaatggaaaagatgcactttgaaacatgcttctattaaacttgtgttggttgtatgggagcagggaacaataataaataaatattttattttttattttatttattttaaataaaataaatatttaaaatagtgaatactacagtaaaggaaataaaacaatatggtatgctactttgcagtggggatggaggattagaatgtgaattaactgcttgttacttgaatatttgaaatgactgctaaataatgaagaggtcatgagaaaagccaagaaagagatattccagaaaatgtgaacatcaagttcaggttcttggatgcttacttaaggaatagatacttgttgtgtcgatagatgtctgtctggatgaatgaatgaatgcatgaatgaatggaaggtagtgagcaaggaggacagtaacagaagatggagggataaagcaggggcttgtaggcctggatacagactttgaactcttccacatgagatgttaagccattgaggagttttagatgaggggcatggcatggcgtagtttacgtttttagaagagcactatagctgttctgaaggagggatagttgggaaacaaatggttgagaaaagagaagcagataggctggttaagtgagaattgcagcagtgatgttggcttgaactagggtggtaatgatagaacaaattagatctattttaaatatcccagggaaaaggagcctataaggtatactgatggactttgtgtggtgttaaagggtgagctgaaaaaaagtaggacagatgactgggaaggttttggtttggtcattgttaagtgatggtgttgtcatttactaaggtggagaaaaagggaatgtggggagaaatcagtatttttgttttagatatgttttttgatgtcttttgatgattttgtgatgcctttaaataggcagatatttagtagagatataattttaggcagttgggactcagagaagaggtcatatctaaggctataaatgtttcagtgattggcacatagaggttttaaaatttttatttagaaactgagacaggatgagaaactgtagataaaaaagaaaaaggggtccccatctaaccctgaagtctggcagcattccatgtagagttagggaaggagaagccctcaaatgagtctgtgggggaggatcccagacaactaggatgacatgatgtcatggaagtcaagagagggaggactgcaagaagacaggagggggctacttctttatatgcttcaaggcagtctagcaagatggggattttgacatcatgctcagctttagcaactttgaggttgatgacgacgttaatgagattgattttggtggagtggtgagtatagaagctagactggagagaaccgataggtgaagtgcaggagacaaagtgaataacactagtttagataacgcaataaattttactgtgaatcatagaaagagagatgtgggataggagaaatagtatttaggagacgtataacagaatgaaaggaggtttgcgtttttattaatttaaaaactttgaatttttcaagaatttttacatttttaaatctttagatgggctatattctattttgctgatttgggagactaatgatgtaggaaatagagggaaatggtttgtaccaaacaagtagtgatgcagaaaagtgagagatgtcatggagctgaagttgctagaactgaatcttaatggaagactcataggcaggaccagcctttcaggctaaggaagtaagggcagatgctctgagatgtgagttctgggaaagaactggatgcatttgacggtggagatgtggttggaactaagaataaataggaaagttggagctagattacaaaaagacttgaaagctagttggggaagttaaaattttgtaggagtctatgaagtatttcaaacaggctgggcacggtggctcatgcctgtaatcccagcattttgggaggtcaaggcaggcggatcacctgaggtcgggagttcgagaccagcctgaccaatgtggagaaaccccgtctctattcaaaatacaaaaaattcgccggcttggtggcgcattcctgtaatcccagctactcaggaggctgaggcaggagaatcacttgaacccacggaggttgcagtgagccaagattgcaccattgcacttcagcctgggcaacaagagcaaaactctgtctcaaaataaataaataaataaataaagtatttcaaacatgaaaatattcatattttagataaatcattcatagattcataagctgctttgtgagaagggattgaggtgaggaagatgcaaagccagttttgagtgtgtaagggctaagtagatagaatatgaggctgtgctacaggtgccttccttgatgggcctgagtgtagagttagtgtgataatgtgattacttccagggatgctcttcttttccagtgccttcagtttgttggaggatgcttgattctcacagtgaaacacagggaggaatttctggcccatgtgggtatgtggccaacctttgaaggaactggaaaccaacttaagctcctcagattcaggtctccttcagtagacctaatcagcatctgaagcttgttagcagattcatggttccttaggagccctcactaccctgtcttttgtactctgggcaggctgatctggttgaggaggttaagaagaaaccctggtttgaatagaattaaatgaggtcagcaatgtgggtttgacacgaagcctttgaaagataggctatataaagtcaagatatttctgtcccagaggaaacatatgccaatatatagccacctcccagccccacccaagcttcccctttgtaaaccttcagcaggtaagcactcctgctccccctgttccaagaaactaacgtttaagtacaaagatcacgctttgttgtgtgtgggggtgtttctttttgttgctgtttggaagaattgtgatgtggcataaagactgttgttattgaacccatctctaaataaacagctaaacttaaaatatgctactttttttctggcctttaaagatctttttgaaaagtaatcgttggactaaaagagaatatcataatgccaatcactgttttattagctagaaatagaaatagatgctaatttctcaaaagctgtcctatctttatttgcaagaaatttagaaagacaggtgaatccactcatcgtttggaaggaggttcatttcagaagagtgcacattcaaaatctttgctttctccttgagctctaaattagtgactaagaactctcatctcctcatctacaggtagttttgtgtatgtttggttttctttttggctcatcaatgggctggaagattagtaacctcaatagcttcccagactagttatatttagccaataccagtgaatgttacaaaaagtgaaatcagagatttccaaaagtaatattgagacttacttaagggtaatcaactattttgctcccagaattatatattgaaaagtgggccgggcatggtggctcacacctgtaatcccagcactttgggaggctgaacggggggtggatcacctgaggttaagagttcgagaccagcctgaccaacatggtgaaaccccgtttctactaaaaatacaaaaattagccggatgtggtggcgggtgcctgtaatcccagctactcaggaggctgaggcaggagaattgctagaacccaagaggaagaggttgcagtgagccaagatcgcaccattgcattccagcctgggcaacagagcgagactcggtctcaaaaaaaaaaaaaaaaaagaaaagaaaagaaaaatttcaaagtctcctcatttctgaaggataatttcgatttatttaacatagtattgcaatcttttttaaatctagcttcagatcagtttcttactgtattagttccaggatttactgcattcccttactcaagtattggtcaaagtttatcctttactcagacacctctctttacatgctcaaactatttataccctctaagatgtttctcccaaatcattttgtcaaggaagccttctctcattttcccaagaagtattgataggaggagggcctgtcctgattcattaacgtatttccagcaccagcacaacaagaagcagatgttagtatattgattaaatgaatgtatagacttctccagttctcatctactgattagaagatattttagctggggattgcaatagccctcactcctaaaatctccagaaagctttggtagctcttatctgttgctcattcattgctgaaataatcaaaaatgaattactgggttcttagtgttagctgggcatctcagaaatgtttgagaagcaatcccttggggtttaattttgaaaactgcaatcccaaggtttgaggaaattttatagtgaagctgataaatcttttagaaaaagtgtgacataccctataagaaggtgcctctgttttgatgaaatctggtttgtagtactatcatggtatggtcagtaatagcattacaaataagtacacaagcacctagttagtttagtctatgtataatctggtaataaatgaactcaaagataaatccgttgttacctttcatttgttgtttatctagtcatatattcctcaatcactggtttggtgtcccctttactctgagcactgttatgggttggaaatactaccgtgaaggactccacaattctgttcgcagagatcttgtctgcctgataaggaaacagacccacagacagacagtgaggaaactgtgatggaagaaatctaggaactgtgataacacaggaatgacactcagctagggtggggtcaggaaaaagggatgaggaatagagaagacttgcaaaggagatgctctagatgaaccttgaagaaccagtgggagttagcaaagtgaaaaatggaaagcacatttcaggcagagaaaaacaacctttgtaagggtgtggagaaatgaaacggaattgttcgtgtggaatgtgcatgaagaggacagtttgtggatggtcttgtatgccaagctaaggaaaatgatgttttttaaaattatttttatgtgtttattttttttttgagacagagtcttgctctgtcacccaggctggagtgcagtggcgtgatctcagctcactgcaacctccacctcccatgttcaactgattctcctgcctcagcctcctgtgtagctgggattacaggcatacaccaccatgcctggctaatttttgtattttttgtagacacagggtttcaccatgttagccaggctggtcttgaactcctgacctcggatgatctgcctgcctcaacctcccaaagtgctgggattacaggcatgagccaccatgtctggcagaaaatgaccttctataagtagtggggatctatcaaaggaggggcatggtaagatttgtatgtcaggtagaagacttatagccaaaataccttaaattatcccactatcctagagaatacacattatctcaggccatgtttgaagaacacattgacttcagttagcttttacagtaaccgataacttatgactatctgttcaacgttttgaaactgatgagagtcaatgtgaaggcaagtttccttgtgaaaattatccctaatatcttgtactgagaagacacgaataatttaatttcttcctcccttctccagctctgacctctttaacctctttaggtatttctgtcacttattcacctgagtgattctagtgacatcataaattcccaaagtttctaattcagctaagttaattattgtccaccaattgtgttgaaatcattccaatgtaagtcaatatattcttttctttaggttgttacttttttcttttgtttgtttacttgcttccttggcatttatattgaaaatagctcatgcatcctctttaatcatgtctatccttcaagataccttagggtctagggctgggtagagaaaagtagaatctctaattaagaagacttcttctccaactccaacctcattatcatcattgttaagaatagaccctgtgtctttaagaccagtattattttcccatctcagtctgttatgctatttgatcatcctcagaaccttgttgagaaagtctaaaatgtaattttgttttcattttatatatggggaaactgaggcatagggaggtgaaataccatgtccaagattaaccaataatcagagatagatcaagagcttgaatccaggatttctgacttcaaggataagaactcttaacaatagctctaacctgagcctttgcttcaaggtaaactaatatcattttcctaagatttggttttccaagctttcaaatgggaataacgatctctgtgcatcttaagtagtgtcctgcagacatgcctcaggaactcagggacatggcatttcaccttgatgctccagataaatgaaaataagtcagctggtggcagtatcaactatgtctgtccacttacaccaagtccatctgcctcgggctcttgaagctgaactcatttcttccaaaaggaaaagaaagtttctggcatatgaaatctcaactggagaagacagactttgctaatggcacctacccacgtcaagtctcctagctggatagaacagatttctaaatgtgtcaccacatgaaagggaatgaatctgaagtgaggaattccctgatatgaggggaagatggcgtgggatggagaaatcagaatgcccagtgcaatcccactatcagctagtcaccacctggcttacagctccatttccttctccctaagacatagtctaaagaaaatagtcaaagggtacagagtttaaactgtatttggttgagagtatatacatcggggatgccagattttggtcattcgttcattcaacaaatatttattgaaagtgtattatgttttcaggatgtgtatgtgtataaaagtgtgtatgtgtgcacatgaatgtgtatgtctgtgtataattttcttagtatccctcacagtgaaatttactgtattattatcaatgctacctagctactacacggaagttatttgaccttggtattgacttcagactcttttcactacaacctgctcagcatctagcagaaagtatttaaggagcaccaagtaaattgatgtaatgaaaacaagaccagtttgttttagtgttttgttgttgctgtctttgttttttgcggccgcacatttgtattccattcctcactctgttctcttctgtgcttggggcagagggagtagagagggagagagaattccccagacacgggctggcagatgtagctgaagggcccccgggacactaatagcaacagaaactgaatagctgtgtccaaggatgttattttaaaaagagactcacaatagctttgtcagcagaatcttggagaagaaactgcatcttctgtctctctttctctctctctcccttgctttctttttaactccatcttatttttctgtcttttaactcttcctctacgtatctatatatcatctattacttatcgacctgcctgtatacctgtttacctacctgtgtctatttctacctttcctccattctcaggttctgctgattcctagcagacaaatttattgtggtctttaacataatcaggaagaaattagcctttagaagaactaaaatctaaccccaatttctgtcattccgagaggttttttgctaaggaaattaagtcactttagagactagatcttacccttacagagaacataatcttaccctatttttctttacattggaggagaagaaagtgataccaagaattaggcacccctatgatcttatttccaagaggttgttttcgtcattctgtagctatggcatgtagggagaagatttctctgctaggtgtaaaaaggccagtcttctacttcttgctctgctaccacctgtctctgtgacctggaagcagatggcttcttcctcaagctcacagttttccattagataaaatggatgaaggggccagcattatacccacaatcatctgaaatcactgcaacaacgctgggtaaatatcattacctccattttttttttttttcagatgaggaaaatgaagttcagagaggttaggttattttatttatgtcctctttgtagtgcttataggaagcagaattcagatttgtacctacttctgcctgatgtcaaaacccttgctcttttcagttctctgtattgggtttctgaagagtaaagtctggatttatggctggtcactcttggattgggcctaggttatacgatatgtagagtggccacattcacatgaggttggagctactgagaagtactgagcctgtattctttctatattgaactgccatgaatgctactggtcacttataatgaattgatttattctgtttcttttgctcattctttctttcttttctctttctgtttttcttttgttttgttttgttttgtttttttgtttttttcagacagggtcttgctctgtcacccaggctggagtgcagtggtgtgatcactactcactgcagctctgacctactgggctcaataaatcctcccacctcagcctcatgagtagctgggactacagatgtgcaccactgtgcccagctaacttttgtatgttttggagagacagggtctcatcatgttgctcaggctcatctgattgctcaagcaatctgcctgccttggctctccccaaagtgctgggattacaggcatgagccactgtgcccggccctatttgggctcttttgatagtatttcactgggtaaactgttggcagaaataaacaagggattttgcagcttggaagaagttcagcattctggtgcccctgaatccaatgactcttcttttcagatacttagcatcatagaaatctgtcttgtttctccttggcaggggctctttctagctaggggaaagttgcttgaatgtgtttcaagtgagcactgatttcacaagctgatttaattcctccacttagaagcaaatcaacccattaaaagaagagtatttttttttctctcgatgattattctaggatgtacaaagcacatttatgttcatttcctattagagttctatggttatcctgagaggttttcctggttgggactataatttctacattacagactggggacagggggaagaggccaagaagtaagtgaagccagttgtgcaaagatacatagctaatgtaagggacagaaaccaaacccttgtctttggccctaaattcagtgccctctccagagctccactctattattttgtggaagaatgttctaaatcaagcagaagccttagggtgaccatatatcctgatttgcctgagaaattcagattttcccaggatatgttccttttgtctggacataatttttaatagcaccactatcattttcaaagtgctctggtttggatgataaattatatagtaaccctaagacactggctagcaactatatttcaaggagctcagaatctttcaaaagtcctgcaacatgtagacttaatagcagcacagtgtgataagtgttaagatagaaatctttataaaataggcacccacacaggaggtggtatttagctttgcctagaaaagttgggaaaatagcacagaagagctgatgctagaattagtaaaaaggtggacaaggtgatctcttttggttggccacattgaggtttttccttgtattgttctgtgttgaaatatcaagaaacatgcataggtcacacctacttagaaggcatcctactgctagctttgtgcttctgttatccttgtccttgcagctaagtgagaatcattgcagccggctgcagctttaaatcattccaaacagaagcacttgctgtggtctagatgacatgggagcttgagaattcacttggtctttaactaaaactcctagggtatccgacaagcccttagaagcctatagcattagacaggaagggttcttggtgtctcaatagtgtaacctctttctctgctctgatggttgagcccagtgtggcaaggagacttattcaaattaacagagcaatttggtttcagagctggaattgaagccaatgtcccttgtaaatcagttcatgttttaaagcaaaactgaaatcctctttggagttaaacaacccccagtttgcctctgtgaaattcttttgtgtcaaataatgcactcagaacttggaaagtgaatgcctgagttggagacccagatcaggtattaacacactgtgtgatcttgggcaagttattaaagatgtatggaatctcagtttcctcatctggaagaataatatcttccacatgaagtttttatgaggaatatttcgaataatgaaggtgaaagtgtttgtgaactttttattacagtatagacacacaacacaaggtctaccttctttatatattttaaatgtaaagtacaatattgttaactataagcacactattttacagcagattcctataactttttcatgttgcacaattgaaaccacatactcactgaaaagcaactctccatttcctcctcccccgagatcctggaaaccaccattttactttctacttctatgagcttccctactttacatgccatctataagtcgaatcatgcagtatttgtctttctgtgactggattatttcccttaacatggtggcctccacgtttcctataacatggttatctccttgaacatggttcatccatgttgttgcagatgacagaatttccttctttttttttcaagactgagtaatagtccatcgtgactaatgtgatgggcttgacagtaccaatggttttggtggtctgactctgcagctgctgatgattgctgaggccaaagaacaaatatttatttattctctccctttctatgtcaatcttttgcagatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtaagatcctaaccatgtgtggcatttcctgcagacattcaaagtctccgctatgccccacaaggctactcacctctaaggcagtgtcattggctatagccacttgagcatatctttattaaatgtactgttagggcttcatgaataccatttgtaaaagattagatctggaattgttagggcagggaacattgtatgatagggtaatgactgtcctcctatttccttgcctgtaataactaatatttggagaaagaactccattttgcatatatcatgtatttcaatgaggtaagaatgaatttatattggaagtcccactttttagggggcgccaagctgtgtactacttgaattaacagtaattatacagtaatttgctatgtggccttagactagttctcccacctctctgggccctatttttcgactcatccttaaaataaagagtagttgagcttgttgatctccaagggccttcccaattctaagaagctgtgactcatgcctcagtcccctaatgcactatttatgtgccacagttcttccccaagggactgacagcttagtccagggagtgagagttttggggccactagtgcttgtatgattctagagatggtcatgctgtcccgagagccccctttccaattatcctaccaaggaagcacctgccttccccgagactcaaatttcccagagacacgactcagtgcttctggctgcctggcctagtggcctttcagagaccagcctgcctcctggccttgcagatgagctgctattcccaggcattcctttccaatattgctttcttgatttaggtttagtcgggtagccctggcttctagatgaaagaaagatatgaccttcctctggggtcaagtgaagaatcactgggtgaggtacagaataggactacctcatttttagttgttgcctgtatttgattatttcttcattcactttttgtttatgtttacatcactaaagcctttattcatttgcatttatttttgaatgccctcaggagagtggaaacaaatggtaacatggcatttcctgatgcttaacaatgtatagtgccagcctgctgaatgaatgaatgaatgaatgagtgcacagatagatgaatggctagggttcatcctccccctgtgccacgtctgtacttggtggaatcatctgtgtggttgcatttatcatactgaactctgaagtatctatttgtctgtctggctcccccattaggctgctggttctttgagaacaagtttcagtttattcatctttgtcctctcatgttcaagcaaaggctagataggtgcccagcaaatgtgtgtttaattgactgtagatacacacacatacacatacatacatcccattgccacatgcaaatgaacgacactgacagaaaacactcacgcattgcctctctatcacatagaatgtcctgcttcagaaacaacagtgctggggccagcaagagaacaaggaatccaaattcaacactagcatccagttcttagaaatgttttaaaaacaaccttcaaacaagagaattattaacacactcagaacctcccatgaggaagagttgaggtagcagctgtgcttaaaaatcacccaaatgttattgcgactaatgtgagaaaaggagagaaagaattttccagtcttagcatttgaaaagaagcttcatggggcaattattccaatcttgtaagggggggctgtcaggaattactggtgattatctcttcctaaacaaaaatccaatttaaaaaatcattataaatactagctcttcgatctacaaagaggagatgaggaaacaaaatcatcctattgaattattcattgtaaccaattttattttaatgaaatcgactaggttccattactctgggcttggacataatctttgttacaaggagatttcagctgtaactaaatttgccataatgagatcagctcactggagaatacagggtcggggagggaatatgtgtgcaggctgggtgcagggccaggaagagggcagcagaacaaaagtctcctgaattcctcatctgaaagcaagtacctagaagtcattcacaaacacacacacacacacaccctaccaccaccacacacagaggcacaggcacacgcatacacaagtacgtgggcacacagacacacacacacacacacacacacacacacacacacacacacggagtctgcataattagaggtaaaggctattcctgaagtgtaaacgtaccttccttccaacaacagagaatgaggaggaagtataattgtgctcttcattaccttgtacagtgattagaagagattggtagttaattttcaccctgtcagggcttccagtgaagatgttgatagcttgagaggaggagctgggaggctcttagaagttgggcttaggaagaagatgggaattgtatcatgtgcttctcactttccccccagatgctcatactctccctcttctctctctctctctcacacacacacacacacatacatacacaaatttacacaccaaaaggccctgtaggagcatgggagtaccaaagcagatagaagagaatagcaggaaagaaatagtagttatcaaggtccaccaggcactggacacatgtatgcacattacagccaatccccttgtcattcttcaaggtaggaattgttgtctaccttggagaaactgaggaacacagtggcttcactataagttacatggtccataagggaagaatctaggattagaagaatctcatggaagatgaatgacagtgggtccttgggaacatgaggtcacattcaaaagttggaagtggctggattcctggaaaacttcactacaaaacaggcagaaagactcctagatggatagatctcagcattgagtgtcactctgcagacctcatgaggtacttcagttctccttgaacaaacttatagtcactgcccataccttcaaattcaggctgttcccattccctgacaaggtgcccctgttccatgatgccctggagttccctaggacactccattaacttagggaatgatgaaataacctagtcattcccatttcctctttacaattcagtttggtcccactttctgtctttccctgatgcaataaaaatgataaatgcgaaggtgtttattggagttatgtgcctagttctgtgctagagcctgtggaagaaaccaaagaactgaaatacccagcctctgacctagtcactgtacaagagttaggagtgagaattctatcaaaggcacattcttatcacaataagtctgcaggatctctatgactactgcaaagaaacaacatgcattgtgctatatggcttgagaatattgattaaaacttcagttttgatgttgtaaaagcctgccatatctaatggtttccagtgtttctcgttcattcttttcaaacatgattcccaaatttggttagggcaaagctaaccctgaacattgagtctcatatccaaatcttatcagaagtatcaaaacttcctggttgtgcaaattgggttgaacatcctataataagagacattctttggatattttggccatgcaccttcctggcccagctggaatcaagaagttcctgagacagaaaaaaatggaaattaaccgaaaaaatcaagttatctctcttctgggaacctcagaacctggtttggtttaagtgcttgcaaatatcttgtattgttcttatttggtctccatgtttcacatttctctaatgctttacacaaaaggatgccaaaatgagatgttgatattccttccttttaccccggcctccagcatttctaccaaagtctgtttcctcctatccaaacaggcacctccctcctttgcagtggcctgaggaggaaatggaaatactaagactatctggaatttacagtgctctcctaagggattacagaccttcagtcaaccaaccaatttatttccttaatcctttgagggtaaaacttagactaagcatttcaaggggagtagtttgagggccaaagtaaagaaaacttttcaaagaatgagaactatccacagtgaaatggagtgccttgtgatataagaagttccccaacataaggcattcaggctggacagctgactgaacagaagattcctgcactagaaggcaggtgagacctaggtatgcctcttttctttgtaattgattctctgactttatgtcccattaacccacgattgggtatattagtccttggccacttcattttgagttgctattatcattccttggcccatccataatacttcatgcctctactagaatacaaaccaggccgggcacggtggctcacgcttgtaattccagcgctttgggaggctgaggcgggcggatcacctgaggtcaggagtttgaggccagcctgaccaacatggtgaaaccccgtctctactaaaaatacaaaattgagtcggttgtggtggcaggcacctgtaatcccagctacttgggaagctgaggcaggagaatcgcttgaacccggttcaagcggttgcagtgagccaagacggtgccattacattccagccttggtgatgagagggaaaatccatctcaagaaaaataaaaataaaataaaatacaaaccatactataccttgtaatataacaatttatacattaatttatttattcacttgattgaacagaaatatatttgagtcctgcactgaggaatgtgagagagagagagagagcatggccgttaatgaggtgaagtagaaatcatgcagatctggctctgctctcttaaattccattctgacatggaaaccttgagtaagttactcttctgggaatcttagtgtcctgtagaaaatgagaatgataacatctacctggtagaaattaagatgaatgatatctacctggtagaaatgaaggatgcagagaaaacactctgtgctgggtttgttaacttgatgggtagttcaaatgttaattctctgtcttgttcatgtcaggtttccttctttgcactccccccaaagctggctctagggacccacacagaacagaagctcagtcaacattttgttgaattaaacacagttgcgtcagcaaacgtttgctgcatcctcagaactgcagcaggcactttgagaagcttcagagaagtactggttctttttctgccttcataaagcttaccatgtcatcagaagggtgttttcaactagaaatagtagccaaagacccaagagtgagagtgtaagatctagagggagtttccccgaggaagaaaccacactgctatcagcttactcagccagtagtgatgagagccagtgtgtaagatagaaaagtcctttgcccactttcagaagatcctggacaaattataaaaatagcatttatcaacttcttccaggctttccaccaaatttcacgaatcctactaaagctactacaaaaataggaatcactgttttcattttacagattaggacacaaaggctcagagagcagagtaacttgcttcagggctcatctctataaggggcagaaccaagatgcaggccactgtgttcataatagaaatacagctacaggaccaggcagctcaagcctgctccaatgactgacacatgagaacaagctagaagagctagtgtcttttgcatcttttaatatgtggtacgtatttaaggaacaccgggaaagtgggcattccctctctctaatacccaaaatactgccctacaatttttgcctgctgctaagatctccatcttttggcccccattctttcacccattgccctttccagagagttttctaaaatgtgtgtatggaaataagagagacacataagtgttgtaaattgccaacccttgcatgtaaaaattatttcttaaattttggaatgtctgcttaattatagtagggatatggggagaaaaaaataataaatgcacaaataggaagaagaaactttgctcaatttacagttttgtcacaagctatgtgctatacataggaaaccttaaaatgtcagtgaaagggaattgtaagatgtgcatattttctttctttttttctttttttttttggcaaagtctcactccgtcctccaggctgaagtgcggtggcacaatctcggctcactgcagcctccacctcccaggttcaagtggtcctcctgcctcagcctcccaagtagctgggattacaagcctatgccactatgcccagctaatttttgtatttttagtagagatggggtttcaccatgttggtcaggctggtctcaaacttctaaccttaagtgatccatcttcctcagcctcccaaagtgctgggattacaggtgtgacccactgcgcccagccagatgtgcatattttctgatggctgccaagtctgaggcaggaggggagaagccattcatctgtgtcttcttcatccttgtctccacagcaagggactagatacccactagggtattgtatggatacaaggataagaaatctttccacgtacacttatgatgcagtgtaggaagtgctcagagaggcggactgagaggaggtcagggagaagtgattgctgagtttcaactaagaggataagctggaggacaggagagggaggacgggagagggaggaaagaatcacataatgggggctgcgaggggtatatccaaaaaaaggtaaataatagatgaaggggaagtcaagagagatgagctaggaaacatggttaggaaaatcctgccaatgcttggaacttgacattatcctgagggcaatggggagtttttctgagtttttcagcagggggctaacatgtttggatcattgaaagaagaacattgacaagtgttgaacacttcttacatgccaggccctgtattattttgcatagatttcagaacaaccctgctgagaattcttaatattcctctctcaaaatgaagaaactgagtctcagggagatgaatcaccccacccatggtactctttcttctgttttcttttcttataccaggatactggtattgcattaaaacagcctcacttggaaattctgcattgataagcaattctgcaatgctaattagagtgtgctatttgcaaagggcaggaagaaatcctgtgctctatacccaatgccgaagtcacttctaaggggctctctgccccttccttgcctgctctgcctgctatggccttcaccaaagcattcatctcctctcattagtgaaatgagagagcctttgccaatggtggtggaaggaggaaaggcgaagggaacatgctgaaatttcagagacaattccaagcagttttcccaaatacccaaaggatctgctttctcctggtggtttctgaataatttttcaagagcacgtgtgcaagtcatctaaggagacagaacagaaagtaccatggtctagttcagcctgtcccatggtgtggggcaccaaaaaaatccctccaggaaagtaaaaatcagagcctgcctcagaaaggagcccactgagttggtcactataaccacccccaaaactttcatggaaaccttggactgtgggagactttaaatctactgaatcttatggggccccagcaaagagatctactagattctgctcctggctctctcttctattcatcctttggtcatttaccctttcaatatctgttcaaatctacaaaagtctagacactctggccctaggatttggactgaaaaactctgagtgactggagctttataaaaaatgagatctaggatcagttcaacctgattttcagttctagagtccaccacttactagctgtgagactttaagcaagtcagttctctttgcccccaccccagtttttcatctgtaatataggagtaataacatctccatggcaggtatttgtcaaggatgagacagttgatctagaaatacagttttccttctggtagcaaccgacaaagttttaaagaaacacttctgtctgcctgtgaagttttggcaactgaggaacaaatccaattaggaacaacatgtggactttttttttttttttttttctaacagaatagtatttggggcatagaaatttaaccagagagagactttgagagtctcttggtcttacttcacttaattaagacttggttttgattaaacaacttccctgaacctctcaatcccatccgttataaaatgattctggtatttggattcaaaatcaacagaatcttgtgaatcttctgggtccaaagcatcattttcaacatgaggttgaacaaagcaaccactgctctcaggcagtaagttatgtgccatggaggaaggaagacaccaaaatagcttctttcgataagaaaagacaaagcttgcaaagtgctgtgatatgtggacaaatggaattaaccttagaggttaacctttgaggaggaagggcgaacctgaataaagtgacaggttatgtagaaagtgatttttctttccacttgggcatttgggggaagctttaaaaaacattgtagtgtagccatattgtttcacagaggaagcataagctttaaagccagaaagacctgacttgggtactgtttgttaccagctgtctgatgcctggcgaatgatttcagttttctgagcctcaattgtcctcatcttcacatgatcctgctgtcattctgtgagatggtatgaggatccaatgagctaacatatataaagtgtataatacgtggctacgtcttgcgaggcatctaattcttgtcagttcacatccctactaaactacattatccctgagcaaattgaatctggagaaggaacaaaaatgtgtaagagaggaaagcaaggaagggatgggtttggcatttgtaggcatacaacaaacacatattgattgatcagggaaggtgccacgtggaacggtgagatcctgctttgaatagcgagtcttcatttttcagttgacacttgactcttgacttgaagcccaagaataagcaaggctttgtggtttggggctgcatctactggttctccatgtagactagataaaaccctgccaaccccttccatggcccatctaggaagattccttggcctctgtcttcctttttcttccaaacctggcctacccctatctcattaccttcattctccacatcctctttagcttcaggaccagaaacctttcttttatccctgtcatttgttctggctcccttaaaacccttctttgttcttgtctttcattttcttttcttttctttctttcttttttttttttttttttgttattgttttgttttaagtggggtcaccagcattcagccagcatggcctttgctgtgtaatttagtttcatgttctgtacccaagaaacatgtaaaaaatgtaaacagcgttcactctcctgggctgtaatgcacttaggaagcaatagccagttgagcttgctgagcctgctgctttggcggtattgaattttgtccctaaaaccacatactcatttctctaagtctgaaagtaaactttctcaagccagacccaaaggatggggttttgaggtgagttagagtttggctgtgcacaagattttgtttttatttttgtacacacaaatgtgttcatttgtttttgtttgtctttcaagtcccctcgtctctactctctattcctccccactctctattccttcccatccttactttgataaattagactgggtatgttacctgtagaatgagaccagaaagggccttctgcctcctcttaagaaactccaaccaggccaggcgtggtggctcacgcctgtaatcccagcactttgggaggccagggcaggcggatcacaaggtcaggagatggagaccatcctggctaacacggtgaaacctcatctctactaaaaacacaaaaaattagctgggcgtggtggtgggtacctgtagtcccagctactcgggaggctgaggcagaagaatggcgtgaacccgggaggcagagcttgcagtgagcggagattgggccactgcacaccagcctaggtgacagagtgagactccatctcaaaaaaaaaaaaaaaaaaagaaactccaaccatgattttcttaaaccctgattaattcttcagccagatccaagcaccagagcaccctgggtacatttgtacatgtttgttttccagggagaaatgggcccagagaggcccatgagagatgtccctgctgagaggttccctgtgccagggcagtccaaaaaagttgtccctggggctcctgcccaccccagaatccttttccaaacatgactcatatgtgcaggtggtgaaaggggacacttcggtgatgtctacatttctctccttcctggaagagaggcccctggggaagtcacaggtttgggagagatctggtctactggcaagatactgctttcagagatgcagatgccacctgggtaatgcccatgtctgcagtgcaactgactggtggcaaggggtccaggaagagaatatcaatttaaagcaacgggaaggaggagataaactgacatgcaccagggagctacggtcaggggtttatgtttcagagagagcaaaattgtatcagtgttcacaggccaggctccagactatctgtccagtagaaacttccatgatgatgaaaatgttctacatatgaatgtcctgttcagtagcctctagccacctatgatattaagccctaggaatgtggttcatgaaactgaggaactaattggtttaattttaattcgttaaatttaaatagcctatttgtgggcattgggttcccctactggacagagcaggtctagagtacttcacatgccagggctgctacttgcattgagatctcgagcaacttaattagcctctctgtgccttagtcctctcatctgtaaaattaaataattaaggggagatggtgagaattccatgggatagcacgcttaaagcacttaggacagtgcttggaatagagtaagtactacctaaattcattcagttctgtcattgcatcgaatctttttttttttttttttttttttttttttgagatggagtctcactctttcgccaggctggagtatagtggtgcaatcttggctcactgcagcctccacctcccaggtttttcaagcgtcctgcctcaacctcccaagtagctgggactacaggcacacaccaccacatccaactaatttttgtatttttagtagagacagggtttcaccatgttggccaggatggtctcgatctcctgatctcgtgatccacctgcctcagcctcccaaagtgctgggattacaggtgtgagccaccacacccggtctctccagagatttttaaaatgacatttctctttcccagagtgagatatgacatactaatctttttgtaactcaatgtcttaaattttttaagtctgcataaattctcactggaggacttttgcttttggatcatattctccgtattcacaagaaatattggtctcagtgatttctcacctgtgaagctctctattttgttccccatggcctataaactccaaaagtcttagcagacaaggccatgcacaatctctacctttgctttacagactattgcctaaggggcacgttccaggcagtatggaccaacttgcaatttccagatatatcttggggtttccttttctcctgcctggaaacaccatcatttgctcctcaaccttcttagggcttaattatcctacagggtttagctcaagtggctcctcttccatatccctcccctgacaacctcagcccatgagcagcctccctcttccatgtacagaatacttctggaattatcagacaggcttgagcacaagctgactttcagtgtgcattgcttgtgtccacagcttttcataccaaatgaccggttagcagctaacgatttggccctcatcttatgcctttaggtatttcctgtgcccagcacaggacctgctgtgtggacaatactcagaaaatggactcattaaatgatgttgttgggaacaatagctgctgggtgttacctcttttatgattggattaaatttataaatcggtgtctacaagtgattcccttatgtttccggattacagcctcctgttaataccataggtgatcaaagcaggcagggccttctgaaatcccctgtttcatcccttcacattacaaaggagataagtgctactgtgtgaattgggggaggaagaggtcccgaaaacccatcctgaacccagacctcatgttctttctgctactctgtgcctccataatctatcctcacccccggaatgttcactgcacagtgagaagggttgtttggtaactgtttttgtgtgcttactcctgtgtgttccagcatcaagaacagggcctggcatatagaatttcatgataaatactgataaataaatgtttttttctctgctaacagctttgggcaaaaagtaggaaacagcttctggaggctgagcgccaggaaggaagctctaccctttgcttcttgtttttgcaggaaagattggggtctaagcaattttcctgtgattggcttcctacagagatggatggaaatctaagggtcttcctttctgacttgagaatgtggttcaccttcagagagatctcccaatacaaggcccagcacaggagggtgtgaaggagtaagaggaagaaagatgggaggaagaagaggtagaggtaaaaggaaagaaggaatatagaatgaagagacagagaaaaaggaaggactacacaataacaacaaataccagtaataaccataatgtaatagtaatcacagaaattgataatgatgagtagagtaaagagaatggcttggctgtcagagtgattacattatgtagagaactctacactgttttttgtacatttaaacctgtcaaccaccgtatgaggtaactactgtaattaagactcacaaaggttaggtcacttacccaagttctacaggtagcccagtggtagaacagggaagtctagaatttgaaaccagagccatgtccctctacagccaggaagaaagaagcagcaagtgatggaggaaaatgtcaattttgtatttttagtgagtagggtgtatctaaatatttgcatgtgcaagagctctttgaatcctcacaatgctacaacataggtaccatcatctcattctgcagtggaagatattagagtttatgaagggttcaaggccatgttgtcagtgaatggcagaagctgaaattccaactcacattcctttgatttaaaatacatgtgtcttctggtgcttagtggaagattcagggaagtggcaggtgcaggggttgttgagaagttcacattgtggatcccagattctcaggcactgcatctcagaacagctgcttcaacaccctgcgtttgtgcagatgtctgttgccctggccaaggctgccactagggaaaagcatcactctggaaggtccttgttcctcagagaaccctgctgatagagtggtggacatataagtcaacagtgtccattgcacctgtggtggacaaagctccccggtttgtacatcacagtcactgtttctacctctgaagcctggaggggcaggccagggagaaataccacttttgtctttaaaaatgggagttcttgtttgagttggaaggtctgcaggatgctgttaaaaacataagtgactgctgtccacctgttcctttcatacatcactgcattgcatcctttggagactcttcctaggaaaaatcaagctcgaggcaacctagacaagagtactgcctcctcttcaaaagcaaaaggaagagagcgaatcatgtagtgattcccagcccttactcattgaggctataggaggggatgggaggaccctgaggtctgcagtgagaagcaggactcagagacaatgcactctgcatgatcatcttggcatctagtggggttccctgcaggtaatgtgacttgtacttcaatttcaacacaatctggaacacacagatcttaatttggaaagctgaataacaggagaaagggggaagaggggaggaaacaaaaacaacaacctggaaacttctagttttatgaacttgagaaagtcttgttctttcaagacagatgtttttaagtaaaaaatcattcctctgacctttcttgaataggccgatgcggtcaagactgccattaaccactgttcaactattcataaccaagggtttcggtgaccaggcaccgaacttggatgtgatcatcactttcctgattaacccatgaatgcccagggactttgatttaaaatcaaaggacaaagagaggtgtagaagcttcctaagacatccccctttagtcttaatagctctgagctgagtgatggagatgtccatattttagtgccttactccagggttgtctgtgtttctgaatttcactctagagccagcagagaaagcatttggattaaagctaagtagatttttgttttttatcttcagtgtctaaatctcagtcagtttcaggtttggggctatagagcagaaggcattacccagccctgttttaggattatggtgttttcgtattctggtccagaacttagaagtgtttcagtgctcaacatactgctctagaactgacaatgcctcgggccctgaaataaaattcatgatttttcaggattcttatctggagctggaaatgcctcagaattttctactgctggcaatagctctgtgctcctgtctagagttgagtgttcatcctgactgaagttaacagtgctctcttgatctgatccagagtctacactggttttatattctgatctagaattcatgacatttcattaatttctttcagtacaaatgcaaaaataaagtttaaactacagaaagttagcaatgtatttttttaaataacgtgctcagaactgtgtttgcaacaatattcagcatctcaaacttatccttcacgcctccgctgttgacatcatttgggaaactgggtttgtcatggcttagctgtggccgagtttttctcctctggccattttttttcctccagttcctgctctccagagcccatttgatattaagatcttgcctttcagacctggccttcagatatagattgcctcagcaactcccttctccaagcccctccctcagccttcagagagcttgaacacagaacctaccacatttctctatgagtgtttgcttgcttcgttcttcacctcccacccccatgggaggagaaggaatttttatctttgttgcttttgttcctttggggtccattttcttcatgtggaccatgggaatgaagaacctaacacataaataagtgctaaataaatgttgaatgaatgaatgacagaatgagagagacatagaaacatttgatcctaggctggacagaaaaaaaaaagatgctttcaaaagaaaacagatccctgggagcacccaaaccactgcctctcaccctgtaagaatacaaggaaggttttgcatcccactcttttaaccccgtcagcatcttactcttggaggtagcacatgtgctgtgaagtcacccacggaccatctggctggggatcccgtgttcctcctctgcagcaagagattacgtaaactggacagcagcctccagatgttagcagtttctgctcatttttttcctcccttttcaacaacaataataataattaaaacaaacacaggcctcatcccccacccgcacccctgaaattacaaacaggtgggcccagatgtcctcccccttcccatccaagggcctcctattcttgaggcccagccgccgaccctcacagggcctgccctgggctgagccggacagtcatgccagctgccctgtggctcaggccacagtctcccgaaaggggaaatggccatgtcatgagaagtctctgtgccagactttccctctccccgcctcccaccccaaagccttggcctccaacttaaatggatgtattttggaggactaggtggcttaagagattagtaatgagatcccaagtctttcactgctgggtcaggagttcataggcgggcctgggcgactagtgaatggcataattagggagacagggagcaggcctgcggagggcccgtgtgaaatgagcccagccaggcctttaatggcagcagttgtcagcagcacaaaaggcggccgccacatccgacactaatcactctcccttgttagaggatttactagctggaggagctcaagccccctgcccatctcctcctcaaaacgggcatctgggaagggactcggcccaatgcctggctgtactgtctgcagaacggggagctgatgccaaccccatggggtagaggtgtgagaactaacatttcatgcaatataaatgagtgactagtgtcattatattaatcagtacttccactgctattgtgaattttctttctccatttgaaaaagggggtggggtgggtgatgaatctccccatcacagtgacataaggatggtgtccatggaggtggaagcatttggatatttatcatcctcaccgttattgtcatcattctcattaagatcagcatgtacactgtgtgggtctcagttttctcatctgcagaatggactgggaataggagatagaactgaagtaacacagacttcaacatccactccgaacaggtgtggccttggcaccttatttattacctctgagcccaggctgtttatctgtaggacaaacaagaaggaggatagtaatactggcttcccgggaatgtggggaatctatgtttggaacataggtgctggacagtaaatgatggcaaagaaaacatgttagctttaccactttcatgaatggtgtcttaggcctctaacataagcttttcccttagaagaaggttgagacatctatctgttgtcccccagaaatcctgaacctgtgtgtatgaaattgaggaatttaatgagtagtctctaagaatcaattctatgattctgaaccatatcatttctaagaaacttagtttccctatctgtaaaaatgttagtatgctgtagggcaatacgtcttatatgatttctatattccctttccattgaaagcctggcttttcctccatgatcatttggtctggccaggggtttgcaccctaaatcccaggatttcagacttgtggggaggtgccagcctgaagggtatgagacccctaaggagtgtgaaatgcctaatgtgttagggacagatccctggagcaacgaggtgctaatcagcccagagctgagccccaaggctggagggcatccaatgccaagttatcttatcagaaagtgtctcctgggtagaggctctgagatctgctgctatttctagaactctgggagggaagaagaagccatctctctgtttcacactctggccctgcacacaggaaatgcttctttccttgattgtctgtctatgccgaataataaatgctcatattgaaagaaacgcaaaccacccctccctttcccctctatctctttaaggcaggcatcaaaggggaaagctgctctggaggcctggggaaagtgataattgtttctaatggttggtaaaagaaagcctggctcccccctctcttttttctgccattgctattaagtgtgtaaaaaggaagtgtgtgtgtatgtgtatgtgtgtgtgtgcctgtgtgttgtgttgtgttgtgtatctgttaaccctcggcttcccttaaagttttctgtgttcattggtcagtttggaattagaggcataagagggaagcagggatagaagtaggaatgaagagaagatctcaggtaggagaggtctatagtgctccgcaggtagtgggagaggccctgaacctgaagttggaagatttgagttgtgtttgttcattatatgcattaactgagatgagacatgtaaagtggtattgttgttatacatttttttttttttttgagacggagtctcactctttcacccaggccggactgcagtagtgctatctcggctcactgcaggctccacctcctggattcactccattttcctgcctcagcctcccgagtagctgggactacaggcgcccaccaccgcacccagctaattttttgtatttttagtagagacagggtttcaccgtgttagccaagatggtctcgatctcctgacctcgtgatccgcccgcctcagcctcccaaagtgctgggattacaggcgtgagccaccgcgcctggccatacattcgcttagcatctaagctggaccttcctctgctcttaatactgaagatagaaaagacaagagctcattcttcccctcagtgagctaatgaccaagttcaagaattgcaaataggattcatcttctaggccagttctgagcaattagagtgactccccatagtgttttgttgagaaggatttagaggcctaccttcagggatgcactatgtaattaatggtgcctgtcctgtgcaatggatgagagaatggtagcactgatgtcacgtgggaatgagtcctggttctcctggtccctttcctgcactacatggttattattatctctaaacattggtctaggccctatagactttgatttctagatctaatgcgtcaccaatcttataaagccttgggaaagccatattagtttaacataggggacatttggtgagccctgcccagtaacctgcattagacactgatgaaaaggaaagagaagtcaggcataggcactgtctttgaagctcatacatggagattcagatggacaaacaagaaaccataatgcaagtgtattacctcaagggtatggaccaagagttattgggaggtcaagccatggagtaagaagagaacagactttgcgtcagacgagcatgagtttgactgctaagccgtggcaggctgatcaatgcctacccaaacctcagagtccttatatctcaattggggataaagatgcttatttcacaagattattaggaaggtaaaatgagataatacacaggcagcacccatactgggcagaccatctttaagagttggtgctggccaggcgcggtgactcacgcctgtaatcctagcactttggtaggccaaggcaggtggatcacctgacgcctggccaacatggtaaaaaccccatctctactaaaaatacaaaaattagctgggtgtggtggcaggagcctgtaatcccagctactcggggggtggaggcaggagaaccgcttgaacctggtaggcagaggttgcagtgagctgagatcgtgccatcgcattccagcctggggtacaataggaagacttagtctcaaaaaaaaaaaaaaaaaaaaaaagagctggtgccctctctcactctcccaggaaagcactgaggagggagaacatcatctgataaaaacagcaaagcctggtttatggaggaggttttatttcacctgggccattctgtgtccaggttccctgaggccctttacagctgtagtcttataggctgtctcccagcaggctttccctcctgtagtcctcaggacccttaagaatcttggaggtttatatcaggaaaccaacttctgtccttcttgcacccttgcaattcttgggaaataacctggcattggaactgcaagcctgaggttaaaatgtggcctaaggagaaatattgagaaatactggctggctgtgtgtgtgtgtgtgtgtgtctgtgtttgtgtgtgttgcacacttgtacatttatgggtactgttagtgtcagtatccatccccgcactcctcctccccattccttttcctattttcttctataaggctcattcgcaggtccctttgggtggaaaaaggaaattggagaggttggactagaggcttgatgagcacttcctccctcccatgattgacaaaagggcatgtaaatctgtaaaatcgaaattcaatggaaacctcatggcatgtcccctgtgtgggaaaataccagagcccccgctccccctcttctccctccgtctccctgcctttgtgtacatcgtgtgtgggtggaagataaactggatttaaaaaaaccctttgaaagcaagacatcgttaactcctctaattgaaagcagtcttctgcaaaggagggggatttggaggcgggtgctggatgtagcggctggcagtgcactgagtggacaagagtctctgggtcctggagccacagagtcctctgtttctgcagacctggaacgcctagtcaccaccagacatcctggcccgtcacagaggagcttactgtatatgttcaagccggtctcttctccctccaccgggctatgtttctccatccatcaaatgtgagaattggagtaagaatttctgaggaccctcccagctcagatatccagtgatcccaaagctctggacaaaggatttccccagctattttgcagcttgcaattgcagacacaaaaagaaagaaagagagagagagagagaaaaaaaacacattgctagaaaggctgcagtaaacttttatgttactgttctgattgtctttgcccaaaaaggtgtcttggaaattagccttcagcttcagagaaagggacccataagtctcagaagtcaacaggatgttcacctgctgcacagtgtggctttgtttgtttctttgtttgttttacacttaattttagagtcaacattcttttctgcagcattcacctgagaagctggaaatcaaaagctggcagaatgtcaggactgaaaagccctttggagatgaattcatcttactctgtctttccataaataggaagagtgaaggtcagaaaaagtgagcaattgagtcagttctaggaggcaggtcccttgcctggcaattgcaggctctttctactgtatcactccactccggggcagacctgaaaaggcctgttttggtctgttgaagcagcttctatttcaggagccccagggaaagacaacaagaagtcccaagtccatcttccatgtggctgggattaagaccccgctagcacaaatatatctattctcttatttaaaaatctcatcacagccctgagagacatgtgggcaggctctcttgaagttaacatctatggttaagaatgtgggctaaacttgtgcctggatttcaattttggttctaccgctaactagttgtatgaccctaggtaaattactgggcctcgattttgttatctgtaaaatgcatatcattgtaatacccacctcacagagtcatggtgagcactgcatgatttagtacatacagagtccttaaaacagtgcccagcatagaataggcacccgatacatgttgctgctgctgctactgctgctgttgcctgctgggcccctattatttcctgtgtgctgggaaatctgctgggatttatttgaggataaataaaacatgcttctcaccttggaaatcttcagagtttaaagagatgaggctggactctatacaactataatctaacttgacaagtgctgtaactgaggtataaataaggaactatacggacacataagaaagagcaattaattctgcctggggagtgagtaaaggctttcagaggagggatgatatttgagagtggctttgaaatgcgtgtagtatttcacaaaatgggcaatgcagcggtggtgggcgtgggggttctgggctccagcatcatggagggggagtccacaacatgtgagagaaagagttgtccagcatgaaggaagcaccactgtatagatgccagggaagggagcacagagagcagtgaaattggtggaagctgctgaaaccagctcctgaaaacctttgtaagctgtgtcaagggaaggttccatcctgtggatcatgggcagcatggtgggtggataagtagcagggtggtatggttagtttttctcctttggaaagttaattatggggagcatttttatgaatgaatgtggtgggaccagaagcaaaaagactggtcgttggtgccctttctccaccagaggaagtggaggtttcagttgagtccaagtagcaattgtgttgctttgtaattaagtacgcagaacatggaattctagagatcagtcaactcctagttgtgatatacaactggatttaggaccttgaaaggatttttcaaagcctctgagcctcattttctcaccagagaaaatgcagtggctctaaactcccagactatcagggttaaatgatattgtgactatgaaacccttggtggatattatgactgtgggtgtccttaagctcctggggcccttaaaggtcattccgtgcaaccattcagtacaactgcagagggggaatcggagagtcagagaaatgtccagttaattggtgacagagctggaattaagccaggtcttctactgtccatggacggtatttgaaggaaacacagaatatctctgcagataatggatagtctaagggattctgctaaaatgagtgccccccgcccccaaggccaagtggacaaggggtcacttgcctttcaattcctccaggtgctaggatgaggatgagaagcagtcatctgcccagcttccataaaagacacagggctgggtatcttggagaagagaatggtgttgggcactagaattgccgtctgtcatttctgccatgatttcttgggggaagagatataaatgtcactggagatggttctacacagcaaaaaataggatcaataaggtacagaacataagtgagaaaagtgcactatttctgggagacagaaaaatttgctttttcataaacgtgttgctccttattggctgtatattgccgtgcaagatacctcccttcccttgaccactgcaaaggggaatgatctcagcagataacctattctagtcccatctaactttaaaataagaaagcttataggcattgctacttagaagaaacagtaggagaaagtggatccaggagtctctctctctctctgactgttggagaggactgtccaatggtacataggctttctataaatggaaatgagctgtatgtccatgaagtaatcaagaggcttatgtcatccatcctccaacctgagaggacctaagtgagggtgcttgtcagcccaaccacacctgctctttgcctaggactactatatcaatttatttttcccttcacttgattattttatgtaaaaaatatttaatgtatttatacattaataaatgtaattatttattgttgtcccaggacaacaaagctgtgacctgaagccaccccagggaccaactattttcttggaataagggctggggaagctgcttatagggtcctgctagattgcccaggatgggaaaagaagtaagaaggttttctgccaatgtagacaccattaaatctgtaccaggggttcaaagagtcaaatacattcaggccagtggatcaacattgaatgtcaacattttagtcattcaaagtaataattctttattttttattgtgggaagagcacaccgtgagatctaccctcttaacaaatttttaagtgtatggtacagtattgttcactataggaataatgttttactgcagagtcctagaacttattcatcttgcttaactgaaaccttatgcctattgattagtcactaatcacttttcccttccccatcccctagcaaccaccattcattttgtctttggttctatgaatttgattattttagatacttcatattaagtgagctaatgcagtatttgttttccatgtctggcttatttaacttagcataatgttctcaaagttcattcctcttattgcagattgcagaatttccttttttaaggtcaagtaatattccattgtgtgtatatatcacatattctttatccattcttctgttgatggacatgtaggttgttacatcttggctatcatgaataatactgcaataaacatgggactgggcaggacagaaaaacaggtttgagctccatggaatctctccttatctccttttccatttccctagggaaacccaaagcctagtggttgcctgtgtttctagagcactcttgatgtgttccacaagacagggagcaatgtgaaaggagggaccaggtcttgttcacaccagcatgacagagaggggaaaaagggttactgtgttacttcctgacatctctagggctggaaggctgggaagaaccttggcatcactggaaggatggaaaacagtatggctctgcacggggtataagaaatgtgcagattgggaagggggaaaaggttaagattgggaatgtcaccggagccagtgtcactgaagaaactggaggaggggagatgatgagcgaagaagagcttaggggtgatggtagggagagctaaagaggcccctagaatgcgtgatataactctcctgcatgtctcctcccaaaacattcagtaaagtcaacattgctcagcaatgctttatggagttggatttgcctttttggaaggtgaaaaaaaaaacacaggcggatgaaaacagagcatccccataaaatcagtcaccttggggatcacacttgtgtccttagtggccaactttgtatcatgggcaagcctcttttgtttgcagttctctgaagcctggcatgccatatgccctcagtaaatggctgctgaatgagcagattcactcaatgtctatgaaagcaggaggcttgtaagggtttgcctctctcttcctctccagcctccctccagttccccaggaacatagattattttgcagatcaactagggctttgggcaaagtttcagctggatttgttcattcttctctgatttgctttgactgtccttggtcaggattgcagccaacttgaaacaaacacaaaacaaaataggaaaacagaagaataaaataacaccagtatattcctttaaaaccctgtctagtgctaatagaactgacaagaggaaatagtatttaagcaataagagggctttgttcatgtcagagaatcctgtagctatgaatgcttcagatgcagagataagacccccaatccagccttcagagatgtgcttcaccaagctctgctgggagacaggcagctaagaacacaaggggaaagaattccaaaatgatacatgtcgaattgctggcctggatttcaaattccatagatagtttatgcaaagtcttgcgctgttgtaaagtgtaacacaatccactggcagatctgcctaaacccggtcccagttgtttttgagaaaaataaataaacttaaaaacgtcttccagcccatttaagtggctatgttctacccttagcctcctcagtgtgaggcttctagagatttgaataactgaagccatcacctaatttgtcagcaatgggataggagattcatggcatgtttcttctcaagaagttaccagtgatattcagagaattaatattgtgctttcagaacctatcaattcctagggccagggtgaggggaactttggcagctaacacatttcaatactttttgatgcttttaaagcaatgaaactcttttcttaaaagaaatattataaggcagctttatatatacaacaggtgagtgcagatgctctgtttgaaatagtagagtggaaactaagtagatcttctctacatcatgatcccctggccaacttcttcatggaatccaaggaatccatggaagacatgtgaaaacctattgtctaacccaacattcggatgtgcaaggtaaactaagggccaaaagacaagacaacttgttcaaaattgcacaccacattttggttatctgtattatccatattgtatttgcaactttactataaatatgaaattacttcaacaaaagttttatttaaaaataaaagtattaatgcttgcaactgcagattataatgcaaccatgtgctttgattagtgtctcattattataaagagaattgagacctggcattttccaagacctcctcgaagccagaaccattgcaagaagtaatggaaagagagacatttgaatttgcacagatttatagatgggattcccaggatggaatatagcatagaatatagatgggattctcagcaagatggtgccaagagtaagaaggatgggctgtcatagaaaattcagacctggtcccgttcattggagcccactgtactgaacacattgttaggaaaactgatgttgatggttttatatctattttcaatggctttctaagctaacagtttggattttttttaatttataaaattacatatgatgatgtaaaccaaaaccacctatgtataacaggtgtatgcactacctgaaattgacaactatacaagtttttcatatttgcttcatgtctctttctgtaagaaaaataacacaccacaaataagattgaggtccttttttttcctgactcccggtgtcatttcctttccttgatacacagaggcaactaccaccctgaatttgatgtatagttctctactctatttttaattcacatgaatcgctgggcaatatatagttttgctttgtgttatttttataaatgacgtcatgatgtacttatccatttgcaccttgtttcttttttcctctcaatgttatgttttgcgatctctccatgttgatgtctatgagcttaccattagggcttcctttttatttggctagagaccatactgagccaagtgttaaactatttttatatcatccttgtatatgaatccagtttatttctcttactgttcctttgccataatagaattctgtcatgtgaatatttcatattttatacatttctccaccaacaggagaacatatagactatttccaatcttttcctactatatttattgtagaaatggatattcttaatccttgtatatacttttccattttacttttgtttttgcttgttttaggtgtttatgtttgtttgatcttgttgaggatatatcactttttttcaatagcatatgagatcctcagggctctccaggtcagccgtacttttcggatgagtagaatgcactgacaagacatgaaatgacaggcccaaattcacagggaagttttgtgagagaagccacattagagaccagaggagaagtaccaatttgggatgaccttctaccaaagacctcaccgatttcaaggacagctcagctgttcctatcctctttccctcattgcactgttttctgtttatatttatatatacatttgtaattacttgactaatatctgcacacattgcctgctctaagctcttcagcatctgtcttttttatcattttgtcccagagtgtttgacaagcaatagttactcaataaatatcatttgaatgaatgaatgaaccagtaaacgaagtgacatttgaatatgcaagaaacccctaagtttgaagaatcctgcttgtctataaatgtttcctgtttcttttaatactgtttggtatttactatcattgagaatgaatttgtgtgtgtgtgtgtgtgcgtgtgtgtgtaggggtgtgtgtgtgtgtataaagtgatggaactgattttctttgttgatggaaaagcaaatactaatgttttcagtcttttctctgttgtaatatcacttggagcacaatttacagatttgttctaaaatcttctacttgacactcaagattctatgagatctaattgttcaacccacttttctgccactgtccctcagcctcagtagtaaccatttgatcacaacttaaggcgtttgatcaaacctaagcattctgggtttctgctttcctctgagccttgcttctgttccctctgcctgcaatgcccttcctcttatcactgccctactcttccaggcccaaatcaaataacaactcctccaagatttgtctccgtgagaatatctctgtcatctctaccatcaaaatatgttatctattatatccttaaaagtgttgaggattacctcttctacattagaatgtgagctcctggaccagattctggtcttttcatccctgttttttcctgtggtgccaagagcaaaataggtgaacagtaaaggtttgtaaaattgaatttagttgaacttctgacactctctaaaacatgattattttttctttatatttttccaggtgtgtcgaaccaaggtgatagatctcagtgaaggcatttcccagcatgcctggtacccttgcaccatcagctacccatattcccagctggctcagaccactttttggctccgggtaagctgaagctctgagagctttggaatctccagcagcgagccacagaaaacactgactcccatgaccctttctgaagatgggttgtctacctgctgagggtgttaattgtaagaacagggaacaaaacacttagcagtgtgatgcttcctgaaatggaatcctaattgctcatggaatgcccccactgagctcttgttttagcaaagagtttggatacatcttgtctgcctggaacctcctattcattgttcaagatcttttaaaattatcttttcctccttgagccttttactgatcaccagaaaaagaagtgaccattatctcccttcttgtcctgcatgtttggtcgcttgttggatggtacttgtcacatggtattacagaactgtctatggtctttctttctggctaaggattgtggatattactgcattttggcttgtgtgtcactgacctactttgaattcccaaaaatgcaagggccatatcttatttagctttctctcctcaaagccgagtgcagaggttgacatggagaagtgaaagataacagtatgcacctttttttgtgtgtgtgggttttagtgtggaccgggacctttgctacacactttactctcattatcttactagaacctcacaacaatcctatgatgtacctgttgatttttttatttttttttaatccaccatttggaaataatggaacttagacccagagtggcccagccattcactcaatgtcacacagctaagtatgagcagagaaagattgaaattgggtttctgatctcagagcctgtgctcttcactgttaggtttcattgcctcctccttcccatcttggacccctgatgagtagtagcccagttcttaaaaaggaagtttctcctcaaatgcaccccaatgtggctgcctccccaccacatgactgagtgcacatgtgaccctcctacgtcttcacaatttcaggcgtatttttctcaaccaatggttgccgcagctgtcattgtccacctggtgacggatgggacatattatggggaccaaaagcaggagaccatcagcgtgcagctgcttgataccaaagatcagagccacgatctaggtaagcatgctctcttggtcttggcttgctttcagtacctgattccacctctgccccataactagttgtgaggatcagcttagaatgagctcttccttcctttttcccctttcttgcttcttttctatttggcattctggttgccctcaaatcaagatgtggttatgtatccagagaaatcaagatctggcagatacagggataaggggccaatggccaagcactcccttctgccagccacctttaactcagacatcctgtattattccccacagaccccaagaaggagagagactgagtaagagccatttccccgttgtacatgtcaccatctgagacccaaagagaggcactgagagaccccaagtcacatggcaggtcaggaattactagttagattttcagcgtcatagcctattgctttttaccctataaccgggagtgttcatgaccctccaccccaagtggggactgtatcaccagtacaacctctggagaagtttccaatgagaataggaataggaatattgtaggagtagggaggcagttgaggagtcaggttctaccatgggaggacctccctgagtgcagggccaagggggaggacaagggctggacttggccacttgtaccacccctttgaatacccacatgcaccgtggtccagaggagagagcctgaatccagagctgacagctgaggtttggatcctgtccccaccactcactcaccttgagaaggtgagcaatcttcctgtcctcacagcacatcacttagaggctcacttgcttcacatacacagcaaggacaatgatatccaccttagagtcagagtgcactattatttgacactgttgtaaccatgcctagcacaagatcgggccctaagaattcctattgtcgctaagaatttcctatgacaccttcacacttccagtctaccctggagagctctgggcagcctggatactccaagtatttggaatttttggccactactgaagcctggacttcaaagttgtgcccacaccattctgcagagaacgcctttcaaagacctgtatgaagcaagccaggcaaggggtcatttcagggtcagataaaagccaagggagcagggaagattttcttgttttgtttttatgcttgtttatttagttccttttaaaggcaaggggaacctatgaataaggaagagaaagaaaacccctctggacttagcaggattcctgggaaatttccctaagtgagaaacaaatattttcatagttgtcgttgcacagcccagggctctgaggagaggttttttcagcagagtggggaaaagtctggttccacaggagctctttggatcctggtactgatgcctgaggcttttctgtttttcccctccacccccaccatcaccatcttcctcagtctatgacatcccagcattctccgaggcagcttcacctctggaactgagaagggcacctgcttcaggcttccacatgggagatttctccttacatagcaagcccgccaggacatggttaggattataccattttttggatgtgaaaactgagttttaggggctttctggagtcccattattaggaaggggctacaccagcatttaaactcaggtccacccaacaccaaagccaacttctgttttgctaattccatcttgccacagccttcctttccttctgtcccttgtgtatcttttctccctggccctctcccttccttcttggagaatgggaacctgctggctgcattaaaaaaaaaaaaaaaaaaaaaacagggctcttgagtgaggcaagcttgaattctccctagagttttagccatgcctgggctgtgcttctctggaaaaccacccctgcccacgattctcaacctcttctgcagactaagcaagaagtccttccctctcagggctgctcccaggttcacagattacttatgagagtgggctttttaccctgggaagcgcctgttgctatgaattatttccatcacttttccaactgaccaggcaggcagcctgaaactcagcaactcagaccaacaagccctacagcaatgtgggagggaggtgagggcctgggatgcttggctgaggggtggccatttgggggagggagagggactttgggcagtaggtgaaggggaagcttagggggcagggaggcagggggattggaaagatttggaaccaagaaaaaaaggcagacaaagaaactttcaatcagactcaaaatcctcaccggccgcccaatggtgcttttgtgcagtgacatgaaagggtctgggggcttcgggaagggcccgttggggagggcgtgactggccttgagtaatgagcctggcccctcggcccctctgtctcccctgacaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagaggtaagggatccgcggcagactcgccctaggccacttgtagccgagtggagacagtgtgattttgaagctgggtagccatttgtgtggatgtaaaaagtctgtgcatttctcccttctccatccatcctctggcctctggccggctctgccttgtggcccatgagtctctgaattcctggggcaattaagggaaacggttgtgtggtgaaaaaagaacctccttcacctggcttgcagcggcagaattgacaatagcttgcaggttgaccctggaaacatcggtttccttctctgagcttcagtgtcctcatctgaacaaaaagaggattagctctcttttatctctgaaatactggaatattctgcttcccgtggcacaagcaggaggcataaccttcctaaccaagggggatagagtgagactggtatttgcatcatcctagttcaccgtgtgtttcagggataggtgaaatctctatgtcttccacaagcctagctcctgtgacctcatgagtggtctaagagcctgtctttcaactgcatgacatcactccctcagtgcttttgaggtgccatctgttaatgcacctagtttggagctacaagcgagtggagtttcctgaaaagaatacgagctttgggaatactcttacttgggtttgaacctccacattaccacttcttgaatgggtgttcttgggcaagtcacttcagttttctgggtcatagttttctattttggaataagcagatgaaatctactccacagggtggttgtgagggttacatgttgcactatagataaaagtattcctgcagactgttaggcactatgcaaacataacatattaaagaagaatatttataaccatcttttgatgatgatggtgctgcttctgtgcacagaattttttgtaaagttcttaaagttagagctggaaaaagcttcagagattatctcatgcatctgacatgtccaaacttctgtgttaccatgtagaatcacagggcccagaaagggaagaacttgcgcagagttgcacagcgtctctcagatttgtttcatgaggtccagaagaagagagagttgtgatttttgtaggctacccaagagtgaggctctctgaaagtcgattcagccttgccctgtatacctgggggcaagaaaaaaaaaagagaagagggggacactagcctttcccacgcccctgttaccacagaggacacaaaaggtggttgcaaaatccacattgtttagtacccactgtctctagcttctgttgtgcaaagtctgtcgtaatctttcagaggcaagagcttcttaaatataattcattgtcttatttcactctaagaggatgttttccacaagcccttgttctccagaccctataaaaataagttaattctcagagcctagggaaaccatgtcaatggaaatccactagaccttttccacaacactttcccatttttaaccagccttcctgaccatccataagttgactgaggcccagactgacttgtttgaattctcgacgaatggtgtctgtgccctaagtaaatagtaggaaatatttaaccactgaaacatatcgattgatacgtatttgttagttctttggttgtaggaggaacattgaatgagggcaaaatgctgccctatatctgactaattatttgaccttggattagtcattccccttctctgggcctcagtttccccatctttaaaatgatgatggtggattgtgtggattctctgaggttcttttcagttctaaatctgtgtttctcaacagttaggaaacatgagagaggacaggaagggacaaacccttgttgagcccttaatagaaaggaacattatcttattttattattgcacctcttgaatagataggaacagtatcttattttattattgcacctcttctgcgaggtatggctcagagaaacagagtgagtgagtcatgaccattcaggcagtaagaggcaaaatcctgctttgtctgtccctgaaagccgtgctctgcctaccacagcaaggcacgagtagcagagaaggaattttcataactggacccatgtgatgatttattcagaggaactctgagtaaggggatggagctgcagctctgaggtctttggctgccttatccctgagcttggatcaggctatgacaggctgaatcttgagggctgaggctgcagggcaggagcacctcctcctgagtgccccagtggggaaaggacagcagctgttcatggggagctaaagaggcatttaccaaaacaagcaggactctgcaaacatgcaaatgcattaaaacaaacaaacaagggaggaaaggaaagaaaaataagcaacaactgtaaagaaccatgggatgttttccttcattctcaaaacaccaaaataaatagcatcactttttataacacaaatttcaactggttgtaggagaaacatcccactttactctcagctgtttcccaggtagtgaaaagtactgtttttcccctccccttctctcctccctccacaacctttcctctttttcctgcatctctccctctctctcctctcccttttctcccacctctccatctcctctctctctctctcccccgccccccaccttctcttacctcctttctcttcctcattttctgtctctcctgagagcagtgtgatgcctactgtgctgccttgggaggagtcctgtagcaaaaccagtttgggcaatgtgttccactctagcttcaggggtctccagtctctttgcagtacttggtataaattcagagacccaagaaaacaggatcaggtttcaaaggagaggtccagttgtgcaattctagccaaatctcagccccacaccaagttgtggaaaggagaaaaggtggggagggaaggatagtgatggggtgtggggtggttaataggcttctttaatgagaaaaactacagtggtgatattgaggctccagtatctgtcacacacacatacatgcacatacatcatgttcatccacgttgtggttcttaacagaaattgaacagtttattataaaattgaatggaccatgtatttagaaaagtaacttccttccctcctccctccatttattcttctttcctttcatgcttcctttcttcctctcactctttttcacattcgctttcttcctttatctcaaactcttccccatttctacaagctggtccattcagagagagacagttctgattgagagctaagttttaaaaggccaactttggggggcaacaagttcttcacatggctagattaactctttcagccagggagaacttagactgttgtttgttggttgggggtgggggtgcccaaagactggagccaagtatttctagagtctgtgccctgatgagaccccatgtgtagaatatctcattaggtaatgacacagggattcataggtaggatttggaacacagaatgaagctgctcttggccagagaccacagattgctcagatcgctgccataacctcattcaacttccccaacccacaaaggaattagtgcctctcagcacattgattgggaatcactagtctggggaatataactacaaatggaactgctgtgcctaagcatgtgtgtgtctttgactatgccaaatactgcctgactcttctccaaaatattgtccaattcacagccccatcagtgatctaccagagttccagttgctccgtatccttggcagtgcttgagattaccaagacaactttttcctatttttctcatttcaaagggctctgaaattatagacctctgttgttttgttctcataaaatcatgaggcctaaaagcggggaaggctctgaaagatttcctggttctgtgccctcatttgaggatgggaaatctaagttctaagcaagacaagtgactcgcctaaaatcacctaacaagttgggggcaaaaccagcactggaatctagttctcaggaatccagttatctttcctctccatcagaggtttcaaggctggtgttccatagaccatattagtccataaacaatctctctttggcctttattagttatctcctttaattagttgccaacatttaaatatcaggagagttcatattaaaaaacagaattcttcttggaactctttaaagaaatgagaagctttgaaaacatcaggccctccatcctactaggcaaccttggactagagcaaagcgctctgctctttggccaggcacataccctctcctcgacacaccccactcagctcgcttgaaccctgcaggctactgagcttgcatcacctaatcttcaaaacttgcctccataccacaccacaatacactggcgcctagaaatccagggtaaagaaccttttaggatcattcccccaggtgcctcatttctgggtagaaaaatgaggtcctagcatagtagctctttcactgtttcacttcctaagtgaacttgcagaattgatgccaagaacagttttccctccattttctagtgtggagcacttgtcttttttgttgtccccatctgagcaacccagaatgatttataaacagcctttctgtttttatctctgcttccctgtggcataattgcagctaagtggcagggcacagcagttacaccgtgagtcaaggaacagaaccaggagagggacccttgtcagccctttaacttctggctttatccgggttccagcactctccagctatcctctgttatgtgtgactggaatccattcttattgacaatggagacagcagtggggggattggctattggatcagataaggttttacctctacatggaatttgagtccaaaggtaaatatattaaacatatagataagaagaaaagaaaaacgttatttaagtatctgatcagctctgcaccccagggacctccacttttgcccaggtttgagaatttgatctatagaattacctgcattctttcccgctcatccatccaatcagccacctttctcccttcaaagaagtgtcttcatttttttccttcttttgttatttttattgactgcccatcactgttattaaatccttccctctttttttgaatgaagcagcagagccttttattttgttttccttgttttgttttttgtttttgtgtttcagaaatgacagggctgtatcacagagttatttgagacggtcagttagggtaatgtttatcatttttggacagtgtgttcacacaaccttgtccaactaacaggatagcaaagaaaaaagagcagggacttaggggacagactggcagatctctattagaattctttccaagctgagtgcccttgggcaagcaatttaaaactcttagtcctagtttcctgttcttgaaaatgggactaatatcactacctcaaggagttgctgtgtggaatgcaaataaggtgatgtaggtgaaacagagtggccaatgcctgacacatattacctcccttatcccttttcttcctgttttcaagcctgcaggccaggtgcagacagatgtgctgaaaaagcaagatgcctcaatccctgaagtgtattctggaaggcagtagtcctaagaaatgtcccatgaaaaaaaaatgttatcagagtttaaaaaacaatgtgtaccttagccccttctggaaattttcaatgggttatccaaattattgagaagtcctgcaactaagaaaactaactggtttcattaactcaatgctacccctactgatctgaccacgaaatcttttgatcaggtgattcatgggaccaaggaccattttttcttttatagcaaaaagagacagagtagagagactcatcttctcaaggagcttcatagttccaaaagcatttctctcgctctttctctctctcttgccctctctttttttatttttatttttttgttttatttatttatttatttatttattttgatacacagtctcactctgtttcccaggctggagtacagtggtgtaatcttgtctcactgcaacctctgccctccagattcaagtgattcttgtgcttcagcctcccaagtagctgggattataggtgtgcaccaccgctcccagctaatttttttatttttactagagacagggatgcaccatggtggccaggctggtcttgaactcctgacctcaagtgatctatctgcctcagctcccaaagtgctgagattacaggtgtgagccaccacacccgacctcaaagcatttctcatatattggccttactagtctacaaacacaccaagctccatcctgtgctggaattttatacctgctcttccctctgcctgattatacctctgccccaaacctgtgtatggcttatcccttcattttacccaggtagtagtttagatgtcccttcctcatggatccttctatacaaagtgccttgcccctttccaccaactgtcactataatttcaccttggtttaacggcctaactgcatgcatcattatctgaaatgatctcatgtattacttttctttggcacacaccctccctcctgaaatacacaggataacaggcatcttgtttatcccctccgtccactatattcccaatgtatagaacaatgtctggtgctcagtaaagcccccagtgaaggtctgttgaatagacgaatcagtggatgatgtctcaccctgttgacaatcctaagaaacaaattattttattacttccactttacagataaagaaactgaacctcaggatgttatataagtttccaaagtcagacaactgataaatggcagagcaggggctggagcccagatttccctgattggtaaaccttgtgctccttctaccccagaaaacgaagcatttcagatcttcattttcctgtgaagaagaacttaatgtgcacaaaataattggggagggcactatttatactttaatggctctgcaacttaaagaagaaagtcatctttccctctgggtcttcataagagcccaggtaccttctgagcgtgcagagtaagaatgcccaaactgttaggcacaggtcagaacagcttgggagctagtagcttacagagtaaatatatttaaattggaaccatgtggttccttcccctggtgcttacacaatgtgaacagatgcattgtttagtgtcaaagcccttgtgttgactccacagttacagtctctttgaggtctccacatggtacaatgctgaggctgtcaggagtaagaaaaagggcagagaattggagttgtctcaacaagtgttccttaatgccagttgccctgcatttcagaaggagagtattggagaactgcaaagctcccatcagtgagggtctgagacctaaattaaatgcttgtcctttctgggtctttaaaaaagtaaattggtttgtgatatgctttggaagcttttagctccccccgcctccagactttatttctcactatacttttgagcagagggtagagaataggaatagatcccagtaaaaccctcagttgggtatcgtgaaactgagagaaaacaaaaaacaaaaaacaaaaacaacgacaaaaaaaaagtgcaaaacttttctgacactggtttggccaaaatgtctccctgtctcctagataaaaataggaacataaaagccttgaggttctagatgtaaatcatcggtgcatacgataggccaggtgttgggggtagacacagtcagagaggcaaaagtcagagaaaactgccccctagaagcttttactgttaggcagaatcaacctctttaaagtgtttaagagctattgcaaggcatcatcaccattggtttcctgccatttaggaaacatctgcaaggaatttttattggcactgcaaagtacaccaagatgaaataggcattttctctgccctcaaggacgttctagtccagaaacatgggacaaggttaacaacaaggcctttggagtcacccctctggatgggcacttaaacaagtaacctaatcttgccagtccccaatttacccaactgtaaaatgagtaacgcttagctcatagggttgttgtaaggatggagtgagctcatgtatataagcaatcagcaaatagtaactaatgttattgagtgcttgcctaactataatacaaggggaatgatcatccaagaatgaggatttcatgctgtttctgtttgcatccttaaagattagcctgcaatctgttatgttccactggcactgaggaactgagtttttaatacatcaaacatgaggcaacagcattagagaaagaagggtagaatacccatgagggtgcttgccgagggacacaagagaaagcttcctatggaaatttgcatgatgcttagacctaaagaacgggtggaattcagactggcagaaaggtagaattcagagttgcagcaagatgcaagacatagtctctgtacaactccactaatgatgtgtaagttatcttacagtttataaaagacttctacctccatcacctcagttgagtctcgtggctatatgaggttggccaaatttaagagtataccgaagctcagagatgtgatgtactttgccaactaggtaatagagcataggtatatttacaacatcagctaccacttatttttatttatttatttatttatttatttatttatttatttagagatggagtttcactcttgttgcccaggctggagtgcaatggcgcaatctcagctcactgcaacctccacctcccaggttcaagctattctcctgcctcaacctcctgagtagctgggattacaggcgcctgccaccacgcccagctaattttttgtattttcttttttagcagaggtggggttttaccatgttggtcagcctggtctcaaactcctgacctcgtgatctgcccatctcaggctccgaaagtgctgggattacaggcatgagccaccgcgcccagcccagctaccatttactgagtgcttagtatatgccaggagttctgctatgcgtttttttctaaactgatttaattctcaaaatgatccttgtaagtgggaactcacaaaatagaaaaaggcttttgctcaacctggtgcctggtagaaaaatgcaataaatattcactgtaatcatgatgatccctttctcacaaatggaaaaactgaggctattcaaggtttaaatcttgataacatacaaagctttcaagtggcaagatttgaactctggtttgtctgttgtcataacttgtgctcttaatgagaaactttaatcgctgcctctagagtcatcttcaccctagccagcacccctttctgtcctcagtctcaagccccctgaaatcttggagaaagaggctcttagcctttatcttccaactgagcatagctgtcctgtgaggagactccttcttcccctcgtttctttcctccccagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccaggtatgtgcaggtgctgagctcagagcctctctgcagcccagggaaggcttactgggtgttaaccatgttctctgctaaatacccagcagcacttaaaatagtgctgccacatagtaggtgctcaataaatatttattgattaaatgaatgcatgaatgaatcaattaaccaagcaagcagtctggaatctctaagaaaaagggttcctgtgcagagtagtgttccacacaatacttaccaatgtttttgtgtaggttgcaaatctccaagaccatggggctgagtattttggaatgaatatcttacagtgagaacataattgaatgggctgctttatgacaaggtgagccctctgtcaatgagatgctcattcattcactaattcattgcaaagcatctgttcactggaaattggatgctatagtaagtactaaagaaaaagaagccattaagacaaatcgagtccttcttctgaaggagcttagtgcctagtggtggaggaagagtcagacaactcattaatgatgaccccactgtgtgataaatgctgtcaagggaattgtagggtgttgtggaggcacagagagattcaagggaggtgccttggaaaagtgacatggaaacagctaactagacagatcagcaaaggggtgtgtgttggggagaaggaagaaatatatgtagtaggcacaggcaaggatagtatgtggaagcacactgatgagaaaaaaaaaaaaaaacatgccacagatttttttgtttgtttgttttctttttctgtactcacccaagcaatgaggctggaagggccagctgaatccactggtgcagggcctgttgatttagtcaggaagtgtggggttgatcttcaggacaacagggagctgttgcaggaaatgacatggtcagatcctggttgacaaagtctcttctagatactccatgtgggtgtagcttggagtctagcagtaagactggtagcagggagaccccctccctcagacagtcatcaaaggagtcatggaagataggacgtgtcctgcgtgagattggtggtagtgaatgatttggagtgatgtgacagaatgttgcttcagcaagatggtgctgtaatgtcccaggtggggcttgggggagtgggacaggttgtcctgggatttgaggatttctgtcactaaatgtagcattttccagggctggtcagtggactttgccttcaaactgcaagcacacagggcacattccttactgctgggaatgcctatttgtacagaacttctggacttgctcttcttagacacctacttccgtgtgtcagacttggcaggcctgaactcctgtagaaacaattagactgttttggcagtgagggacctcactcaagcacacatccctttgatgtgtgcttaagagggaaaatgtcctttgcttttaaaatcccagatcaacgtttggcatctccagtccctaggatttagcggcttcctccttgaatgaaagcctccaggctgcaatgattgtccatcccttgactccgtagcatggtcttgccctccacccagctccaccatcgtgtagtttggttcaaatctccatttactctttcatttttcctaggcttttttttgtctttgtacccttctctcttgactattgagccgccaaatctgagagtagggagtggatctttgagcagttcatgagttcaatccatccattttgccaaagggagaactcaagtaaggaaaagggacttgcctgtggtctcataacatggaggaaaaacatggaggtctcctatagccatggagagtgcctactgtgtgccaaacactacaacaagttcctagtaactcctctagagctaataaaagacatacaaatcaacacttgatgtcctaccattgaactgtatttcacagtctgttttgtgaaagaagtcatcatgccctgtgaggtctcaaaacctcaagattctcatcaataaaatggaaatcgtgatctgggaggcactatagacagcagttaagagcatagcctttggactcaagtccaacttatccttttcccagctggttaacttaaggctgatcatgtaatgtctctgagtctcagtctctgtgtctttgagatctgaaatatgtaattcatggagttattgggatcattaaaagtgagctaacgttaaacactaagcattggtctcctagtgcctgggcgagactctgagccgtcaccttgggaagaagggtatttctccacatctagagctcagtctgccactcctcactatgcacgactctgcctttcagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggtatcaagaacgccttccccagctcagccttcctttgtctatgggaaacctagaagctgcatccaggccctctttctgggtctcaaacaccaagggtgggatgggttttatctatgctcctgacttcttcctactaattgtatttatgtaaactgccctgctatgcagataagaaagaaaaaagagtgtatggataattatgacagtgaagccctttccaagaccttggaaatcttgcaaaaaagaaaagaaagagaggataaaagtgaagaagggagggaagaaggaagagagaaaaagaaaaaaaagttacatttgggactgatgaaactaattcactctgtatgattagggccagtaagccttatgaggtaagcgttactattattcccatttcacagatgaggaaaccaagcctcagagggtttaaagaacttgcccaaggctgcaccatcagtggtggggaccatattgaaacccaggtctgttgttctccaatgctggctgccactcattaagaggggccagctgggcagagaagagcagatatggacaggaagcatctggcatcctcctgagctaggcaccagggctattgaggggaaaaagacactggcataccagagaagaggtcacattttagaaaaaagtgagtagctggcctgggtgtcctagaatgctgggactagatgtggaatgtgttaataactccagactaggaaatcatacttctctcaatcaatcagaggcttttgggaaagggaggtgtataaattaacattgattattacagacctcattgtggctaataataatacttaatcaaaatgatgcagatccttccactgccaactgttgttggggaagtgtgacctggctggggagacaaggccttaggaggaccatcattttgacagttggtgatcccaactttgcttttcctttgaccattcagggaaatatctctctatttccatattgatcaactaggaccaattgccacttcatgcaacttggttgtcagcatcatctagtgttcagagtactgtgctgaggcttctgcttggatctactggcagcaaggactgggcaaaggtcctgctgcctttctcttgaacttgatattgccacctaatttgccctcccaccctcatctcaagccagggggtaaagaggtgatcaatttcaactttccttcttttacttgcttcccttttctcctttctaccttttgtttttcctttgatcataacatagtttaagcaaaaaggacaacagtttttttaaaaaaaacttttattttaagttcaggaggacatgtgcaggtttgttatataggtaaatttgtgtcatggaggttcattgtacagattattttatcacccagttatgaagcctgccttaataccctttagccatttttcctgatctcctacctcctcccatcctcttccctgtgataggccccagtgttagttgttctcctctatgtgtccatgtgttctcattatttagctctcatttataagtgagaagatgcagtatttgtttttttgttcctgcattagtttgctaaggatgatggcctccagttccatccatgttcctgcaaaggatatgatctcattcttttttatggccacatagtatttcatggtgtatatgtaccacattttctttattcagtctatcattgataggcatttaggttgattccatgtctttactattggaaatagtaaaagcactaattttaaacagtcaataaataataatgataacaatgaccagcttgaaatcctttctgccctcagtttttgccccacctggccctctcctctatttgtacctcttgtccttcttaatctgtcttcttcctctgtacttccgttaaagtctaccccttaccaagtctacccccctgctccttgcaatccccccgtaccagcccttggctaatgcagccagttgattgagtgattgtccttattccagtccagctagtgcatttttgtttcctccaaacaatatagtggccaatattctttcacattctaacatgctagagatggacaagaactcagagacagctttggtttagggacaaacaagttaggtgatttgttcaaggtcacagataaattcatactttatgcattcaacaaatggataccgaggacctactattcgctcagcagtaggctaggctctgggagtaacgaatatacaagatacagcccttgccttaggatctagaaagtgccaacaccatgaggcaagtgcttagaataccagattgaaggtctagtatttctctccttgagttctgttctatgttaattttaatctttacagcactcccaaagagacttgatctcctgggtaatcttttaaatgaagtaataaaaataagtacctctcctttgacactgctacaagttgacaattgttttaatgctcattagagattggaatttccttacccacatttgtagacaggctgggcaggatgtatttttctgcattaaaagatgaacaagtgaacttacagggtcccaaaacttgacggacccaaaacttgatggaatctaatctctaatatcaacacctctatgaagagacgttaccctctaccaggaacttcaggctcagacatgccttcacttcgtgtcttgagtcatgttcccccaggaaatacggtgggggaatgaggacaggagacatggaactgacaaaagtcaacaggctctcttctaaagcaagttgccactgtgggcaactagagctcagtccctctgggaaactctgggagacggtggagaacatgcctccgagttattgcaactctggaaactggcacatgaatccaacaactccaccattagtttagtggtgcttccaggggcattaactccttggtactttaaactcaccctgcatatggacagagtaagcatcaatgaccagtataataagcatccatgagcagtataatagccctcaggcagagagttggcagtgcagtaagcatctttcacagtatacaggccagtgccaagaagacaaacgaagggcacatcatgtatcataccctactttcttcaaagccacattgtagatgcagggtagtggctacagctggtgcacagaaatactgcccagttgaaaactctcttggagtttgttgcaggggtggggggacatatccatggtcctgaatcaccagtgcctgctttagctgtggtgcactgctaacttctattcaccctcttccagaaagcacatttctggtttgcattttctctcttgattaacattttggaaactttatgttctcttgtcacagaaaaccacgactttcacttcataatttacaatatacatagctaatacaatgtactttttaagagtcccaacaccttttccacagatatgttatctctcttaggcaatttggagagggtgtgcttcctgtactttatatacagctccccttcccactaaccttgtgcattagctgggcaccccaaagcaatgactgccccgattacaagggcaatgcaaaaagaagtttgtagacactgactggtattctggacgcttctatgcttctatggaaaccaaatgaatcacctttctgcacactttactctttttacttgatgttaaaatatatatagttgtcagtctcacagtttgtcaatgtggaatcccctatggggtttacagacaccaatctgccttgtgctaaccagatgaatcatactgacaaagaagaaaaatgaaaaaaatgagaaggaataagataagtggaggagcgtacataaaattgcaaagtactttctcccctttcttccttttcctgctttttcttatagtacttggcaccttctggcacactaaataatatactttttaggataatttattgtactcctccctgtcccactagattataagcatcaagagaacagagctatttctatcttgttttgttttattttgttcactgctttgccttcaacatataaaagtatctggtgcagaataagcactaaatagatatttgttgaatgaatgaagacttctgtgaagattctttcagagctactaatgaagatgaaaagaagaaggaaagtgggaggaagcagggaagtgaagaaaggaaaggagggaagaaggaaagaagttaagaagcaaacgaagacattgacaacacttttataggcacttttcataaatgttgttttatttcatcttctcagcaccctgaaaggcagaagcaattgtttgctttccacagatagaaaaattgagatttgatggctccggaatgaataataagggccctgctgatcatacgtagtagccaacttcccattaaaaacaaccatctctgtagttagacagaatttgttttgaacctcagttttgtcttttgccaactatgataacttggtcaagtcacctctttctgagtcttcatttccaaataaagactgtcatactaaatgcactgtttatagtgagaataaatgagattgcatatcagaagcactcggtacatagtaactgcccagtagatgtcagttttctccctaccactccacctctccaacctgcaagtccccgagcccccgacatgtttccagccctgattgtcaacaccattcagtaataaccaggaaaaggagagtttggtggagaaacacaagtttcaggtcctcctctagttgtcttgggaaggttttaggcgggctgtgcctcgataatatatgagctggcagtgaaaagcctaactcccgtgttttacttttatttgcaacgttccccatcagaccagcttcccaatggcagtcagcactctgtcagagctggcatgggctacgggggaagtgctgctctttcacctgctttggcaaagcttcactgagcaccaggacctgaacagaaaatcaaatctcctaacacaatgctgtcacttccaggcattggtggtgggagctgggggaggtggtaggcaggacagatacaggggtgctgggcccagggggagagtggcagcttgaggtcatgcactcactgatatcagaatttgctgtagtttctggtgggagtttttgctgccaagtattagaaggcaagtgcctccatctctgtgctcagatgcccatttgtaaagtaagaaaaatggattcaaggattgtgagtgtgtcttttctatgcagcagaagaggctcaggatcagaagtcagaagccttggattttaattcactgtagacatgggggtaattcactccccccatttagatctcctcttctttgtggcagctctcttgatttccctaggctcctcagttggaagtagaaggggttggaattccacataagggatctcctggttcttcaagtcagctaaaatccaagtagctatacattagcttggctatcagagactcctccctcctctaaccctgcttgcctatgtcttccaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaagtaagtggggttggaaatgcaaacttatggtctctgggaggacaagagttaggttcaaatgcctgactggacggaagcactcatttcttcactggaggtaatgactgccattcatcccattctgttctgtgagaagctagaaggatttgttaataatattagctttgggtcaaacagaacaaactttaagtttcagcttggctgcctaatggcaatgtgatctcagacaaatgactttacttctctgcacttcattttttttttaagccacaagaggggtatgataataacagttaccacgtaaggttgttatgaagaacaaatgaagatgtgcacgtaaagtgctcacaaaatgctttgcacgtagtagttgttcagtaaatggtgggtaatcataacatgatggttccaacacacatcagaacactctgcaaaaaaggggagagaacctggggctgaagggcatgagttttgtctcaatctacatgtagctggaagcatgacatttctgcctgctcttgctaaaggagttctgtggatgaattatccttaattcctgcacgggtcccaccagaacccaataggtcaggtggggaatcaaaactaggaaataggaaatgggggcccagctggtggtgttcatgcagggcatggatctagccatttggtccttgagatgtctcctgtttgatcctttccttgaagacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccaggtaagcctcctggaacttgagattgataccatggtccctttcctttctgcttaccaaaaactagcctgtacttcaggaaccactttctgcacttttgtaatctctgatcctcattttcctacccgcaatactgtttttgatttgctcagagattcttagctttgaatttttttttaagcattggaacttttatgaaggaaatcatacatggaatcccaatgtatgaagttgataaaagttaagttcctcaaacaggaaatgaccagggctcttttcccagtttgctacctccattaccacccatgttggtccttgaagtatttaaaatcacaagactgcaactatatttagacatcaattggctcctgaagcataaggaaaaaggggaccatatttagatgagaagtacagttttgagaacaccatggaagaaaggaagagcagaaggagcaaggtttgaattttatctcaatccacatgtaactgagaacaagtccaacactcctgcctgcctctgctgaaggaattttcttcaaatcctacacatgcccaaaaggatggtacgggaatcaagaataggaaaaaggaacaaaaggctgaaaaaaccttaagtccacaaggagctccatctccatcaaagcaaccatgcagagttgataacccaagtcctgtgtttcacaggtgtgcaaggatcatcagccaggtggggatagatttcagtgcaggcgtcgtcttcaatcagtctttattggtctttattgttagcctccagataccaggcactgccaaatcaccattctgaatccctctcactccctccatatccaagcaattactgagtcatacccattctcccacaacagcatctcctgaagctgttctcttttgtccccaatgccactaccctcactcaggccaacatcaactctttgatgagccaccatgcagcttcgtgatcattttcctgttttaattcctgtgcctctttccagtacattcttcacatttcagccagagtgatttgagcaattatgtcaatctctctgaaccaggagcccccgtcccttaggataaagtcccaactccttagggtgacatttaagacccttcccccatgccaataagatggattttccccccacacctctgcattctctaccttaaaaagagttatccttgtacctttttcagctgtctgacacctcatcttccttcgcaatttagcccaggcaccctttcctgcaggagcccttcctcaatatcccttccactgccgggctccgtgcccctcctcaggttcccccttcacaacattggccacactgcgttgtcactgcctgctttcattccacatccccacactaggctgtgaaacagtccttcactgcatctgcacccttccctgtgccttcagcacttaggacagtgccaggcacctagtaggtactcaggaaatgtcacaggaattaagggcaggaggaaggactgcaatgaacatcaaaggcaggttcctccttttacagatgagaaaaccaagactcaaagaggttactcaaccccccatggtgacacagctggcatcggctgagtcacagtcagaatccaggttcccctgtctccagctgtaaatgggctgagtccagtaggcaccacctgagaatcctgttctcatacactctcggcgtctgtttgcattcatgggagtcattcccatccttgactgccagggaggcagaagccagtaccggaacaaacaaaggctagagattaccacggcctcttgcaggctgatcagcttccccctcactcccttacataaaactgttgctaacagttacccaaactgctgagccaaataatattctggctgcggtcatgttatcaaactgaaactcagcctgcctggggccttccaagtaactttcatggccagtttgtatttaaaggagaggaaagtgtaaatgtatcagacgactcaagcagctctgtttggcaactaacggagaggctagtcgcaaaggagcagggtattgcttgtctgctcaaagaatgagggtgtgcgtgccaaatggactcctaatacaattgacgtttctactttgtactgaaaatgaatttcctctaccctcagatcagggcctgagagccaaatctagtattcacctcagattccctcttgctgcctataaacatagcagaaatgcatggcccagagcatcttgaatcagcttgtatggagcagggattctttgctttccaaacaagtttcagatcctggcgggaaaggataggggctgttgtaggggagagtcacacactctcttccactgccactaaaagcaaataaaaacctgactttattcattccttgggagccagtatgacactggatctgtagtttgagttcaaatcccagctttattacctagtcactagaggccaagttacttaactcgttaagcttcacttttcttgtgtataaaatgaggagaaagaatactacatacctaatagtttgtttgtgaaggttaaatgaggtaatgaaaatagagcatgtctatgggtacccactggccttgtgcagtgcacaacctgtgcaatcatatgtggtagccctggggaatacacaaatgaactagcctgctttaaggtcactccagtggcgagaatcccttatgctctatgtgagctcctggagggtctagaaacacaacagattgcaacctagccctctgctggctagctctaaaaactgagaagttttctgttttctgcatatggctagccagttttcccagcaccatttattaaatagggaatcttttccccatttcttgtttttgtcagatttgtcaaagatcagatggttgtacatgtgtggtgttatatctgaggactctgttctgttccattggtctatatatctgttttggtaccagtaccatgctgttttggtttctgtagccttgtagtgtagttttaagtcaggtagtggaatgcctccagctgtgttctttttgcttaggattgtcttggctatatgggctctttttggcttaaaacctagatgacagtttgataggtgcagcaaaccaccatggcacctgtatacccatgtaacaaacctgcacgttctgcacatgtatcccagaacttaaagtaaacaaagcaaaataaaaacaaaacctgagaaggaggcacccatcctgcatgaggccaggatgtggagtagagagaccagcatgagctttagtcaaacctggtcccttgctcaaataaacctgtagaataaatagtcctctagttcctgtagaccagcactttccagtagaactttctgccatgataaaaatattcatatctgtgccaggcaaatgatgaccactagctgaatgtagctatggagcacttgaaacatggttgcagcaaatgagcaacaaaatgttaacttttatttaatttaaagtaattcaaagttgaaggcaaatagccatacttatacagtggctaccatatcagatagtccagctctagcacttacggtattctcgtctctttaaaccatgacagagaaccttaataataacagctttctttgtctttgtttttgagtgtcaaatgtgtgccaagctgctgctgcagacttgctctcttttgacagctcacaacatacagctggaaaagaaacaaaatccccattttacagatgcagaaagaaggcccggggagggtaagttcttgcccatggtgacaagagagcaggtgatgttctttctgatctctagctctgctctttccactgctcccaaacatcttcaggccagaccagtagtgaagggcagagattttatccccagggggtgagaagctactcatctcaggatttaatccagctcagatggccctgagctagttgatgagataacataggcctgtgggggctttataggtgagtcagggagtggccagtcttgggatggggacggggtctttggaagatgcatcagcaggggaggacaaaagctagaggtgctttgtgggcaaagtgatgcacctaatgatggatttcagcaactcagcaggagcaagagagaaagggagcggtggaatcttcaacacacccagctcattgcacagatcacagaaggtggctgtgaaagcctttctgccataaggggtgtagagctgcactctccatttgtgagccctgccatggacaaggtacagctcacatatgtgcagtgcctcagctaggttttcatttccgggttgttaaatgtttggccaagcacccaggatgtcctagaggaattcagaagagtcacagacccatgtgatgttagagctaggcaggacctcagagacccccactgtagcttgcttgttttactgatgggagccctaaaccccagaaagggaaagagacttatcctgagtcatacaagcagagccagttcttaaactacgtcactttgcaattcacactttccactcatcctcccttgtggggcaacatgtcacccctgtaccaaccttggaagacacaaaatgcatgtgagggcattgactgggaacagagacaaatgattcacagcagttgaaataatgagcacttactacatgccagccactgagatgagcacgttagattgattgcttcatttaagccccatggcatctggcattattgccccattttacagatggggaagctggtgtaaactggtttgccctgttttatacaaccagacatggtggaactgacactcttgtttttaagtcagcatgcctccaaagcttagccatctagctcctgcactcactgcctggttttgtcttgctcggatgccactacatttctttccgctattattttgtttattttcatgtcttctaaggagaagaagtctactgcttctccctcttccttcctcttctcttctttcccttcatcccactggggtacaacagcttacagtcaagagacatggttctgacattggcaacctttgtgacttgggcacattgcctcccctttctggctgctgtcagttccaaaatgtactgttggttgggttgattctaaacttctcttagagacagtacagcaaagtgagtaagaacctcatctgacgattacagagctcagtatgtgttaggctttaaatgctttatataattggactcacatgatcctcatgatcactctctcaggtagtagactccatgcccatttagcagtcagggaacttgaggcatagagaagttaaagagcatccccaaatctacccagctgggaagttgccaagcttgcatttgaattcaggcagtttgacttacacccaggctcttaaccatgacactagcatcatttgaaaactcactttttcactttctaacagagtcagtttccaagtctgcaaaaataatataatttctactctactgtattgttcaagtgatttttaaagcactgggcatgttataggtgtttgataatattattatatgccttcagctctccgtggatctgtgtagctaaagcagcaggggagttagagctcaatatgcgcttgtaaaaacagatgcacaggcacagagaggcaaactgttttgctgagagattttcagccctcttataagagatttcaccttagcatgaagaattgtacaactggagtcaaacatacccagtcagttccctgacaacacctagaaaaagtaccctctggtcttcccaggttggagcttcagtgatgccagatcttctctggtcaaaccagactcagtcagcaataattgactatgaatttctgcaccaggtggtaggcaatttctgaatgcactagcatctagtcttaaagaaggatttaaaaatccaaagaggctccagaaagtctgcatgcagagggcacagcaagggcaaagatgtggaggtgggaaagcaagaaaagtttgcaggagaaacaaagtgattcatttgtctagcaggaaggatacatacatagcaagagatggagctagaaatgtcatctggattccattgtagaagccctgaagtgccaacctaccagtatgccttgttctgaaggctaaagtgtcttagcaaaaggatgctatatatttttaaaagcaaattttgcaacacaaagtgccagatgaactgggcaggagagagataaaccaatgataacaaaaccagtgctttatgctcccacctttcattcatggtggggcctccccagtgtgaaactccatgagcagactctggctacttctaatacattctctgttacaaaccaagctctccagccagccctggcccaagtagtgctgaggtctgcagccctttaggggctggaatccaaatgcatcacaggcccaggccaaggctccaggaaattggggtcaatttcctactccccagagggcccaggagaatcatggggcctagagcctggggctctgagaaggagagtctgggctctttgaagccacatgaagctgcgtaagtttgccacgagcccctacagaacctctgggagtgaactctgcaagccgccttgcagctgcatgctcaggatgggccacccttctcccaaggccagagaggtttccattgcaattgtaccctccttttgccggcaaaggagaggcctggaaaggggcccctttctcttctgaatcttgtctatctgcagctgttttctcacataggggagcctcagcctacatcagttcttttaaggagtttattcattttctcatacattcattcataatttattccctcattcattcttttcttcatttactcacttgtgcatttatttcctcatctgtgtgttcatttattttcttatttcttaaagaaatacattctatcactctccaccaattcaccccatcttttcgtaaacaaacaattcttgaatgagcaaaaatatctattaagtgatgaatgaatgcactgagtggcctggaccttttaggcattgtggaaaaccctgaggatacaaggttgaatagggcaccagcctgggccttgaggagctcattgtctggttgcaaaacagatgataaacaaataggtaatgtcctgtcagagacattcaggtagtgccccatgcagaattgagatggcaggagagcaggatgggttgtgccagataaggtatttgcaaggtagacaagggtgggtaggaaacaatagcagacagaaggagcagtgagcatgaaagcacaacatacgatgccttcacaaatgcaggcaatttaaactgaagttcaaggttggtggtggtgctctggagagcaagaaactggagaattaggcagaattaaggctgggagggctctggagccagcacaggagtttgcatggaagctgaaggtcacaggaagccattgcataaatttttgcattggtggagcacagccagctcctctggcctcatgtcaagtttctcatcttattataagcctgaaaggggtagagaatatatagcttgttcttagatccttcacaatatgggccccctgcacagaaaccacctgtgattctccatttctgttcggtaaagtctaaactacttaagttggcatttaaggctccacgctttatctgtgttaccagctcatcttcccctgcttcatgccttgagtcatagaattagaaccacaacaggctctccagcacacacgatatttttcatcatttgcacacgcccttccatcttccaggaatatcttctgttccttttctgcctgcaattccatgcatccttgaaaacccttttccatatatcatctcctctaagaggccttccctgattgtcccctcataaccagttactcttccttgtgtactcacagcactggtgtgatatttgccctgcctcactgaacacagtcacactgacatggctggtggatcacatgactgccattcccactagatcgcagaggcaggcactggctctcttcacttctgcaccccacagagctgggcacagattggacactaacgaatcttacttgaattagctttctgaaattcggaggttggaaggggacgtcaagaagggattatgtcttcaagctgcatttgcctaatgctttgcagaagattgagaaactataattccctattttaaagaattgggaggaaagcacagatatataagtatccccatatcaccctcttcatgccattattgttggaatggaatgaaatggaatagaatggaatggaatgaaagaaagagaagatgagaaaaggaaaagaaatgtcttggaaaaaaagcttctcagctagacccagattattatttatgacagagccctgacataggatactttctcactatttaagaggaagtaaactttagtgttcctcattaacccatgctgctactctctgtgtcattcaaggagctgatgggctcctaccctctcaatttaaaaaaaaaactcccacacacaaatcaaaactataattggctctgattgaaatttctgaaagactactaagctcggacttgggagtttggcattctggaaagccttgaacaagtttcttcctggtctgagtcctcagtttccccatatgtaaaatggagacactaacaatacccctctttcagggtggttgagtttcaaccattgttaagaaattgttttggaacacttcagagctctggagagatgaaaaattcttttctgttgtattcagaatagcttattcaattggggctggtgtctctcttggtcctaactctgtttctctgttgttcagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccataggtatgatgggcccgagaggggagcagtaggaggggcaattccttccagcaatgcagggctaatgcctgggtgggtcattgaacaccctggccacatgagttcctgcgtaggcactacagaaagagagatgaattagtgtagaccatgtcctcccagaaagagggtcagggacagggatatggtgacacaatggtgggtgagtgtgcacagttacaacagaatacagaaaagctgtcaggtgcctggtggggacacagaagactcccacaggaagggatgcttacttggggatttgaaaaagcttgtcggggaagaaatgctattgcaggcagaagaaactctgtggctgaggagcaggagttatgaaagcacacatcacatttagggaagcaatagcagtctggtgcagcttcttttattattaatcttgaaatttgcatcatactaaacattcatgagtacctgatatagttcaggcccttcatcaagcacttgaaaggcattatatcttatcctcacaataacctttaacagatgagggaatcaaaacttgaggggataatggaacatgctcccaaatcctgagacccatcctattccaaagtctgacttctttccatggcatctcagctgcatccaagatgagcataaactgcattttcaaaatactctttgcatggtgacaggccagctcgagaaatacacacagtgagaagagacaagctgggattgtatgccagggatttgcctcgttgaaaccaggtgtctggacacatgcattaatcaccagcaccacagctttccggggtactcagagtgcatggagtgtgacctcatttaagggcagtgatgctgaccttttgggctgattccctaattgaccatgatgaaaagcctagggaactgaacatcctttctcctggccaatatgatttatagagcaatcaccaggggtgtctggtgtagaaggttatctgaatgtgcatagagccaacatgatcttcatccagcaaacagagagttatcactgcatgtccagaagcaaggcctgtgtggttggagagggaaggttcatggggactgtccatccttttttgaagatgaaaacacatgccctcagatagcagaagttcttcactgtaacttacagtgggaatcagcactcttgtgtttagcccaggacactggctcctgcatgggtcagaaaacaccaaaacacatgattgctctcgctgatggtttggaaggtactttaagatcttatacagccaccaattcatgagatgctgaccaggagtgttgcagagagatgggatcttataggacctgctaatataggcattctagaaggttgggcaacaagtattgccatggtgagcagcatgggctgcaccatcccaaggccaacactttctcctttccatcattcctgataggtgtgcgtggtcctgaacaagtatgtctgtgatggggtcccaacctccagctcaatcagaatatgcaagtgaatattcattcatactcttaactggcattgagtggctctgtgagaaaaagcctaattaagtgacctttagggaaaacctacagaaacaaatttgctgcatatctatacccactgacacattcaaatacattcacacgtgcatacataaacgcatgccacatgctgaaatgcttcataaacaaacagccccaaacacacacatcatatagtaagctcatgcctaacacctacacatcagccaaataccacacaaatgcatcactctcacaaacacatacacacacaggtagcacataaacctatacacagcactcacatgcaatacatacaaatctcatacttcaacaaacacaaacacattttatgtcccaaaacatatcaaacacacagaaagacgcacaaaaggcaaacaaacctcacagacgcatttacatattttattcacatgtctcaactgtacgcaaatgagtacgatacctggctgtcttctctccatcagaacagtggagaaagaggggaaggggtgggagggtggtatttctttacccactgagtgttttcatggtcaaagcagaaagggaaagaaatctatatgatattgcagcctgaattaactcctttcctgtaccccaagtccccacggctggcacccagatgtccatcttataaatgtgataatccagggcagatgatgagtgcatagggacactggaggagatcagagagaaaaagccacatagggagacaggaagactgagggtgagaatgagaaacaaggcaggagagcagtttttgctcatccactcctcagccccagctgtatcctcgctttcctccaaatgcgcctgacttccacctcccaggctgagcccttccctgaggagaatccactttgccaaggagagggatttgatcactggccttataagcaggggtgagatatgtgtcgggcttgggggctggagggcacattctggagtcacccagaccagctccccctgcgtgcctcccccaggccacctggggaggcttctgtggcagttatgagccctcagaaagttgctgctgctgccaccagggctgccaccctccccgcgcctcccgggaaggagacgcggaggcctggtgagatcaccactctgtaaggatgccaataatggctcatatatcacaacacagcagcctggtcctaaagccccagagctggggtaggggaggagagcctgggggagggagacgcggagaaagagaaattaagacatgaccgctgcataggacagcaagtgtctcctgttttgaccaccgttttttttttttttttcctctcttgggataagatagcctttgtctatttctcagaggctgcatttttttttttcaaaaggattttattatcacagccttgtctcatctttgctccctaaaaactcctttagaactggtctcatgataaagcacactccataagcagtttctctgactgcttagggatttttgctccttattctcatcactcatcatttttgtctgtgttatccccatttcttgtctctcctctggcctctcaccatctctcctgtttcgatggctgcctccttctctcctctctctgtgtggctgcactgttatcgattgtggggcctggaattagagatgtggctctctcctcaccagctttgtgccctgagctttgtgccttttggctctccaacctgtgaaacgggtgtcatgtacatatgtatatttggaagggggcctctgaaatagctaatacatacatatgtatatttggaaggggggactttaaaatagctaatagaataggatatttaaagaaaagagttgacttgctcctagtgtttggagggtggtttcgatactaagagaaatggcctctttcaggcctagtcagattctgacaggttgtttctttgcccacatgaataaatgcctctttggggtactgagtactttccatggactaggcttgatttttcagatgacctcaggatgtgtgaggtcagggtagagaatgaatgagctgaattacagtcaacttgccaacccacagcctggaagtcaactgtcttcacccaaaagttcctggaccaagggcttctatgtagtagccctatctctattagtcatttaccccttctttgactcattacctgattttttttattcctttatccatttaatccataactcactcattcacttatccatttatgtacttacttcttccttcatacgacacctaaatgcatattcatcagtcagtcatcatgccattcatttatccattaatccactcatttcctgatccattgatgtacttattcactcactgtctcttgcactcattttacaaatacttattgggtgcctataatctgccatgcacagtgccaagctctggacatagaatggggagcatgggtagtgctggccctatagagttacagtccagcagggaagagagctattgatatcacactcaccaagcaaacaggaaatgatcatgtgacaattctgtcatgggcacctaggaggggcttggcctgtcaggaaaccatgaaggtcttctctgagcaagtggcttgggattgaggtctgtaagatcattaaaaatgcacttgttggagtgggaagggtctttaaggcacagggaaaggcagggatgaaaccctggggcaagagaagctggtattgcatttatgtgctcatcattcactcggccagtgctcactgagctctacctgggtgtcacacgctgggttaaactccgagatgaatcaagcacatctgatgatggagtactctcactcagttgtggaattcagggcaaacttcttagaagaattgaactggcccttgaataatggatagaattcggttatgggaaggcagattgggggacatttcaggagatgggatgaacaagagaagaagcacagaggatgagaattgtgggactcagatggaaaaccaagtgtagttcagtccggttgaaccaaccaaagagtgaaggtggttagtgagagaggagattgaccagaccgcaggaggcactgagtgcccagcaaagggggctgtattttgttctggatgtggggagccttggaaaggtgtttgagcagaggaggagcttgatcaaactagggtcagagccaatgagtgtggcagcaggaaccagtcagatgggaggcatgtgaatggagtcagggagaacagaggtggccctgcctggcttgccttctccttcccactgccttcaggttgggtagctgagtccaccggggaccagggagtgggagggcccactctgcaggagggcagtttgcagatgttgagggtctcgggcctgagctgcgcctcatgctgtacttccctcagggtcggagtgtgccacctcgtgcctggaccacaacagcgagtccatcatcctgccaatgaacgtgaccgtgcgtgacatcccccactggctgaaccccacacgggtagaggtgagtgaccagggacatctacccacctgcagctaagggggagggaaatgatattgttgagcacttgctatgtcccggttctgagttcattctttcacacatattacctcatttaatcatcacacctgccctgtgggtgtgtgttgcagggaggtggggtagagtcgggaggagacttattcacaatcatttctctagtccttaattatttaatactttctctctgtcaggtcctatgtgaagggccttttatttactgtccactaaatgctgatgtcagcctaggaataaactgaggcaccaataacagaggtagggagcatagagccaggtttcagacctgagtctgtctggctggaaagtccatactcataaggatggtgttgtatggcttctctggtgccctcccatgtagccttccactttacatagcctaggtttctggtatccttctccaagctttacctgttttggggaaagcaattaataggtgtctagcaaactagtaacatcggttgtttgtggagaacctgccacgttcatgtgtccggtgcttagcacgaagactccattttagcctcagcacagttgtatgagagaagggtcattgtctgcattttccagttgtggacactgaaatctcggaagtgaggtgatgggccctgaaccaaggcttgaacccaaacctgagtctgagccctgtgtgcttcccacagtgccaggccggtgtgcccccagccagatgactacagaggccccctcctcagggcagtgtcagtttgacttcaaggttggctgttcccactcgcctttgtgtcacccaatcaactggggcccccagagctgatgtgggccctgcttttctcccccaggacatcgcaggtcccaggccttatgtgtcactctgggcactggctcttcaccctggagaaaccgaaagaaggaggccggggttgcggggtgggcgaggttcagctctgtgtctctccaaccagcctactgcctggggtgctgagaggccatggagcccagggagctactgtctgcctgcctgctgcagatcacactctggatagctgggcagaacctgatactgggtgtactgtttctcaaatgcgctgagggcacgattgccagggcttactcagcactccgagtgtatagacctggccagacctcctccactcctctgtgcgccccggcatgctcctccactcctttctgcttcctctttctcttttgctgtctctttttctgtcttcatcttactctcactaatttttttcctatctctgtttttccactctgtttctctctcctccctcttctgatatacctttcctcttgttctgtcttcctctctcccacactctcctttccatcatccactgtttctctctctctctctctgcctctgactctctgcatatctacaagacagccctatttcccaaacctcaagctctttcatctgtttcctccaccattcctgaaccagaattcctgcacagattcccccgagtgccccagtgcaccctgatatgctcatatacccaggcatgcagggagcccacatgtcagaatctcaaggcagctagagataatcaaggacaggttcctcattgtacagatagggaaactgaggcctatagaggaaggcggctggtccacacaggcagcacaactggaacgacaagctggacttgtgattggcagctcttccaatactaccagctctccttccttttcccacccgaactcccacatacccgaaagcaggtgagtttgactcacacacaaaacagacacaggagacctccctctcaccccagtatcagagatcttcttggcctggaccagcctcccacttaagacctttttcctaccccctgggcaaattcccacccttccctctgtgggccctgggcactaaagagttcagttatgattcactgtgaaataaatccagggatttgaaagcctgcaagctgccccccctccccaccattgcccacccgctgcctgcctgccccatcccccaacccagttccctggtctgcctgcctttattgatgctggcctaccgagagaaccataatgaggttcagacctccactggtctctggaggcctcattatccaggaggaaaaaaatgtggtagaaaaagggaggagggcgaagggcagagattgatgatttccaggaataaggcagaaaagctggcctctgctgcacccttgccccttgtgcggtgagagctacagaaatagagctgctggtgccagcatttccaggccagaggaggccctggatagctcctctgctttctgagggtctgcctgcgagcaccagtgcaatttagatagctgggggtgaggctctgctccagctgctgccacttttatccccggggtaagagagtgagaggcaagaactggcatttattgggcacttgctgtgatcaggcactgggtcaggcacttcctatcctttatttccacctccaccccctaccacacacgtacgaccacacacatatgtccctatcaggtgggtattagtctcttcctgcttccagtggaagtaatggaatctcagaggtggaagccacttgcctaagagaaggtgaagagagacccaggccagtctgatagtttacttcagctatccctgcagcctctatgaaatgtagagtaataaaggcaatacatttagtgatggcttaccagggatgtgctggcaaatagttaacaactggctctccacaaacattagactgactctgctttgtagcatttcccaatttctgtgatataaatattcctaccgtggcagatttcaaggtttccaggttgctgtcactgagcacaaagttgggaagatccaggcactgctggctcttgcgagcctatgcaagccagctgtggtccaccaccgacacttagccaagacagactctattttaagtcctttgcatatattgacatgaatgaagagaaagatgactgcttagatgagtggaatgtcaacactgagatcacaggtcatgatgtggacaccaggacagtgagctttgtgaaggcaggaccacggtcatattagttaccatagtacctcccttggtgcctagcacacagcaggtacttgctaaatatttatgattgctgagtcagatgacccaggttctagtgtaagctctggtgccttcctgctgtatgtcctggagcaaatcctgtcacttctctaggccacagtttacccagttgtgaagtgagagctaggcttcactcaggagtcacaaactgaaatgccacctgaaccaggcaggtggagaaatgagtgaagcaggccaaacatactcttttgtatattaaatactgaggcagccgggcgcggtggctcacgcctgtaatcccagcacattgtgaggccaaggcaggtgaatcacctgaggtcaggagttcgagaccagcctggccaacatggtgaaaccccgtctctactaaaaatacaaaaattaggcgagcatggtggcgcacacctgtaatcccagctactcgggaagctgagacaggagaatcgcttgaacccaggaggcggaggttgcagtgagctgagattgtgccactgcattccagcctaggcaacagagtgagactctgtctcgaataataataatgataattaaaaataaacactgaggcatattagtagtagtagtatttactgtaaatattttggaaagaaagacttgcagaaaaatataacacccatacacatactacccaacttaataaataaaaactttacagatactgttgaagttcttttctacttttctttttttcaattttttatttttatttttttttagtggagatgaggtctcactgtgttgcccaggctggttttgaactcctgtcctcaagtgatccttctgcctcagcctccttcttttttattgagctataacttacttctttaagtgtaaggcattataaattgttttgggtacactcatgaaaccactactcatattaggatgtggacctgtccaaatcttcagggagtcctccctccccaggccaggcaatttctccagcaccaaggtaaccactgttttgttctctattgctatggattggttttgcttatttgtaaatttatttgtagacttggtccctatcactacgaattggttttgcttatttgtaaacttcatataattagaaatcatgaggcattttcataagtgtgttttcaacttctataaagagaaacacaatgtaccttcttttttgtgtcctaaaccttctttttctcagtccccttccctgtacatgcacttttcaaagtgattagaggtacagagaactcttcctctaatctaataaacaaaatgatacaaactcaataataggtggaaatgcccctcaggttcaatgctagagagaaactgcagggaatggtggggactatggcaaactatggaaaacacagttgttgtttttctgcttccaaagggggacagcattagccaagtgcagcaatgtggaaatgtgggcctcctgtggccaaatttttcattttttcttgggtacaagaaatctggagttcttaaaatttgaaatctctttctttttttaaaaagtttggcaactaattttgactttttttaaacacttgtatgccaaacaaaacatttctgtggtttgtgtagcctagaagctgttggcttgcaacctttggatgagatagactattccagtctggagacctagaattctggggtggcagcctgtctcccatcagttcctaagaaatagatccaatttgctcacacatcgtcccttgcccagggatgctgagagtgtttcacaatagaaagtgcatctccctatcctcagaaccttataattcctttaggtgctgagaccttggcttttataatagcttctgaaaaaaaaatgggaggcggaaagagagggagggaatgacttaaggaaagaagaggtaaattgccatttattgactatctctaatatgtagacatggtttgctaggcaattctatatatgccatttcattttgtctccatcactccccagtgaggtaaggattatcacgttacagatgaagaagctgaggctcaaagaggttgtcattgcccaattcacataacgactgtggcagaattagctagctaattccactgcattccatcctgcaagggcaaccctcatacatgtcttttaaaaatatgcaacacatgcagacagagaatgcaaaattcagttgtgaaaagaaggtagttttgtggaaagccctgccgagtgtctaaaggtcagaggtcgaatggttctgagtgactgttaagtccagtctaactgacctagagatggagaactaagtgcactggaggggaagcccatagacaaagagatgcagccagaatctactgatttttttcattcatttatggacacgctcatacattcgttcatttgattgtccatttgttcatttacttattcaataaacatcgactatgcacctccaagcagatactcttcaaacactaggaatacgaagtgggaaatgcctaggcttttaaaaagcttaccctggaaagaagccagaaactcagtggctgataacaaaaagcaaataattaataataataataataataactgatatgattcactcatagcaggtcccagaaatcaaggaaaaaagctaagggaaaaagggcttatcttagaagacatccaggaggggtgtcagatctgagcctctggatgagggggctctcttagatgctttctcacatgtctttggctctgcttggggcctgtcttcttgggccttcatcttttagatgctctacccactccaacatttgtctcaaagggcctctccacctttctgaactttggtcttcccatcggtcaaaaaagtaagctattttatacttacagcttcaggggatggtatactttgaaggagattatggcgttcaaagcctagaccttaaaaccagataaatgtgggtttaattgctgactgtcactacctatgtgtacgatttggggcaggtcatttaacttctctgtgccccagttttctcttgtgtaaaccagagtcaaaaatagtacctatctcatagttacggtgagaattaaatgagatgaaagctctgagcccagggcttagagcataatatttattaaatagagaattttgtgccgatgaggatgaggatactgatggtgatgatgatattgacgttggtggaggtggtgatgttagtgatggtgttttcatgctggtgatgatggtggtggtagtggtggtgctatgatgatgatgataaaaagaagatggtgcagatgatggtggtgttggtggtggtgttgatgatgatgatggtggtgatgatgatggtggtgccaatggtgctgatgatgatgacagtgatgatgatggtaattgcaaccaggaagaaaagatagtctattcttcctaccaccaaggcaggaaatgaaagccttcttacaaaacctgatctgaaaaagctctggctgggctagatgtctcactggtatcaagaggaaaaaggctgacatctgaggggccccatctgagatctcccaacttctcctgtaaacagcctagccaatccttcagctcccactgcctgtcccctttcccagttctagcacacagaggggtcctgtagtgagacaggtggggcgtgcagccctgagtaatagtggaaaatccaaaagccttggaaagataaataggcttatgcagatagtataaaagtcctttttccaaactcacgtcaggtaaacctcaactgacagaaacttgtacaaccacaccaagacactcctacagatggattaaattagctctcaaataaacaggggaaggcatgggcatcgaatccctagtggattctaactctgctgttttccacttcttgaacctttaccaaatgccctccaacatctctggattttgactgggaacagactctcatactgagagaggaaaatctggttaagagaatgaaagcaggtgatcctcttcacccagccccatggctgggaggcagagggggaagaacgtagcttaattgaaagaaaggaatactgaaacaacccaaattccctcatttgtatttgtatcacattccttcatgtatttcttcactgtgctccacgcttcaccctggaaggatacagaagtgtctataactcaggatctgccctcaagaaacttaagaaattggtactaggtttaccattttcacagcatttatatgaatgcaccatctcaacaagtctatgatgttttcagtacctatcttgtggatgagagaaccaaatctcatagtggaaatgtacaaagcaattccaaatcagaattgcaaccacatctgtcccatatcatatcccatgacttttcccatataccactttatgcgtgtactggggatgggtagacaatttcaatagaagcagtaagatgcaagacagtagatttcacattgcaagactgattggaagatcatcaagttaagctctttctccaaggtctttgatttacttgaaggttgatagtggctacattcagcctatactaaactgatcctctaaactagacttgtttagaggacaagtctagtgcttgaccttagatgatcttctgatgctctagaagacaggaagacaagtaaagaaattattgtccactggtaaaatcatctctattttgagaagaatctgttcctttataaaataaatatttatttagcatcccctctgtcaggcattcctgaaggcatggcatatctaatgtgaacctgagattttatggagcagagaagaaaggcacccaatccagtcttggggtcacctgattccctctgtcacagcctcaccaagaggcctaattacaatttggctaccatataggtctgccctcagggagagaataggctgtttacatggattttccacattttggcccaggtgactcttcattttttaattaaaattaatcaactggcctctcagtcagttgaacaacctctgatcatgtggacttccatagttggttgttcacagttacctgtcactacacatctaagcatgtaccattttattttatttcattttattctttaaagaaataattgtaatctggcatgaaaactggggcatccatggagaatagaaaagggaacttccaggatttttttttttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagctaatttttgtatttttagtagagacggggtttcaccatgttggccaggatagtctcgatcttttgacctcatgatccacctgcctcggcctcccaaagtgctgagattacaggcgtgagccaccacgcctggccaagcttctagaatttttatggtaactgtattcctaatactatgttatctttctagtcttatttagctttcttatttcacccactttttaaaatatcatcatgttggattttatgttatgagctttattaaatcatttctgaaacaactggttattttcaaatcctggtttctccaccaaacagctatggagcatggggaatttactctcttatgacacaagattaatgcccacctcacatcatcatggcaagaaataaataagataatgcatacagtaattagcacaatgaatatactcaatatattttagttgtcattatcttcatcataattattatttttaaagaggaggctataaataagtgcctataagctctgcctaacggggctaggaaaagtgccaaagaagacataaattttgagcagacatttaaaagattctcaaagtgacaaaatggggaagggcattcagggaaggggaagagcaagaacgaattcactgtgggcaacctcagagaactgtgggcagaccagtatgacacggcagcaggtgacagcagaggggttctctgcctttccagggatttgaaccataggttggttcataatagcccatgtgctctcagactgtagtgtgcattggaatcatctgcaaggcttgctaaaatgcagagtctcagggcctggtctcagagagtccaattcattaaatccaaagcaggtctgaggaatctgccgttaattaaacacactcccacggcaatgctgatgaaagtggtcttcagctcatgctttgagaaatgctgctccacagttttctcccatccgcctgctgcagtcacacacatgtatgcacacatacacacacacacatgcaaacacacacatgcacacacacacacacacccctcctccccccaccttatcccaactccacgaatgggtcgaatattagtcgagaattttctgaaaggcctttctgatcgtgtctctaccctccagttctgcttctcctcaacccttgttcctgccagggaaatacagaaccatgacacatgcggtgaacacaaatattattttaatcttgtggctcctgttattgcaagtacccgggcaagttctccatgtaaaagccagggtgaggtcaggaattggaaggtcccagaagaggtgaggtggttaaatgtaatgccaacacggaggtgggtccctcccaatcccaagcccatctgacctttctctccctcttcccacagagagttgtctgcactgctggtctcaagtggtatcctcaccctgctctgattcactgtgtcaaaggctgtgaggtgagtcacaaggaaggcactcctcagttccctggaaataatcctgctgttgttattgttattgttatattaatgttggctatcctttgccatacctactgagtgttgaaaatatccatttagcagacttcttggacagggattagcagccttattttacagatgatggaattgaggcacagagatataaagaaacatactaaaaagcatagggaatgggtaacagagttgggttccaagccaggcttttgtggctccagagcctgtggtctacaaaatatgggatctgtaagaaaggaagggcagggggctataatgatttaccatctagaatatgctaatgttggaaatttaccaacattgttacatttaacctttacagagtcaggtgaggtggttttatttttaatttccattttactgatgacctttacttgcagacctattccttctgccccacatcttagtcatttactcatgcctcaatcccagaaggaatatgaatgccttagacctaaccattgagctgaagtgaaagagcctttataacccttaaattctatgacttcacagttgagccattccttacagcttggaattatagagatctgtctctgtgtgtcagtgacaagcttgggaggactcaaggagcatggttcttgggagatcagctgtgtcctgaagggagggctgtccacggaactcaaagacatttctgcacatcactctgccccttgtggctcttcccagctggcagtgaaaaagcggccccaaatcccttccaggtggatggccaaatctctgtggttcatccagagcccactgaggcaaacgcaggtgaaaaggatcagaccatgccctagaaaaagtcgtatctgatgaaactcttagaatgccagaaccagaaagactcttttacctaatctcaactaatcttttatttttaaaatgggtaaacagagacccaggcagtggctggatctaaaatttgatggaatgccaaaactgggaaggctcttaatttgatctagctctattttcttggtgtatagagtagaaaacgagggccagagaggggatggaatgtccaagtttgcacagcatgataaccacaaagacaaaacgtaagcccagctcttctaacgtccaggctggtgcttttctcctgctgcctgcctatgatccattccctgatctgtgtcacaagacaatccctaggttacacatttttttctctgcattgttgagggatttcctgagggcacttgacattgtacttgactttaggaaccccattctctcaggcttcaattaggaatggcaaaatcaaagccaaggccctgtggctgttgcttacttctgtctttttggatcaatccagcattttgggaaaagaaagcttgagttacctgggcactcattctgctgagttggcggtctgggcaaccagtgtgacagcggaattcaatccctccttggactcagcagtgagacccaagagaccctcacctgtcagactctgagccctgccagtgatgtttatcacctttgcccttgcaggtgcccctcatctcctgtcctctttagctttgttctaatagtgccttgtctggagctgaaaattatgcttagaagacatacaaactctgggactatcaaccttgaatatccagaggtatccaagataaagaaagggtttggggacccctgagcccctgttttctgcaccatgctgggtccaaagtgatcattcactcacttgttcaccaaagcttcactgagaacctcttatatgccagatactgttccagttctgggaatacattggtgttagtccagtgaaaatagtaactatgctctccttgagtcatctatgatatcttcttgcctgtcatccatccatccatccatccatccatccatccatccatccatcgttttactaaataaacatttatggaatctatatttgataaagttttgcacaaatacgagacattttgctagcaatctaggatacagaaatggatgatgcgcacagtatagtgaaggagatagacaattaaagagagaattttaaaatcctgaagagctatcacaaaatcaaatacaagaggctatggcagcagacagcatcctgaggctattaggggtggcattttggagaggtaacatttgagctagatcttgaaggatggtttgtttgtctgaatgcgttactagtagaaggagcaacatgagataaaccagagacaggagaaatctctaagtaccagagcttttctcatattgttccctgtctctagaaattctctcttctccacccccacctaattaactcctactcatctttatgatctcagctgaagcgtcatttcttcagggacttcactgagctccctgtctagatcaaatctttctactttttaatagcatcacaaacctcttctccatagctcttatcagagttgaaattggttaattagatgtgtgattatgtgattaaagtctgtctcttcaccagagtataaggtctggaggggtaggaactatatctatattaattcactattgcatccttttccttagcataatgtgtaacacatcgtaggaattaaatacataggatggaataaggataaatgaatggatggatggatggatggacggatggatggataggtggatgaaaggatatggttgcaggaaagaacatatagggtagagtaactagtgatgggactggagaattttttcagggccaaataaagaagtatcaccttcatttaatttttctcttttcccctagctacttctttatcaagccagttccttttattctaaggaagggacaattagtctccatcattattctgttcatttattacataaaaaagaacataacccacaggcagatctcctgaggcaggaaggaaaagaaagggtttattgtttgttgtttgtttataccccactgctctaatgtggatgtgatgtgttcattctggtggtcacacagcagagtcacacctgaacccacagccatatgcatgcacacccacacaactgagctcaggtcttccttgctctcagagctctgtctagctgtgatcttttagactctagtagtagagtgatgaaatgaaatctggcatcatgagttcagggtgaaaagtttctgtgagtaagaatttggaacagagaggcaaaagccaggaatgccacatgggatggagcttggttctttctggagcagtgaggatgggaaggggagaccactggatcacagatggcatgcttggatgcaaaggtcttaaacaaatgttgtctctttcccatgaatgagtcactgatctttagagaccccaaccagcactttaatcagagtggtttcactttcatctgctttctatattgaaatgtcacacaatatggcatttgatggtgaggagaggggtaggttcactgttttgagaaatcaatggactaatctggcctctttatttcattagtgggagtcctgaggcctagaggagataaggtcacttaaccaaaaccatgaagtaaccatcccattggctgaggttgggaggactagaacccaggttttctcaatccctgccaactgcccttgccactatgccggtacaattacattccacttcagaaacattattaagagccaaagttgtgtgcagccttaaatgaggtgattgggagtcaaagacaaactagacattgcccatgtccatgaagagctcacagtcttgcaccagctacagaaacataaacagaccacagaatacaatgtgctagcggttgggatgaggaaatacaagtgactggggaatccaagagactcctggactttcccctaataaggctctgggttcagataaataatggcttgactctattatcttttcttcatcttgggagtgtcctggggtggagaaacacacagaagaaaagaaataaatcagtatatgccagaacagccaagagagatgaagtaaaaaaccatagagccaacttagatttaaatcacttactctgactgtgccaatgtgattttgggcaagtccctgtctttgagtctccgcatcttcatctgtagagtgagaaaaccaatacctacctcacttattgtttggagagcaaaagaagaaaacaaacatgtaaaatgtgtgacatcaagtacatctgccctccttgtgagagggagcccactatcacacacagaccatggtgccaaattcctatgagttcttacattttatcttaatgcttcttgggcagtttacattcagcttcctaacatatttgcatatattttattacaaattacgtttttaattacatactgctgaaaaaagtgggagaaggaggcttacatttcctggtcatttctttgagtaaaatgagccctctttcaggaagatgtaagccatctattttgtggttttgcatacccaagcacacaagagtatgtctctcagcataaccatactctagttggaaaaaactgggtaagagtctttatgaatggtagaaagaaagataagagtctttatgaatggtagaggtgataactcattcaagggggtgttggggatgtgaagcctggccagctaatcgtggaaggctgtgaaaagatgacagacacccgaaggactgcagacgtcagctcccactcactccaggatgctaacaaggcctcatttcctccttctgtctccctttccagcccttcatgggagacaattattgtgatgccatcaacaaccgagccttttgcaactatgacggtggggattgctgcacctccacagtgaagaccaaaaaggtaggccagtgtgcactcctcggcagctgcctcctgcccacttctccagcttgtggggccaggatcactccttcatggctggacaacccttgtcctaactctgccagcactgtccacacgctttatttctttttttaatttttattcttttggtcagtagttgaactaatatcataggctgggccctggttgatttttgcagatgtggttctcaaagcttagaattgggtacggaagcaggtaataaaactgcaataagtactttcggaaaggaaggacaaagtgcttggggggctaggcaaggggtcagagaaggcactgcagagcaagaggcatctgcactgaaacttgagggataagaggaaggggtgaggaggtggtcaaaagaacggtgtctggagcaggagactggcatgtaaaatcccagtgagaacacacatttttagggggtagggctgaagtctaggaaacagaaaatagtacatccctaatgaggtcatttacagtctttgagcattttattatctatcttatttgtcacacctgtagaattagagaaagatggtcatggtcatggtattttttctttatatcaggacacacccaggagtgattcaagtgtttatagtaaaccaaagaaaaacattcgatagatgcacattaacccctcacagaaaagtggccacctccatttttctccgactgccgctgagaccagagtgaggagccccagccaagggttgggagggaggtggtaaccctgctagcctgggctgagaagcgttcttgtgatgaatgagttaatggaaaactatttctatttttatattcatctgcagtcagagctgaaagatcatttcatctgtgtcattttaaagaagggggaactgagtttctgagacaggaaaagcaaagaatcatagtcaatcatgcctaaagagccctctatgactatcttggcccaaacgcttcattttattaataggggcactgaggcccataaaagaggaatgatttgtcccaggtgacaaagtgaatgatagaaagagtgaggttcctggattccaatcccagtccctttattttgcaacatccttaggagagttggtttcttcaagaaagaatctctgacccaaaatacaggaacaaatgggacaagacccaaggaacacattctaatcagatggctgttagttactgaatcttttggttgaggaataaaatttctgggattgtccaggatcagtcagtcccaggtgggcaacagttttcagcatgcctacccttctttggtttcggtttggttttgatttttgattgataggacactgaagacgtacaatttttgcttaagtagagaaaaataaaattcattttctgttaaggaattttatcatttttttctaattatgaaataatgcatattggaaaattcagaaagaagaaaacaaaagaattcacttattatcttaaaaaccaaagaaaaccactgctttttattttggtgtattttattctgtgaattttgttaagtaagtgtgagggtatttttgtcgtctgtgtatatatcactgcctttctagcttgcaatcttgttttgcttagttttgtttacttagcacaggaaatcttagacacaagaattacttgcgctgagcacagtggctcacggttgtaactccagcactttgggaggccaagatgggtgaatcacttgggaccaggagttggagaccagccagagcaacacaggcagacccttgtctctacacgtaattaataataataataataataataataataataataataataataataaagtagccaggtatggaggcacaggtctgtagtcccagctacttgggaagctgaagcagaaggaccacttgagctcagagaggtcaaggctgcaatgagccatgatcataccactgtactccagcctaggcgatagggtgagaccctgtctcaaaatttaaaaaagttctgatagtagtataaacttctcagctgtattttttgctgcattgttgtttattatatggctgtgatgtatgctaatttatgtaaccatttacttcaacttttatttttaacttttggattatttcttttttcttataattttaactaaaatgatgctcatgagcgtctttgcacataaaatacttttatagctctaattatttctttatagttgattcttacaattggaatgccaagggagggatgtaagcatatttaaggctcctgatacctgtttccaaatgaatatagtgaacaatattatctattttcttccattggagtcagccacctttgaacgtgaatggacgatgaagtttgtatttgaaatagaagtttttacagaattatggctccatctgacaccaacggttggagaaagagcagctctgtttaaaataatgttcctatctattgtaacttaggtactaaaatataaaatatgaagctgattttttgacagagaactttccaaaatggattcctctctctacagagtgcattgtgggaatatgaagtcatgagaccagcctcgccaagatggtgaaaccccgtctctactaaaaatacaaaaattagccgggtgtggtggtgggcacctgtaatcccagctgcttgggaggctgaggcaggagaatcacttgaacctgggaggcagaggttgcggtgagccgatatcgtgccactgtactccagcctgggtgacaaaacgagactccatctcaaaataaataaataaataaataaataaataaataaataaataataatttggaatccgcacctgaacctcaatctcatgacttcatagtcccacaatgcactctgtagagagagaatccatttggaaagttctctgacctcatgatccacccacctcagcctcccaaagtgctgggattacaggcatgagccaccgcacctgaccagattccaaattattatagtaactttaccatatacatatatttgaacaccaagccaccattttggctctctgttcccatactcagttccagtgcagcaatttcagactcccaggccccaagataagcacagactcttcactaaggaaccccagaaccagttctttgctagctctgaatgcatttcatactgttgtttcctccttgtctacccacattataaatgtagttaggctttttgtgttaagaaatcctcttcttccactttaaattcttgtttcttcttgttggctgagggtgcagaatgcagatggccaagctgccttcatccaatgcggtgaatctccattgaggatctctgtgtgctcagcaccagaccaggctgtggacagtatttctgcccttgtgaaacgtgtagtctattagaggagcctgttattaagcagggagccacacaactattgcatttaattacttttgtggaagaggcaatgatgagaaagtgtgagattttatggagaacagcatgaaggtccgagaaagcttctctgaggaagggacatttacatggagatctgaagagggaacagagtcttcctggtggaggtgaataatggttgggggtagaaggggaaaggtctcttaaaactgtacatgaagtatggattagagagactaagggcctcctttatggcagataggactttgccatcattatttcagttgtggacaggtgtttggggcttttcagatgcaagattcctagaagtcttacttctggaaaagtgtctcagattaaagtcacacttcctacaatttagatttcccagtttgacttttaagggaactccaacttcttgaaacttttctcctctttcttggacacccccaactactccctgcagtagactggcttaaaggtggtgctagatggagaaaataaataagaacacaagacttccctaagtgaactattgcatatttcagacactctgcgagacacttggcctctgttatcctctttaatcctcttgtcaacacagagaggtcactattcttattcccatcacacagatgaaccagtctgggcttagagtacatatgggacttgcccaagttcacttggcaaatgagtggggaagcccaagtttgaacccagttctatctgactcaaaagttctgctttttctcctgcatggtgctgagtttcagaagaagaaagcatgcagggtgcctgtgtccttggcacaccttggcatgaccctccctgttctggttggaaacatttcaccatgagcccagactgccagggaactttggcaaagaggagagcagcttttcccagtagcagcaaagatggggtcgggggaagataagtctcccagccttcccatcatccctgacatccctggcagcccagagaggagtttcccgtgggcatccacagaacagaagaaagttctggtttttgtttccatcttccaccgcaggaagcctctcagagaaggagagaggttactttcctttcatgcctctgcccttacctgctggacctgtttaggtcccacttgtcccctcagccccagtcccatatcaagagacaatcccttcccttacacacccaggctagcgctcagagaaactcacccctgggtgagtttcaagcaccttcctaaatcacaggaattcagttaactgagcacttaatatgtgcttcgctgtggcctggatctctgtgcatgtcatctcacttaaactccagaataattcagccaagtagagcactgaggttgagggaaatggaataatttgtacaaggtgatagagctatgtttgggatttaggatttcctaactgaacaaatggtaatagctaagagttattgctttgctttacatgtcgtttcatttcatcagcacaataaccctgttgtagatgttgttcttttttctttttcttttgagatgaagcctcactctgtcacctactctggagtggctcacttcagcctcaacctcctaataagctcaaatgatctttccacctcagccttccaaatagctgggactacagacacacaccatcacaccatgctaattttcatattttttgtagagaaagcagtctccctgtattgcccagactggtcttgaactcctgggctccagtgatcctccagcctcagcttcccaaagtgctgggatcacagatgtgagccgccatggacggccctaggcgttatctttttaatcctcattttatagatgatgaaactggggcttagaagggttaaattcacacagttagcaagtggtaaagctaagatgcaaaccaagagaattcaagctgcacagcacctgcctctaaccccttggaacatccttttgcagcaggcttgtgtcttgcccaagcgtcttgtcctgccccttgtgggtgatattcttgcttcatagacctccaggaatggagttcttggtatgaactccaggcccagagttaagcactcagcatcttctcccagacttccttcttgccagttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtctgacaggggtgtccaatttcccacccagacacctgcctgcagtgtgaggcagacaggaaggggcaggactcagcctctcaggatgtcagtttattattttcctgttggagccttgaggagcctcaaatacaaagcagatttccagaatggttgctccagtggtttcccttcatgacaaaaaaaattcaatttataattggaatcattctaagtaagcacgtgttagggtgtgagggagaaaagggaaacaaccttaacatattcaacataccaaagctttctaaggtgtggtggcctggaacactagttgtggtcatgtttcagatggctgctaagagagtgattcttatagatgtctggggagttggggtatagtcctggttctgtgacttattaactctgtgaccttgggtaggccagactcactttgggtttttatgttttgatatttgaattagattcctgtctaataactcaacataacaaggctttctaaaaatgtgcctaaggactcttcacatggcttcctggatgagttggtcattgagcaggaagttgaaggctagttaagactgagacctacagagaataagaagaggttaatcccagaaacacatctcagcacaggatggtgcacccaattcatgcaactatgtgtagggctggctgcaatatttgctaaatgacagatttactaaatcttaaaccctacctaaatgagaacatggtttcttaagaaaagacattatacccaacatgtagcacattggtcattggtctaagaaggctagtgattctataagatatggaaaaataatcaacatcattacatggagagcaaccttcttagcagagtgggtgataacctacattgacaaagggctggatgttgggtagctgacttggggatgtacatcagtgtctcttcttgacctagcagccagaataatcctttttttttttttttttttggaaacagagtctcactcttgtcacccaggctggagtgcagtggcataatcttggctcactgcaacctccgcctcccaggttcaagcaattctcctgcctcagcctccagagtagctgggattacaggcacacaccaccacacctggctaatttttgtatttttagtagagacggggtttcaccatattgctcaggctggtcttgaactcctgacctcgcagaatagtccttttaaatccagtcagatcatatcacacctcaatgcaaagacatacagttccttcccattttacttggaatgaaaaaccaaagttttcccaatgcctacaaagctcttgggaaaatgtgggtgctttgcccacccacattgcttctctgactttgccccctttccactgtctatgccttttcttattcacctctggcattctggaccccttgctatccttagttcagctcaggcatccttctactttacagcctttgtcactgtgtcactggcaatttctttggctgagaaccctcttctattcatcctcatgactcactccttcacctctttcaagtctttgcccaagtgccatgttctcaatgactccaaccctgaccacccaacccacatcacccctggcactcccacactcatttgctttgccttctgtttttttttttctttctttcttccctaatacttatcaccctggcacacactataaaatatatttattatttatgatcagatgacccctactcctcttgatgctagaatgcagaattaatgaggataagaatgtgcttcttgtttgtttattgatatattcaaatttccagtgtacctcattgtttcctgtccaatagtaggtactcaacacccacaaataaatactttttgcatgagtgaatttagggtattacctgctgtgtgacagatactgtactaggccatgagcaagaacttggtcccagctgaatgaattcatgtcttatggatgagtagccagacatttagagtatagcaagtactcatggagacacagcaagtcaggaggtcagcgaagtttcccagagaaggcaacaccaaaggcaataaatgaaaggtccagaaggtatttcccagatgaaaggagtaaggaaggaccagagataggggtgggagggaaaagggtatctttggcgagaggaacagtctgtgcaaaggcccagacaccagggaaagtgttaaggaaattataattccctgagtatgcccagagcatggtgcaaggggaaaagggataaaagataagcctagatggataagcaaggcttttatcacccaagccagggagattgaactttatccagaggccagtggggggtattcaggaggatttgaagcactgagccagtgtagggaatcccagaaggccttttggaagagagagtagatatgcttaacttggaggattagtaagagacaacaagcagatggctaagcacactagactaactcttccatgttcaaaaattactggcttctggaatgttattaaaccctctgcctccccctgccccccgctttggaatgtagccctgactttttccttatggatgaagtaggcactcattttagcttggtcctatgatggaatccagcccttctatcccaaaaacttatcagcatcattatcaatgttattaccaccaccatcatcatcattacctcactgtcaaaaccatcaccaccatcaccactagcatcatcatttattgagcccatattttatgccatgcattattctaatgctttacttgcatttcatactttacccaacatacttctgtgtggtaggactgttagtacctcctttttacagatagagaaactgaagcccagaaaagggaagtaacttgccggatagcatacacgaaagtcagcaacagggcaaagactcaaacgtgtctttttctcctctaggccagtgctttcctctaatttacccatattttttccactttatcctccatttatccacatgaccactttatcttcatttaaacaagcttcgtatacattaactgttccacgttttatgccaggtactgtatccatcctacctttaagaaacttacaggggaatcctcgtccttggcatcatgcctttatctacttggtactcatgaaatctttccatcagcactgtcaagaccctaagactcaaccaggtgaagtgacctgccagtgatgtggccccccacagccagcaggagacacagtcaaagctctctgaccatcagcacaacatgactgttgtccctctccaaccggcacccccaccatgctctgctagttacctccctgtggagtctgagtcagaatccagcccctgcatgtctctcagctctggacaggatctgcagccagggccttgtggtatagttgcctgagctgcattcctgagccactcacactcacagatggaggtgttagcctcagcagctcacccagagggagaacccatgtgccggagcaccatctctagccccgagtaaaaacaggagagaatcctggcccttaatcatggacctggcttgctaacacaatcccagagtgggtggccaagccatttatgggacagcctagccacatggtgctgagaatccccaaatgtaaactggccaccatggtgttcatgctgtgggtggtaggttttcttgggaggccgcctgggggagaaggtggggagctgcttggggagtcagggaatctggcagttgggctcagagctctgattttatcaagatgtgattcttctctccatgcctcagtttcttcgtctgtgaagagaggaccctgactcctgctctgccgtcctcctggggcatggtgctgaggagtgccaggccacctgacagcccactgattcatctctttgcatcttagtttcttttaagatgtaaaatggggatagtaagaatagttacctcttagcattgctgggcagagtgagtaagataatgatgcacattgagtttagctcagtgccaggcacataataaggataaaggttattggtgattaaaaagacaaagcagcagtcagccttttcaggttgtgaagaaaataccttttttttcccccttctttttactctcacttgctgaaaagctctcaagtgtttgaagtggggtttggaatcctgcatcaccaactcactgactggtactgaggcctgagacaggttagttttgctttaaacattctgaagcctctattttctcatctgcaagatggggagctaataatgatagtctcccaaggtggtgcagagtcagagagctagcatatagaaatcatctggcatgtggaaggccctttggaatcactagtgtgtgtacaatggtattcaccgcttgagcctgcatgaacaggtgtccccaagtcctttccaggttagacctagcaatacctgaaaatctccacccttttcttctcagctttatatctgtgataagtgaggaagcttgtaacagaggaggctctgaacaggcagttcacaaagaggcaagaggagggaagaaaacaccatgtgtctcctctacattgggcactctgagagctggactggacctgacatgacttcactgactcctcactagagcccttcgaggtcttgataaagacccttgtcttacagatggggaggctgaagtccacaagatgccagggacttgctgaaagtcatacagtttctgtataaagtctacaacatattacttacaagcatgtagtggagacaaggaggctctggataggcctcctgagaccaaccctcctaggctttgtcatattctgattgagtttcctccagtgtttatttcggaagtgctgaaactgcccagactggcctggggaaggaagaaaaaggtgacaccaccccagcatagccagagtgccaagaccggcctgagaagctaactggtggcaaggccttaccagccaacaattttggagaagctgattgaactggggaggacaggaaggggagcattcaagacagggtctgtgaagaaattctatgtttcaagttcctttctggccaggtctttgccttctacctttctcagactgagaaggattttcagccagatgagaagttagaagctatgaaaatcaactcttattataggcagggaaacaagctcagagaagggaagtaacttgtccaaagtcacccagcaactgactgtaaaagtggaggctccctgacttgtattctgcctgcatattcatgcattcatttgttcattcattcatgggtcattgaatgcataaagactgagttcaataacagtcatggtccctgcccagagtgagctgacatcgaagtaaagaagtaattcagtatcagaagggtgcaaaaataagatgctgtgatatggtatgaaggtgatggtgctattaggttggtgcaaaagtaattgccgtttttaccattactttcaatggcaaaaaccacaattatttttgcaccaacctaatatctttggtcagactactgagggaggtagtgatacttgcgaaaagacctggacaatgaaaaagagctggccagggaagagcagtcagagtggagggccattagtggctaaggacacaaaagtaggaaaacagagtatctggggaaccaataaataaagaagccactgagagtgaggaggagaaggaaaccatgtaagatctgagacttatgtagaaatcagatcatgcaaggccttgaacttgtggtaaggactttggattttattctaagacatataattttttgaatgtttgccttgagtgaggtgcagcagaaagcacaaaagataaagcagacagacatgaaaccatccctcatgggtgtttgagctcaatgggaaagtgttacagacagaatattagagaagacattagaggtaactggatcgtgctaatgatagaatgagagcaagggtaggagacggggatggataaagcatgggggagttaaggacaaggagattgttcaagtgtggaaggtgggcggtgggggacaataggcaggaaagatcgtgaaatacgagtgagggagaaatctgattcagcatatatgtatttggcactgagcatctcaagggtgttaggccatgtgctgaggcttttgcatgtttcttcttgcttgatcctcagaaaaaatgcaacatgaaatatggtattttaaaaatcctcctttcatagatgtagaacctaagatcatgacagtggagggattttcccaaaatcattcaacgagtatgaagcaaacaaggatcccaacccaaaccttttggctttcatgatagtactttccacactctaccccagtggttggattttgacttggctttgccctcagtttccctgtttggactggggggttttctctctatgccacttccagttctaatattctgtgcttctcttcaaggtaaaatgaataggggcaaatattctagattctagatggaatatcctagatgtattccacaaagtcacagaggatggaaagtaaatgtcctaaacagagaacagcaagtagctgtgagcaagaagagaggtgctgcttggaaaaggggacggtggaaatgcttaccacagcatcaagcacttatgaatttaaattgaaaagagaaacaaagacttgtggtagccataagtacaaagagtcagagagagatggatcaatgaatacaaatttattcattctgtggcttagggcctgtgaaaacaggaataaacaagattgacctggtccctgccttatgggccacagaattggtgggaggatagaccaaaaaaataaaggagagggagcgggagagagaaagagacagaataattgagcacttagcatatgtcaagcactgtgtgaggtgttttcatgagttatttcatgtattccttatcacaacctcaggaggtctacacttttatttttcccattaaatgaatgagttcattgagactcagagaaattgtcacatgttcaaggtcacatctcaagtagatgagagagctggggcatatacttaaatctttctgatgttccattctacattttaaattattgcaaactttcaggatggagagaggttgggagggagggaaagaggtcaaagaggcagagaaaaaagaagaggtagacattgagaatgagtccacaagtacatgagagagaaggatagaaacaaagattctctctgagactacgtgaccacttggagaccctgcccaggcaggaggcaaatgaggtcattaaatccatctgcgcagatgggaggctctctggggaaagttatatgcaaatgtcatgatgcaatgaggtgaaatctacttgcgttagttcaggtggggactcaagcaggaactgcactgtgctctttggaaagatagattatctcctggatggggaagacactcactctgttgggctcttcctatcagtttgcagaaaggaaagctggccaaggtcacagagcacatgaaggaacgaactggcaactgtattgaactcagttctctcacttgttcgtatgctaaaatctgcttcccaggtccttcaaatttggtgcaaaaccaccatgcgatctattccctactcaggattccaagcctcccagaaggtggtctagcttccctgagacatgctttttgttttcatcattgcctactaaagtcaaagtgaccagtatgtgcagagacttatgttttctcaaaagacacttccacatcctttctttcacttgatcacttatacatcagatattccattacacagttctattaatcaactttgctatagtgcacgacaattttccacccatgattttactcagctcctatagtttaaaatacaaagtgggtcttattatatcagctctacatagggacctgaggctctgagataagtaagtagcttgttttactttaaataccagacttgacacttattattacttttggcaaattcttattcctttctgagcttcagtttccccatcaataaaagggtgattgttgcagcatctgtcttatagagttgtcaaaagtgttttcttgtttggaaatcactgagtacattgccttaccccatagcaaatgcctgacccatagcaagtgcctctgcaaatgaaaactgctgtgattatgatcatggtgtgctcgataaaagttatcaccaggatagcaagaagcagagccataacttgaacttgaaccttctgctcctcaaatccagtgattgtatccctgcgctgcactgcctttctgatcattactgcttcagaccaaatcacctgattcacttcttctttctgcaggtcaccccattccctatgtcctgtgatctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattatgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattcttctggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatact
